(12) United States Patent
Langan et al.

(10) Patent No.: US 10,851,135 B2
(45) Date of Patent: Dec. 1, 2020

(54) DE NOVO DESIGN OF PROTEIN SWITCHES

(71) Applicant: UNIVERSITY OF WASHINGTON, Seattle, WA (US)

(72) Inventors: Robert A. Langan, Seattle, WA (US); Scott Boyken, Seattle, WA (US); David Baker, Seattle, WA (US); Walter Novak, Seattle, WA (US); Marc Joseph Lajoie, Seattle, WA (US); Alfredo Quijano Rubio, Seattle, WA (US)

(73) Assignee: University of Washington, Seattle, WA (US)

( * ) Notice: Subject to any disclaimer, the term of this patent is extended or adjusted under 35 U.S.C. 154(b) by 0 days.

(21) Appl. No.: 16/796,009

(22) Filed: Feb. 20, 2020

(65) Prior Publication Data

US 2020/0239524 A1     Jul. 30, 2020

Related U.S. Application Data

(63) Continuation of application No. PCT/US2019/042651, filed on Jul. 19, 2019.

(60) Provisional application No. 62/700,681, filed on Jul. 19, 2018, provisional application No. 62/785,537, filed on Dec. 27, 2018, provisional application No. 62/788,398, filed on Jan. 4, 2019.

(51) Int. Cl.
*C07K 14/00* (2006.01)
*A61K 47/69* (2017.01)

(52) U.S. Cl.
CPC ........ *C07K 14/001* (2013.01); *A61K 47/6949* (2017.08); *C07K 2319/40* (2013.01); *C07K 2319/60* (2013.01); *C07K 2319/70* (2013.01)

(58) Field of Classification Search
None
See application file for complete search history.

(56) References Cited

U.S. PATENT DOCUMENTS

| | | |
|---|---|---|
| 6,217,864 B1 | 4/2001 | Coffino et al. |
| 7,223,556 B1 | 5/2007 | Zhou et al. |
| 9,765,019 B2 | 9/2017 | Hedstrom et al. |
| 2003/0153727 A1 | 8/2003 | Kenten et al. |
| 2004/0018625 A1 | 9/2004 | Struhl et al. |

FOREIGN PATENT DOCUMENTS

WO    WO 2015/138711    9/2015

OTHER PUBLICATIONS

Singh et al., "Role of intrinsic disorder in transient interactions of hub proteins," Proteins 66, 761-765 (2007).
Stein et al., "Synthetic protein switches: design principles and applications," Trends Biotechnol. 33, 101-110 (2015).
Takeuchi et al., "Structural elements of the ubiquitin-independent proteasome degron of omithine decarboxylase" Biochem J. 410, 401-407 (2008).
Westphal et al., "Molecular biology of Bax and Bak activation and action. Biochim," Biophys. Acta 1813, 521-531 (2011).
Wilmington et al., "An Inducible System for Rapid Degradation of Specific Cellular Proteins Using Proteasome Adaptors," PLOS ONE vol. 11 Issue: 4 (2016).
Wittman et al., "Engineered riboswitches: expanding researchers' toolbox with synthetic RNA regulators," FEBS Lett. 586, 2076-2083 (2012).
Zhang et al., "Control of DNA strand displacement kinetics using toehold exchange," J. Am. Chem. Soc. 131, 17303-17314 (2009).
Dueber et al., "Reprogramming control of an allosteric signaling switch through modular recombination," Science, 301(5641):1904-08 (2003).
Huang et al., "The coming of age of de novo protein design," Nature 537, 320-327 (2016).
Langan et al., "De novo design of bioactive protein switches," Nature 572(7768):205-10 (2019).
UniProt: UPI0006AB52F2—RefSeq Identifier XP_013725879 first seen Sep. 1, 2015, one page.
The International Search Report (ISR) with Written Opinion for PCT/US2019/042651 dated Jan. 17, 2020, pp. 1-24.
Ambroggio et al., "Design of protein conformational switches," Curr. Opin. Struct. Biol. 16, 525-530 (2006).
Aranda-Diaz et al., "Robust synthetic circuits for two-dimensional control of gene expression in yeast," ACS Synth. Biol. 6, 545-554 (2017).
Berger et al., "Computationally designed high specificity inhibitors delineate the roles of BCL2 family proteins in cancer," eLife 5, e20352 1422 (2016).
Boyken et al., "De novo design of protein homo-oligomers with modular hydrogen-bond network-mediated specificity," Science 352, 680-687 (2016).
Brunette et al., "Exploring the repeat protein universe through computational protein design," Nature 528, 580-584 (2015).
Choi et al., "Design of protein switches based on an ensemble model of allostery," Nat. Commun. 6, 6968 (2015).
Chothia et al., "Principles of protein-protein recognition," Nature 256, 705-708 (1975).
Clift et al., "A Method for the Acute and Rapid Degradation of Endogenous Proteins," Cell vol. 171 Issue: 7 p. 1692-1706 (2017).
Crick, "The packing of [alpha]-helices: simple coiled-coils," Acta Cryst (1953). Q6,30 689-697 (1953).
Crick, "The Fourier transform of a coiled-coil," Acta Crystallogr. 6, 685-689 (1953).
Davey et al., "Rational design of proteins that exchange on functional timescales," Nat. Chem. Biol. 13, 1280-1285 (2017).

(Continued)

*Primary Examiner* — Fred H Reynolds
(74) *Attorney, Agent, or Firm* — McDonnell Boehnen Hulbert & Berghoff LLP

(57) ABSTRACT

Disclosed are protein switches that can sequester bioactive peptides and/or binding domains, holding them in an inactive ("off") state, until combined with a second designed polypeptide called the key, which induces a conformational change that activates ("on") the bioactive peptide or binding domain, components of such protein switches, and their use.

26 Claims, 14 Drawing Sheets

Specification includes a Sequence Listing.

(56) References Cited

OTHER PUBLICATIONS

Delgado-Soler et al., "Molecular determinants of Bim(BH3) peptide binding to pro-survival proteins," J. Chem. Inf. Model. 52, 2107-2118 (2012).

Dou et al., "De novo design of a fluorescence-activating β-barrel," Nature 561,485-491 (2018).

Dueber et al., "A Engineering synthetic signaling proteins with ultrasensitive input/output control," 25, 660-662 (2007).

Dueber et al., "Rewiring cell signaling: the logic and plasticity of eukaryotic protein circuitry," Curr. Opin. Struct. Biol. 14, 690-699 (2004).

Dyer et al., "High-throughput SAXS for the characterization of biomolecules in solution: a practical approach," Methods Mol. Biol. 1091, 245-258 (2014).

Fleming et al., "Do all backbone polar groups in proteins form hydrogen bonds?," Protein Sci. 14, 1911-1917 (2005).

Gardner et al., "Construction of a genetic toggle switch in *Escherichia coli*," Nature 403, 339-342 (2000).

Giesecke et al., "Synthetic protein-protein interactiondomains created by shuffling Cys2His2 zinc-fingers," Mol. Syst. Biol. 2,2006. 0011 (2006).

Glantz et al., "Functional and topological diversity of LOV domain photoreceptors," Proc Natl Acad Sci USA 113, EI442-51 (2016).

Grigoryan et al., "Probing designability via a generalized model of helical bundle geometry," J. Mol. Biol. 405, 1079-1100 (2011).

Güttler et al., "NES consensus redefined by structures of PKI-type and Rev-type nuclear export signals bound to CRM1." Nat. Struct. Mol. Biol. 17(11):1367-76 (2010).

Ha et al., "Protein conformational switches: from nature to design," Chemistry 18, 7984-7999 (2012).

Harrigan et al., "Real time genetic compensation operationally defines the dynamic demands of feedback control," bioRxiv 244020 (2018).

Huang et al., "High thermodynamic stability of parametrically designed helical bundles," Science 346, 481-485 (2014).

Huang et al., "RosettaRemodel: A Generalized Framework for Flexible Backbone Protein Design," PLoS ONE 6, e24109 (2011).

Ikeda et al., "Molecular interaction and synergistic activation of a promoter by Six, Eya, and Dach proteins mediated through CREB binding protein," Mol. Cell. Biol. 22, 6759-6766 (2002).

Isaacs et al., "RNA synthetic biology," Nat. Biotechnol. 24 545-554 (2006).

Joh et al., "De novo design of a transmembrane Zn2+-transporting four-helix bundle," Science 346, 1520-1524 (2014).

Khalil et al., "A synthetic biology framework for programming eukaryotic transcription functions," Cell 150, 647-658 (2012).

Kosugi et al., "Six classes of nuclear localization signals specific to different binding grooves of importin α" J. Biol. Chem. 284, 478-485 (2009).

Kuhlman et al., "Native protein sequences are close to optimal for their structures," Proc. Natl Acad. Sci. USA 97, 10383-10388 (2000).

Leaver-Fay et al., "ROSETTA3: an object-oriented software suite for the simulation and design of macromolecules," Meth Enzymol 487, 545-574 (2011).

Lee et al., "A highly characterized yeast toolkit for modular, multipart assembly," ACS Synth. Biol. 4, 975-986 (2015).

Linko et al., "The enabled state of DNA nanotechnology," Curr. Opin. Biotechnol. 24, 555-561 (2013).

Liu, "Allostery: an overview of its history, concepts, methods, and application," PLoS Comput. Biol. 12, e1004966 (2016).

Maguire et al., "Rapid Sampling of Hydrogen Bond Networks for Computational Protein Design," J Chem. Theory Comput 14, 2751-2760 (2018).

Matsuzawa et al., "Method for targeting protein destruction by using a ubiquitin-independent, proteasome-mediated degradation pathway," PNAS 102(42):14982-87 (2005).

Moreira et al., "Hot spots—a review of the protein-protein interface determinant amino-acid residues," Proteins 68, 803-812 (2007).

Natsume et al., "Rapid Protein Depletion in Human Cells by Auxin-Inducible Degron Tagging with Short Homology Donors," Cell Reports vol. 15 Issue: 1 p. 210-218 (2016).

Ng, et al., "Modular and tunable biological feedback control using a de novo protein switch," Nature 572:265-271 (2019)—with supplemental materials.

Nielsen et al., "Genetic circuit design automation," Science 352, aac7341 (2016).

Perez-Pinera et al., "RNA-guided gene activation by CRISPR-Cas9-based transcripion factors," Nat. Methods 10, 973-976 (2013).

Perkins et al., "Transient protein-protein interactions: structural, functional, and network properties," Structure 18, 1233-1243 (2010).

Prehoda et al., "Integration of multiple signals through cooperative regulation of the N-WASP-Arp2/3 complex," Science 290, 801-806 (2000).

Raman et al., "Engineering allostery," Trends Genet. 30, 521-528 (2014).

Rehtanz et al., "Direct interaction between nucleosome assembly protein 1 and the papillomavirus E2 proteins involved in activation of transcription," Mol. Cell. Biol. 24, 2153-2168 (2004).

Renicke et al., "A LOV2 Domain-Based Optogenetic Tool to Control Protein Degradation and Cellular Function," Chemistry & Biology vol. 20 Issue 4, p. 458-460.

Rocklin et al., "Global analysis of protein folding using massively parallel design, synthesis, and testing," Science 357, 168-175 (2017).

Schneidman-Duhovny et al., "FoXS: a web server for rapid computation and fitting of SAXS profiles," Nucleic Acids Res 38, W540-4 (2010).

FIG. 2C BimLOCKR$_a$ Key Sensitivity

FIG. 4A  FIG. 4B
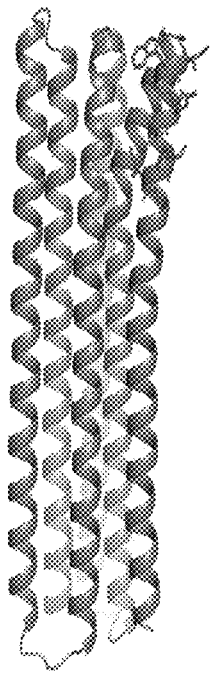
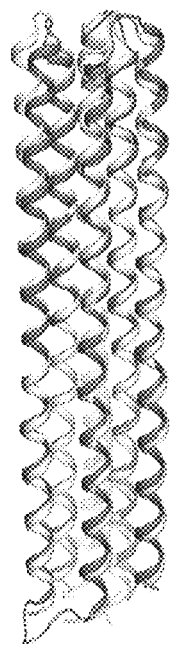
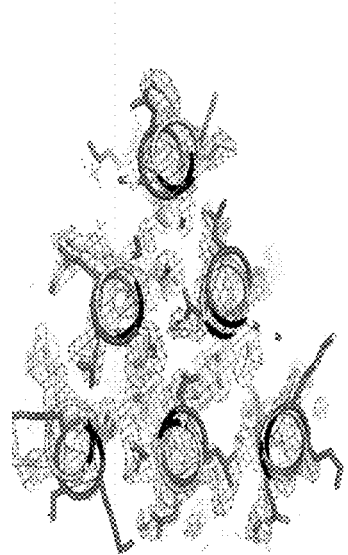

Cage only

Cage with naked Key

Spycatcher/Spytag linked

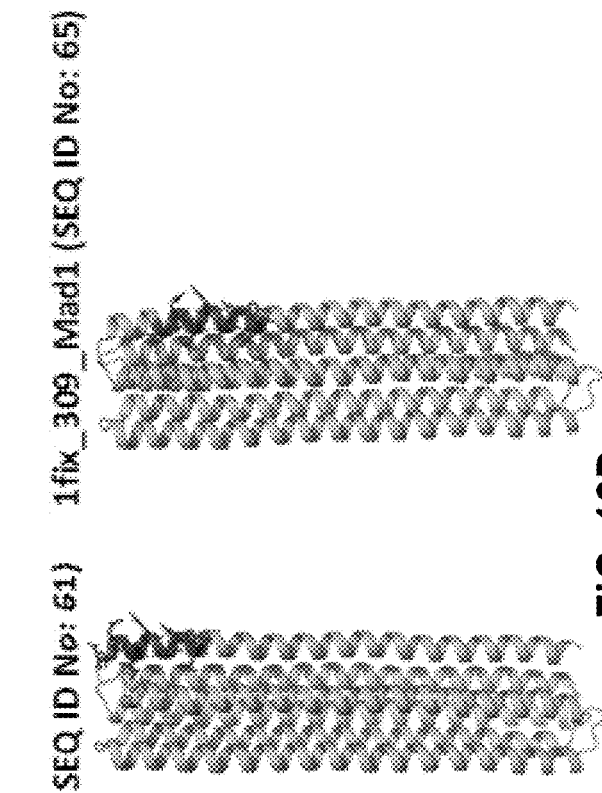
FIG. 12A
FIG. 12B
1ftx_302_Mad1 (SEQ ID No: 61)   1ftx_309_Mad1 (SEQ ID No: 65)
FIG. 12D
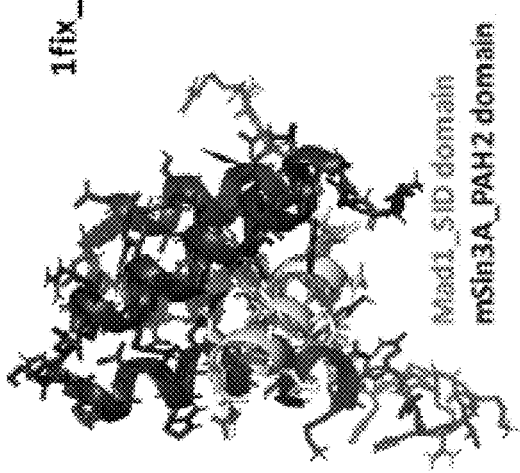
FIG. 12C

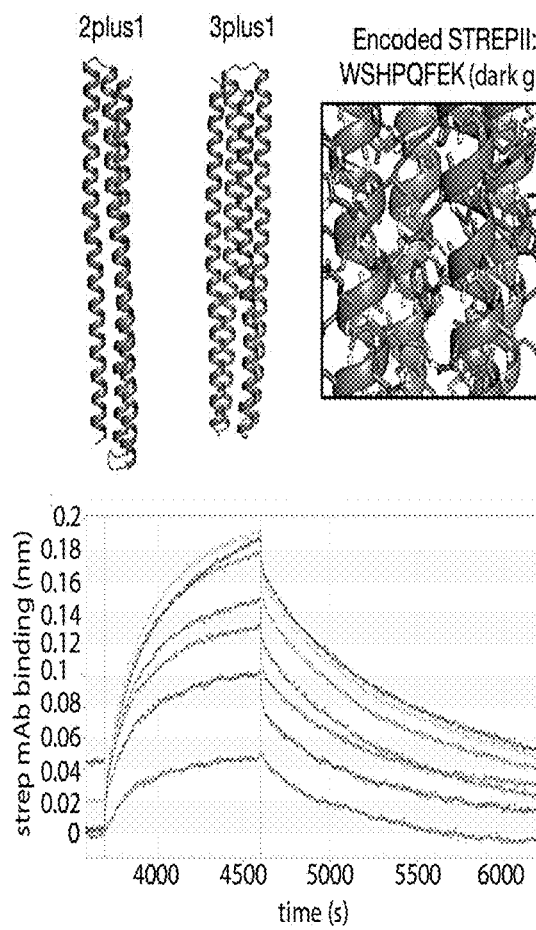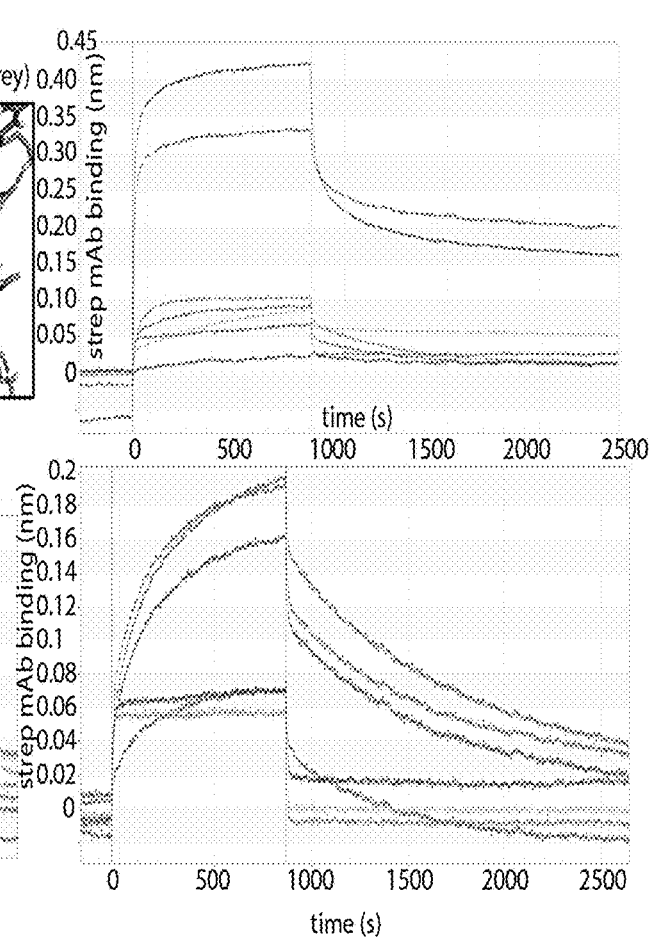
FIG. 13A
FIG. 13B
FIG. 13C
FIG. 13D

DE NOVO DESIGN OF PROTEIN SWITCHES

CROSS REFERENCE TO EARLIER FILED APPLICATIONS

This application is a Continuation of International Application No. PCT/US2019/042651, filed Jul. 19, 2019, which claims priority to U.S. Provisional Application No. 62/700,681, filed Jul. 19, 2018; U.S. Provisional Application No. 62/785,537, filed Dec. 27, 2018; and U.S. Provisional Application No. 62/788,398, filed Jan. 4, 2019, the disclosures of which are hereby incorporated by reference in their entirety.

REFERENCE TO SEQUENCE LISTING SUBMITTED ELECTRONICALLY VIA EFS-WEB

The content of the electronically submitted sequence listing in ASCII text file (Name: 18-1054-PCT_Sequence-Listing_ST25.txt; Size: 32,278 kb; and Date of Creation: Jul. 19, 2019) filed with the application is herein incorporated by reference in its entirety.

BACKGROUND

There has been considerable progress in the de novo design of stable protein structures based on the principle that proteins fold into their lowest free energy state. These efforts have focused on maximizing the free energy gap between the desired folded structure and all other structures. Designing proteins that can switch conformations is more challenging, as multiple states must have sufficiently low free energies to be populated relative to the unfolded state, and the free energy differences between the states must be small enough that the state occupancies can be toggled by an external input. The de novo design of a protein system which switches conformational state in the presence of an external input has not been achieved.

SUMMARY

In a first aspect are disclosed non-naturally occurring polypeptides comprising:
  (a) a helical bundle, comprising between 2 and 7 alpha-helices; and
  (b) amino acid linkers connecting each alpha helix.

In one embodiment, each helix is independently 18-60, 18-55, 18-50, 18-45, 22-60, 22-55, 22-50, 22-45, 25-60, 25-55, 25-50, 25-45, 28-60, 28-55, 28-50, 28-45, 32-60, 32-55, 32-50, 32-45, 35-60, 35-55, 35-50, 35-45, 38-60, 38-55, 38-50, 38-45, 40-60, 40-58, 40-55, 40-50, or 40-45 amino acids in length. In another embodiment, each amino acid linker is independently between 3-10, 4-10, 5-10, 6-10, 7-10, 8-10, 9-10, 2-9, 3-9, 4-9, 5-9, 6-9, 7-9, 8-9, 2-8, 3-8, 4-8, 5-8, 6-8, 7-8, 2-7, 3-7, 4-7, 5-7, 6-7, 2-6, 3-6, 4-6, 5-6, 2-5, 3-5, 4-5, 2-4, 3-4, 2-3, or 2, 3, 4, 5, 6, 7, 8, 9, or 10 amino acids in length, not including any further functional sequences that may be fused to the linker. In a further embodiment, the polypeptide comprises one or more bioactive peptide in at least one of the alpha helices, wherein the one or more bioactive peptides are capable of selectively binding to a defined target, wherein the one or more bioactive peptides may comprise one or more bioactive peptide selected from the non-limiting group consisting of SEQ ID NO:60, 62-64, 66, 27052-27093, and 27118-27119.

In another aspect, the disclosure provides non-naturally occurring polypeptides comprising the polypeptide having at least 40% sequence identity along its length to the amino acid sequence of a cage polypeptide disclosed herein, or selected from the group consisting of SEQ ID NOS: 1-49, 51-52, 54-59, 61, 65, 67-14317, 27094-27117, 27120-27125, 27,278 to 27,321, and cage polypeptides listed in Table 2, Table 3, and/or Table 4, wherein the N-terminal and/or C-terminal 60 amino acids of the polypeptides are optional, wherein the sequence identity requirement does not include optional amino acid residues. In one aspect, the disclosure provides non-naturally occurring polypeptide comprising the polypeptide having at least 40% sequence identity along its length to the amino acid sequence of a cage polypeptide listed in Table 2, Table 3, and/or Table 4, not including optional amino acid residues. In one embodiment, of each of these aspects, the polypeptide comprises the amino acid sequence having an amino acid sequence having at least 45%, 50%, 55%, 60%, 65%, 70%, 75%, 80%, 85%, 90%, 91%, 92%, 93%, 94%, 95%, 96%, 97%, 98%, 99%, or 100% sequence identity, not including optional amino acid residues, along its length to the amino acid sequence elected from the group consisting of SEQ ID NOS:1-91, SEQ ID NOS: 1-49, 51-52, 54-59, 61, 65, 67-14317, 27094-27117, 27120-27125, 27,278 to 27,321, and cage polypeptide listed in Table 2, Table 3, and/or Table 4.

In one embodiment of any of the aspects of the disclosure, the non-naturally occurring polypeptide further comprises one or more bioactive peptides within or replacing the latch region of the polypeptide, wherein the one or more bioactive peptides may comprise one or more bioactive peptide selected from the non-limiting group consisting of SEQ ID NO:60, 62-64, 66, 27052-27093, and 27118-27119.

In another aspect are provided non-naturally occurring polypeptides comprising a polypeptide having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity, not including optional amino acid residues, along its length to the amino acid sequence of a key polypeptide disclosed herein, or a key polypeptide selected from the group consisting of SEQ ID NOS:14318-26601, 26602-27015, and 27016-27051, and key polypeptides listed in Table. In one embodiment, the polypeptide comprises an amino acid sequence having an amino acid sequence having at least 45%, 50%, 55%, 60%, 65%, 70%, 75%, 80%, 85%, 90%, 91%, 92%, 93%, 94%, 95%, 96%, 97%, 98%, 99%, or 100% sequence identity, not including optional amino acid residues, along its length to the amino acid sequence of a key protein selected from the group consisting of key polypeptides listed in Table 2, Table 3, and/or Table 4.

In another embodiment, the disclosure provides fusion proteins comprising the cage polypeptide of any embodiment or combination of embodiments of the disclosure fused to the key polypeptide of any embodiment or combination of embodiments of the disclosure.

In other aspects, the disclosure provides nucleic acids encoding the cage polypeptide, key polypeptide, of fusion protein of any embodiment or combination of embodiments of the disclosure; expression vectors comprising the nucleic acids operatively linked to a promoter, and/or host cells comprising the nucleic acids and/or expression vectors. In one embodiment, the nucleic acid or the expression vector is integrated into a host cell chromosome. In another embodiment, the nucleic acid or the expression vector is episomal. In another embodiment, the host cell comprises
  (a) a first nucleic acid encoding the cage polypeptide of any embodiment or combination of embodiments of the disclosure operatively linked to a first promoter; and (b) a second nucleic acid encoding the key polypeptide of any embodiment or combination of embodiments of the disclosure operatively linked to a second promoter, wherein the second nucleic acid encodes a key polypeptide capable of binding to a structural region of the cage polypeptide encoded by the first nucleic acid, and wherein binding of the key polypeptide to the structural region of the cage polypeptide induces a conformational change in the cage polypeptide.

In a further embodiment of the host cells of the disclosure, the first nucleic acid comprises a plurality of first nucleic acids encoding a plurality of different cage polypeptides. In one embodiment, the second nucleic acid comprises a plurality of second nucleic acids encoding a plurality of different key polypeptides, wherein the plurality of different key polypeptides comprise one or more key polypeptides that are capable of binding to and inducing a conformational change in only a subset of the plurality of different cage polypeptides. In another embodiment, the second nucleic acid encodes a single key polypeptide that is capable of binding to and inducing a conformational change in each different cage polypeptide.

In another embodiment, the host cell may comprise (a) a first nucleic acid encoding a fusion protein according to any embodiment or combination of embodiments of the disclosure operatively linked to a first promoter; and (b) a second nucleic acid encoding a fusion protein according to any embodiment or combination of embodiments of the disclosure operatively linked to a second promoter, wherein:

(i) the cage polypeptide encoded by the first nucleic acid is activated by the key polypeptide encoded by the second nucleic acid;

(ii) the cage polypeptide encoded by the first nucleic acid is not activated by the key polypeptide encoded by the first nucleic acid;

(iii) the cage polypeptide encoded by the second nucleic acid is activated by the key polypeptide encoded by the first nucleic acid; and (iv) the cage polypeptide encoded by the second nucleic acid is not activated by the key polypeptide encoded by the second nucleic acid.

In another aspect, the disclosure provides kits comprising (a) one or more cage polypeptides according to any embodiment or combination of embodiments of the disclosure;

(b) one or more key polypeptides according to any embodiment or combination of embodiments of the disclosure; and (c) optionally, one or more fusion proteins according to any embodiment or combination of embodiments of the disclosure.

In one aspect, the disclosure provides kits, comprising:

(a) a first nucleic acid encoding one or more cage polypeptides according to any embodiment or combination of embodiments of the disclosure;

(b) a second nucleic acid encoding one or more key polypeptides according to any embodiment or combination of embodiments of the disclosure; and (c) optionally, a third nucleic acid encoding one or more fusion proteins according to any embodiment or combination of embodiments of the disclosure.

In various embodiments, the first nucleic acid, the second nucleic acid, and/or the third nucleic acid comprise expression vectors.

In another aspect, the disclosure provides LOCKR switches comprising (a) a cage polypeptide comprising a structural region and a latch region further comprising one or more bioactive peptides, wherein the structural region interacts with the latch region to prevent activity of the one or more bioactive peptides;

(b) an optional key polypeptide that binds to the cage structural region, thereby displacing the latch region and activating the one or more bioactive peptides; and (c) optionally, one or more effector polypeptide(s) that bind to the one or more bioactive peptides when the one or more bioactive peptides are activated.

In one embodiment, the effector polypeptide is present, and wherein the effector polypeptide comprises an effector polypeptide that selectively binds to the bioactive peptide, including but not limited to Bcl2, GFP1-10, and a protease.

In various embodiments, the host cells, kits, or LOCKR according to any embodiment or combination of embodiments of the disclosure comprise one or more cage polypeptide and one or more key polypeptide having an amino acid sequence having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity, not including optional residues, along its length to a cage polypeptide and a key polypeptide, respectively, in the same row of Table 1, Table 2, Table 3, and/or Table 4, or to a cage polypeptide and a key polypeptide, respectively, in the same row of Table 2, Table 3, and/or Table 4. In further embodiments, the one or more bioactive peptides may comprise one or more bioactive peptide selected from the non-limiting group consisting of SEQ ID NO:60, 62-64, 66, 27052-27093, and 27118-27119.

In other embodiments, the host cells, kits, or LOCKR according to any embodiment or combination of embodiments of the disclosure comprise (a) the one or more cage polypeptide comprise one or more cage polypeptides having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity, not including optional amino acid residues, along its length to the amino acid sequence of a cage polypeptide selected from the group consisting of SEQ ID NOS: 1-49, 51-52, 54-59, 61, 65, 67-14317, 27094-27117, 27120-27125, 27,278 to 27,321, and cage polypeptides listed in Table 2, Table 3, and/or Table 4, wherein the N-terminal and/or C-terminal 60 amino acids of the polypeptides are optional; and (b) the one or more key polypeptide comprise one or more polypeptides selected from the group consisting of a polypeptide having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity, not including optional amino acid residues, along its length to the amino acid sequence of a key polypeptide selected from the group consisting of SEQ ID NOS:14318-26601, 26602-27015, 27016-27051, and key polypeptides listed in Table 2, Table 3, and/or Table 4.

In another aspect, the disclosure provides use of the polypeptides, fusion proteins, nucleic acids, expression vectors, host cells, kits, and/or LOCKR switches disclosed herein to sequester bioactive peptide in the cage polypeptide, holding them in an inactive ("off") state, until combined with the key polypeptide to induce a conformational change that activates ("on") the bioactive peptide.

DESCRIPTION OF THE FIGURES

FIG. 1A shows thermodynamic model describing our design goal.

The structural region and latch region in cage form the switch with some equilibrium in the open and closed states. The key can bind the cage to promote the open state to allow target binding to the latch. FIG. 1B shows plots from the model in (a) for two values of $K_{LT}$ showing how fraction target bound is affected by addition of key ($K_{CK}$=1 nM); the different colored curves show the effect of log-decreasing values of $K_{open}$=[open]/[closed]. FIG. 1C shows loops were added to homotrimer 5L6HC3_1[5] to form monomeric five- and six-helix frameworks; double mutant V217S/I232S weakens the Latch allowing it to be displaced by key, resulting in a LOCKR system able to bind an exogenous key. FIG. 1D shows chemical denaturation with guanidinium chloride (Gdm) monitoring mean residue ellipticity (MRE) at 222 nm. FIG. 1E shows small-angle x-ray scattering (SAXS) shows that the monomeric frameworks exhibit spectra that are in close agreement to each other and the original homotrimer. FIG. 1F, Pulldown assay showing that Key binds to the truncated five-helix framework and LOCKR (V217S/I232S), but not the six-helix monomer; free GFP-Key was added to monomeric frameworks immobilized onto a plate via a hexahistidine tag; after a series of wash steps, binding was measured by GFP fluorescence (n=2, error bars indicate standard deviation).

FIG. 2A-2D: BimLOCKR design and activity. FIG. 2A. the free energy of the latch-cage interface was tuned through sub-optimal Bim-cage interactions (left, shown as altered hydrophobic packing and a buried hydrogen bond) and by exposing hydrophobic residues at the end of the interface (right) as a toehold. FIG. 2B) Introduction of the toehold allows activation of 250 nM BimLOCKR with addition of 5 µM key ('on' bar) via Bio-layer interferometry. FIG. 2C) Bio-layer interferometry shows key-dependent binding to Bcl2 with 250 nM BimLOCKR. Association from 0-500 s, then dissociation from 500-1700 s. FIG. 2D) Each point is a result of fitting data in I and extracting the response at equilibrium. The curves show similar data with shorter keys demonstrating the ability to tune $K_{CK}$ of LOCKR and effect its range of activation.

FIG. 3A) Left: LOCKR in cartoon representation. Cage with three different latches superimposed and hydrogen bond networks marked by markers. Right: Hydrogen-bond networks across the orthogonal LOCKR interfaces FIG. 3B) BimLOCKR binding to Bcl2 in response to its cognate key on Octet. One replicate FIG. 3C) Response on Octet after 500 seconds for each switch (250 nM) and key (5 µM) pair. Average of two replicates.

FIG. 4A-4B: Experimentally determined x-ray crystal structures of asymmetrized LOCKR switch designs. (FIG. 4A) Crystal structure of design 1-fix-short-BIM-t0, which contains the encoded BIM peptide. (FIG. 4B) Crystal structure of design 1fix-short-noBim(AYYA)-t0 is in very close agreement with the design model with respect to (left) Backbone, (middle) hydrogen bond network, and (right) hydrophobic packing; the region of the Latch where Bim and Gfp11 would be encoded is shown; the electron density map is shown for the network and hydrophobic cross-sections (middle and right).

FIG. 5A. Crystal structure of GFP (pdb 2y0g) with strand 11 shown. FIG. 5B. Crystal structure of prototype switch with GFP11 stabilized as a helix (mesh is electron density). FIG. 5C. The computational design model matches the crystal structure with a root-mean-square deviation of 0.87 Å. Experimentally determined x-ray crystal structure of designed LOCKR switch 1fix-short-GFP-t0, showing the encoded the 11th strand of GFP (GFP11) is an alpha helix and in very close agreement to the design model. FIG. 5D. GFP fluorescence is only observed in the presence of the Key peptide, demonstrating the switch is function (OFF in the absence of Key, and ON in the presence of Key).

(FIG. 6A) Schematic of test system, where colocalization-dependence is controlled by linked Spycatcher™/Spytag™ fusions. In this model, the Key should only activate the LOCKR switch (yield fluorescence) when fused to Spytag, which will colocalizing the Key to the Cage (right). When Key alone is added, it should not be able to activate the LOCKR switch (middle). (FIG. 6B and FIG. 6C) Fluorescence data demonstrating colocalization-dependence of designed LOCKR switches following the schematic in (A). Designs 1fix-latch and 1fix-short fused to Spycatcher™ show more activation when mixed with their cognate Keys fused to Spytag™; Keys lacking Spytag™ show markedly less activation.

FIG. 11A) The latch was truncated from the 6×-His tagged cage in the five redesigned LOCKR constructs (b through f). The corresponding keys were GFP tagged. Key-Cage binding was measured by Ni pulldown of the cage and measuring the resulting GFP fluorescence. Error bars are standard deviation of three replicates. FIG. 11B) Each full LOCKR construct that binds key from (a) was given a nine-residue toehold and tested for binding against all four functional keys (a through d) in the GFP pulldown assay. Error bars are standard deviation of five replicates. Key a is suspected to be promiscuous binding, but not activating, due to the pseudo-symmetric generation of LOCKR from a homotrimer.

Figure 3A:
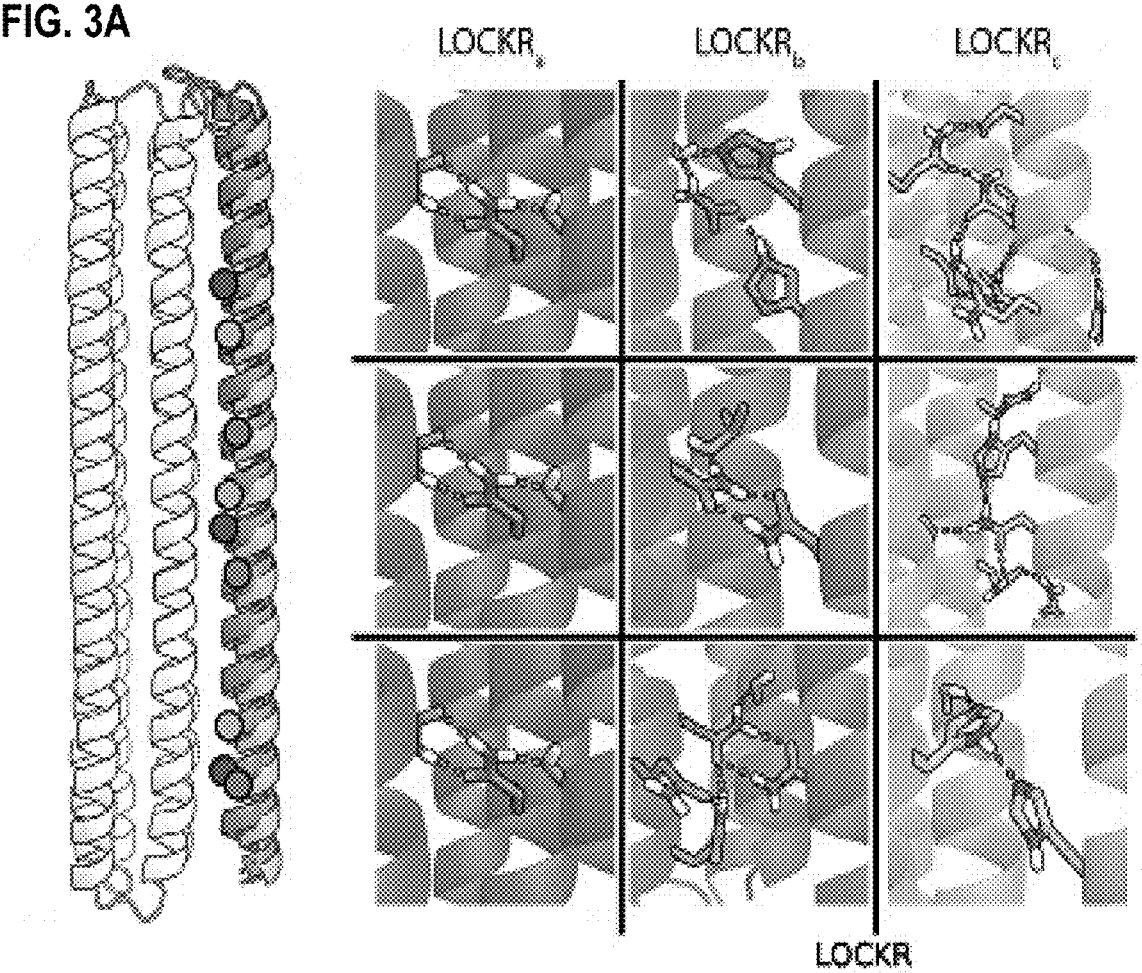
FIG. 3A-3C: Design and validation of orthogonal Bim-LOCKR.
Figure 3B:
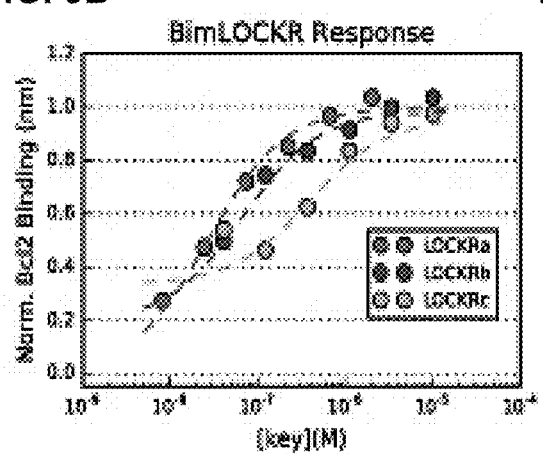

LOCKRb shows no binding to its own key, which is attributable to latch strength given results from (a) and FIG. 3b.

FIG. 12A-12D: Designed Mad1-SID LOCKR switches for key-dependent transcriptional repression. (FIG. 12A) Crystal structure of the interaction between Mad1-SID domain (white) and the PAH2 domain of the mSin3A transcriptional repressor (black) (PDB ID: 1E91). Caging of the Mad1-SID domain should enable key-dependent recruitment of the transcriptional repressor mSin3A enabling precise epigenetic regulation. (FIG. 12B) Designed Mad1-LOCKR switches, with Cage component encoding the Mad1-SID sequence at different positions (dark gray). (FIG. 12C) SDS-PAGE gel showing successfully purified 1fix_302_Mad1 (1), 1fix_309_Mad1 (2) and MBP_Mad1 (3). (FIG. 12D) Biolayer interferometry analysis of key-activated binding of the Mad1-LOCKR switches to the purified mSin3A-PAH2 domain. MBP-Mad1 is a positive control for mSin3a-PAH2 binding. 1fix_309_Mad1 (309) shows successful activation when mixed with designed Key$_a$. 1fix_302_Mad1 (302) shows very tight caging of the Mad1-SID domain, but no activation in presence of Key$_a$. Kinetic assays were performed by immobilizing 0.1 µg of Biotin-mSin3A-PAH2 protein on Streptavidin biosensor tips (ForteBio). Protein cages were tested at 50 nM in presence or absence of 500 nM Key$_a$.

FIG. 13A-13D: Caged STREPII-tag LOCKR switches; demonstration of new 2plus1 and 3plus1 LOCKR switches. (FIG. 13A) Designed 2+1 (left) and 3+1 (middle) LOCKR switches were designed to encode the STREPII sequence WSHPQFEK (SEQ ID NO:63). (FIG. 13B-FIG. 13D) Biolayer interferometry (Octet) Data demonstrating function of the STREPII-LOCKR designs: anti-strep antibody is immobilized onto Anti-mouse FC tips to assess binding of the STREPII tag: (FIG. 13B) The designed proteins show less binding than positive control, suggesting the STREPII has been at least partially sequestered as intended. (FIG. 13C) Activation of design STREPII-3plus1_Lock_3 by 3plus1_Key_3: The curve is 250 nM of cage with no Key, compared to 250 nM Cage in the presence of increasing concentration of Key ranging from 121 nM to 6000 nM. (FIG. 13D) 250 nM STREPII-3plus1_Lock_3 in the presence of Key at 370 nM, 1111 nM, and 3333 nM; 250 nM of Cage with no Key is 250 nM, and the other plots are Key at the same concentrations (370 nM, 1111 nM, and 3333 nM) but in the absence of Cage. In all Octet plots, the left half is the association (binding) step, and the right half is the dissociation step.

Figure 14:
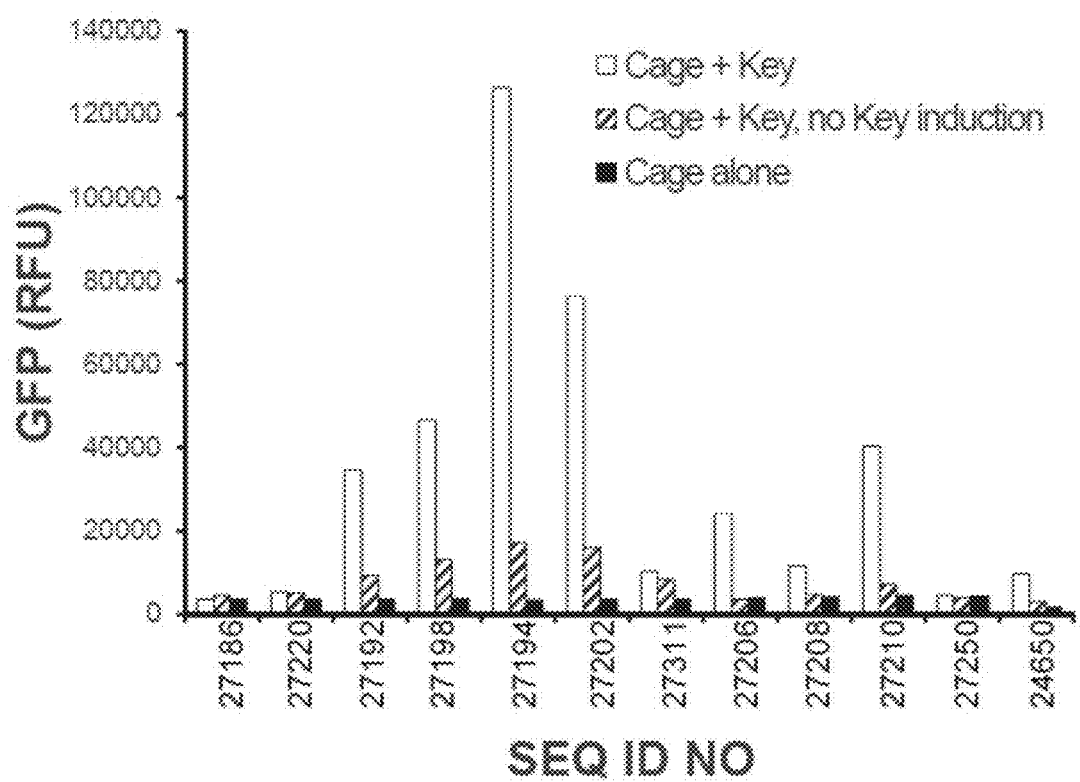

FIG. 14: 3plus1 LOCKR switches activate GFP fluorescence in response to expression of Key. LOCKR switches were designed in which 3plus1 Cages were used to sequester strand 11 of GFP (GFP11) in an inactive conformation, thereby preventing reconstitution of split GFP (comprised of GFP1-10 and GFP11), resulting in fluorescence. Expression plasmids were prepared for inducibly expressing the Cage (p15a origin of replication, spectinomycin resistance, arabinose-inducible promoter controlling expression of GFP1-10 and LOCKR-Caged GFP11) and Key (colE1 origin of replication, kanamycin resistance, and IPTG-inducible promoter). Chemically competent E. coli Stellar cells (Takara-bio) were transformed according to manufacturer's protocols either with the Cage plasmid alone or with both the Cage and Key plasmids. These transformations were grown overnight at 37 C in liquid LB media supplemented with spectinomycin (Cage alone) or spectinomycin+kanamycin (Cage and Key). The resulting cultures were diluted 1/100 into fresh LB media supplemented with appropriate antibiotics and either arabinose only (induce expression of Cage and GFP1-10) or both arabinose and IPTG (induce expression of Cage, GFP1-10, and Key), then allowed to grow at 37 C for 16 hours. 200 uL of each expression culture was washed once in 200 uL PBS, resuspended in 200 uL PBS, and transferred to a black-walled 96-well plate. GFP fluorescence was evaluated on a Biotek Synergy H1MF plate reader (excitation/emission 479/520 nm). Fluorescence was minimal for Cage alone, confirming that LOCKR proteins prevented activation of split GFP in the absence of Key. Induction of Key expression resulted in a large increase in fluorescence for SEQ ID NOs 27192, 27198, 27194, 27202, 27206, and 27210. These results demonstrate that the 3plus1 LOCKR architecture is able to control the function of bioactive peptide GFP11.

DETAILED DESCRIPTION

All references cited are herein incorporated by reference in their entirety. Within this application, unless otherwise stated, the techniques utilized may be found in any of several well-known references such as: *Molecular Cloning: A Laboratory Manual* (Sambrook, et al., 1989, Cold Spring Harbor Laboratory Press), *Gene Expression Technology* (Methods in Enzymology, Vol. 185, edited by D. Goeddel, 1991. Academic Press, San Diego, Calif.), "Guide to Protein Purification" in *Methods in Enzymology* (M. P. Deutshcer, ed., (1990) Academic Press, Inc.); *PCR Protocols: A Guide to Methods and Applications* (Innis, et al. 1990. Academic Press, San Diego, Calif.), *Culture of Animal Cells: A Manual of Basic Technique*, 2$^{nd}$ Ed. (R. I. Freshney. 1987. Liss, Inc. New York, N.Y.), *Gene Transfer and Expression Protocols*, pp. 109-128, ed. E. J. Murray, The Humana Press Inc., Clifton, N.J.), and the Ambion 1998 Catalog (Ambion, Austin, Tex.).

As used herein, the singular forms "a", "an" and "the" include plural referents unless the context clearly dictates otherwise. "And" as used herein is interchangeably used with "or" unless expressly stated otherwise.

As used herein, the amino acid residues are abbreviated as follows: alanine (Ala; A), asparagine (Asn; N), aspartic acid (Asp; D), arginine (Arg; R), cysteine (Cys; C), glutamic acid (Glu; E), glutamine (Gln; Q), glycine (Gly; G), histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

All embodiments of any aspect of the disclosure can be used in combination, unless the context clearly dictates otherwise.

Unless the context clearly requires otherwise, throughout the description and the claims, the words 'comprise', 'comprising', and the like are to be construed in an inclusive sense as opposed to an exclusive or exhaustive sense; that is to say, in the sense of "including, but not limited to". Words using the singular or plural number also include the plural and singular number, respectively. Additionally, the words "herein," "above," and "below" and words of similar import, when used in this application, shall refer to this application as a whole and not to any particular portions of the application.

The description of embodiments of the disclosure is not intended to be exhaustive or to limit the disclosure to the precise form disclosed. While the specific embodiments of, and examples for, the disclosure are described herein for illustrative purposes, various equivalent modifications are possible within the scope of the disclosure, as those skilled in the relevant art will recognize.

In a first aspect, the disclosure provides non-naturally occurring polypeptides, comprising:

(a) a helical bundle comprising between 2 and 7 alpha-helices; and (b) amino acid linkers connecting each alpha helix.

The non-naturally occurring polypeptides of this first aspect of the disclosure can be used, for example, as "cage" polypeptide component (which may also be referred to here as the "lock") of the novel protein switches disclosed in detail herein. The protein switches can be used, for example, to sequester bioactive peptides in the cage polypeptide, holding them in an inactive ("off") state, until combined with a second component (the "key" polypeptide) of the novel protein switches disclosed herein; the key polypeptide induces a conformational change that activates ("on") the bioactive peptide (see FIG. 1A). The polypeptides described herein comprise the first ever de novo designed polypeptides that can undergo conformational switching in response to protein binding. Furthermore, there are no known natural proteins that can switch in such a modular, tunable manner as the polypeptides disclosed herein.

The polypeptides are "non-naturally occurring" in that the entire polypeptide is not found in any naturally occurring polypeptide. It will be understood that components of the polypeptide may be naturally occurring, including but not limited to bioactive peptides that may be included in some embodiments.

The cage polypeptides comprise a helical bundle comprising between 2 and 7 alpha-helices. In various embodiments, the helical bundle comprises 3-7, 4-7, 5-7, 6-7, 2-6, 3-6, 4-6, 5-6, 2-5, 3-5, 4-5, 2-4, 3-4, 2-3, 2, 3, 4, 5, 6, or 7 alpha helices.

Design of the helical bundle cage polypeptides of the disclosure may be carried out by any suitable means. In one non-limiting embodiment, a BundleGridSampler™ in the Rosetta™ program may be used to generates backbone geometry based on the Crick expression for a coiled-coil and allows efficient, parallel sampling of a regular grid of coiled-coil expression parameter values, which correspond to a continuum of peptide backbone conformations. This may be supplemented by design for hydrogen bond networks using any suitable means, including but not limited to as described in Boyken et. al, (Science 352, 680-687 (2016)), followed by Rosetta™ sidechain design. In a further non-limiting embodiment, best scoring designs, based on total score, number of unsatisfied hydrogen bonds, and lack of voids in the core of the protein may be selected for helical bundle cage polypeptide design.

Each alpha helix may be of any suitable length and amino acid composition as appropriate for an intended use. In one embodiment, each helix is independently 38 to 58 amino acids in length. In various embodiments, each helix is independently between 18-60, 18-55, 18-50, 18-45, 22-60, 22-55, 22-50, 22-45, 25-60, 25-55, 25-50, 25-45, 28-60, 28-55, 28-50, 28-45, 32-60, 32-55, 32-50, 32-45, 35-60, 35-55, 35-50, 35-45, 38-60, 38-55, 38-50, 38-45, 40-60, 40-58, 40-55, 40-50, or 40-45 amino acids in length.

The amino acid linkers connecting each alpha helix can be of any suitable length or amino acid composition as appropriate for an intended use. In one non-limiting embodiment, each amino acid linker is independently between 2 and 10 amino acids in length, not including any further functional sequences that may be fused to the linker. In various non-limiting embodiments, each amino acid linker is independently 3-10, 4-10, 5-10, 6-10, 7-10, 8-10, 9-10, 2-9, 3-9, 4-9, 5-9, 6-9, 7-9, 8-9, 2-8, 3-8, 4-8, 5-8, 6-8, 7-8, 2-7, 3-7, 4-7, 5-7, 6-7, 2-6, 3-6, 4-6, 5-6, 2-5, 3-5, 4-5, 2-4, 3-4, 2-3, 2, 3, 4, 5, 6, 7, 8, 9, or 10 amino acids in length. In all embodiments, the linkers may be structured or flexible (e.g. poly-GS). These linkers may encode further functional sequences, including but not limited to protease cleavage sites or one half of a split intein system (see sequences below).

The polypeptides of this first aspect include a region, termed the "latch region", for insertion of a bioactive peptide. The cage polypeptide thus comprises a latch region and a structural region (i.e.: the remainder of the cage polypeptide that is not the latch region). When the latch region is modified to include one or more bioactive peptides, the structural region of the cage polypeptide interacts with the latch region to prevent activity of the bioactive peptide. Upon activation by key polypeptide, the latch region dissociates from its interaction with the structural region to expose the bioactive peptide, allowing the peptide to function.

As used herein, a "bioactive peptide" is any peptide of any length or amino acid composition that is capable of selectively binding to a defined target (i.e.: capable of binding to an "effector" polypeptide). Such bioactive peptides may comprise peptides of all three types of secondary structure in an inactive conformation: alpha helix, beta strand, and loop. The polypeptides of this aspect can be used to control the activity of a wide range of functional peptides. The ability to harness these biological functions with tight, inducible control is useful, for example, in engineering cells (inducible activation of function, engineering complex logic behavior and circuits, etc.), developing sensors, developing inducible protein-based therapeutics, and creating new biomaterials.

The latch region may be present near either terminus of the cage polypeptide. In one embodiment, the latch region is placed at the C-terminal helix so as to position the bioactive peptide for maximum burial of the functional residues that need to be sequestered to maintain the bioactive peptide in an inactive state while simultaneously burying hydrophobic residues and promoting solvent exposure/compensatory hydrogen bonds of polar residues. In various embodiments, the latch region may comprise a part or all of a single alpha helix in the cage polypeptide at the N-terminal or C-terminal portions. In various other embodiments, the latch region may comprise a part or all of a first, second, third, fourth, fifth, sixth, or seventh alpha helix in the cage polypeptide. In other embodiments, the latch region may comprise all or part of two or more different alpha helices in the cage polypeptide; for example, a C-terminal part of one alpha helix and an N-terminal portion of the next alpha helix, all of two consecutive alpha helices, etc.

In another embodiment, the polypeptides of this first aspect comprise one or more bioactive peptides within the latch region. In this embodiment, the bioactive peptide(s) may replace one or more amino acids in the latch region, or may be added to the latch region without removal of any amino acid residues from the latch region. In various non-limiting embodiments, the bioactive peptides may comprise one or more of the following (all sequences in parentheses are optional), or variants thereof, of SEQ ID NO:60, 62-64, 66, 27052-27093, and 27118-27119:

GFP11 fluorescence peptide and binding peptide to GFP1-10:

(SEQ ID NO: 27052)
RDHMVLHEYVNAAGIT.

BIM binding peptide and apoptotic peptide to BCL-2:

(SEQ ID NO: 50)
IxxxLRxIGDxFxxxY, where x is any amino acid; in one embodiment, the peptide is (SEQ ID NO: 60)
EIWIAQELRRIGDEFNAYYA Designed peptide for binding to BCL-2:

(SEQ ID NO: 62)
KMAQELIDKVRAASLQINGDAFYAILRAL

StreptagII binding peptide to streptactin or an antibody:

(SEQ ID NO: 63)
(N)WSHPQFEK

TEV protease cleavage site:

(SEQ ID NO: 64)
ENLYFQ(G)-X, wherein (G) can also be S, last position, -X can be anything except Proline Thrombin protease cleavage site:

(SEQ ID NO: 66)
LVPRGS

Cathepsin cleavage site:

(SEQ ID NO: 27053)
RLVGFE

Spytag covalent crosslinking peptide to spycatcher:

(SEQ ID NO: 27054)
AHIVMVDAYK(PTK)

NLS peptide to target the protein to the nucleus:

(SEQ ID NO: 27055)
AAAKRARTS

NES1 peptide to exclude the protein from the nucleus:

(SEQ ID NO: 27056)
LALKLAGLDIN

NES2 peptide to exclude the protein from the nucleus:

(SEQ ID NO: 27057)
ELAEKLAGLDIN

NES3 peptide to exclude the protein from the nucleus:

(SEQ ID NO: 27058)
ELAEKLRAGLDLN

EZH2 binding peptide to recruit DNA-methylases:

(SEQ ID NO: 27059)
TMFSSNRQKILERTETLNQEWKQRRIQ

MDM2 binding peptide to recruit p53:

(SEQ ID NO: 27060)
ETFSDLWKLL

CP5 binding peptide:

(SEQ ID NO: 27061)
GELDELVYLLDGPGYDPIHSDVVTRGGSHLFNF

9aaTAD1 for transcriptional activation:

(SEQ ID NO: 27062)
TMDDVYNYLFDD

9aaTAD2 for transcriptional activation:

(SEQ ID NO: 27063)
LLTGLFVQYLFDD

9aaTAD3 for transcriptional activation:

(SEQ ID NO: 27064)
DDAVVESFFSS

9aaTAD4 for transcriptional activation:

(SEQ ID NO: 27065)
GDFLSDLFD

-continued

9aaTAD5 for transcriptional activation:
(SEQ ID NO: 27066)
GDVLSDLVD

Mad1-SID-epigenetic modification:
(SEQ ID NO: 27067)
NIQMLLEAADYLE

Mad1-SID (3A mutant - epigenetic modification:
(SEQ ID NO: 27068)
NIAMLLAAAAYLE

RHIM Domain 1 from ZBP1:
(SEQ ID NO: 27069)
IQIG

RHIM Domain 2 from ZBP1:
(SEQ ID NO: 27070)
VQLG nanoBit Split Luciferase:
(SEQ ID NO: 27071)
VSGWRLFKKIS

CC-A:
(SEQ ID NO: 27072)
GLEQEIAALEKENAALEWEIAALEQGG

CC-B:
(SEQ ID NO: 27073)
GLKQKIAALKYKNAALKKKIAALKQGG

GCN4:
(SEQ ID NO: 27074)
RMKQLEDKVEELLSKNYHLENEVARLKKLVGER

CC-Di:
(SEQ ID NO: 27075)
GEIAALKQEIAALKKENAALKWEIAALKQG

Membrane-disrupting/cell-penetrating peptides:
GALA for membrane disruption:
(SEQ ID NO: 27076)
WEAALAEALAEALAEHLAEALAEALEALAA Aurein 1.2:
(SEQ ID NO: 27077)
GLFDIIKKIAESF Magainin-1:
(SEQ ID NO: 27078)
GIGKFLHSAGKFGKAFVGEIMKS Magainin-2:
(SEQ ID NO: 27079)
GIGKFLHSAKKFGKAFVGEIMNS Melittin:
(SEQ ID NO: 27080)
GIGAVLKVLTTGLPALISWIKRKRQQ Mastoparan X:
(SEQ ID NO: 27081)
INWKGIAAMAKKLL Cecropin A:
(SEQ ID NO: 27082)
KWKLFKKIEKVGQNIRDGIIKAGPAVAVVGQATQIAK Cecropin P1:
(SEQ ID NO: 27083)
SWLSKTAKKLENSAKKRISEGIAIAIQGGPR Citropin 1.1:
(SEQ ID NO: 27084)
GLFDVIKKVASVIGGL Temporin-1Lb:
(SEQ ID NO: 27085)
NFLGTLINLAKKIL

```
HPV33 L2 peptide:
                                          (SEQ ID NO: 27086)
SYFILRRRRKRFPYFFTDVRVAA Adenovirus pVI membrane fusion domain:
                                          (SEQ ID NO: 27087)
AFSWGSLWSGIKNFGSTVKNY Gamma-1 peptide from flock house virus:
                                          (SEQ ID NO: 27088)
ASMWERVKSIIKSSLAAASNI Poliovirus 2B pore-forming peptide:
                                          (SEQ ID NO: 27089)
VTSTITEKLLKNLIKIISSLVIITRNYEDTTTVLATLALLGCDASPWQWL Rhinovirus pore-forming peptide:
                                          (SEQ ID NO: 27090)
IAQNPVENYIDEVLNEVLVVPNIN Influenza HA2 pore-forming peptide:
                                          (SEQ ID NO: 27091)
FLGIAEAIDIGNGWEGMEFG Influenza HA2 derivative:
                                          (SEQ ID NO: 27092)
GLFGAIAGFIENGWEGMIDG HA-derived INF6:
                                          (SEQ ID NO: 27093)
GLFGAIAGFIENGWEGMIDGWYG.

KRAB domain - epigenetic modification:
                                          (SEQ ID NO: 27118)
MDAKSLTAWSRTLVTFKDVFVDFTREEWKLLDTAQQIVYRNVMLENYKNLVSLGYQLTKPDVILRLEKG
EEPWLV Minimal Krab domain (KOX1 11-55)- epigenetic modification:
                                          (SEQ ID NO: 27119)
RTLVTFKDVFVDFTREEWKLLDTAQQIVYRNVMLENYKNLVSLGY
```

Figure 10:
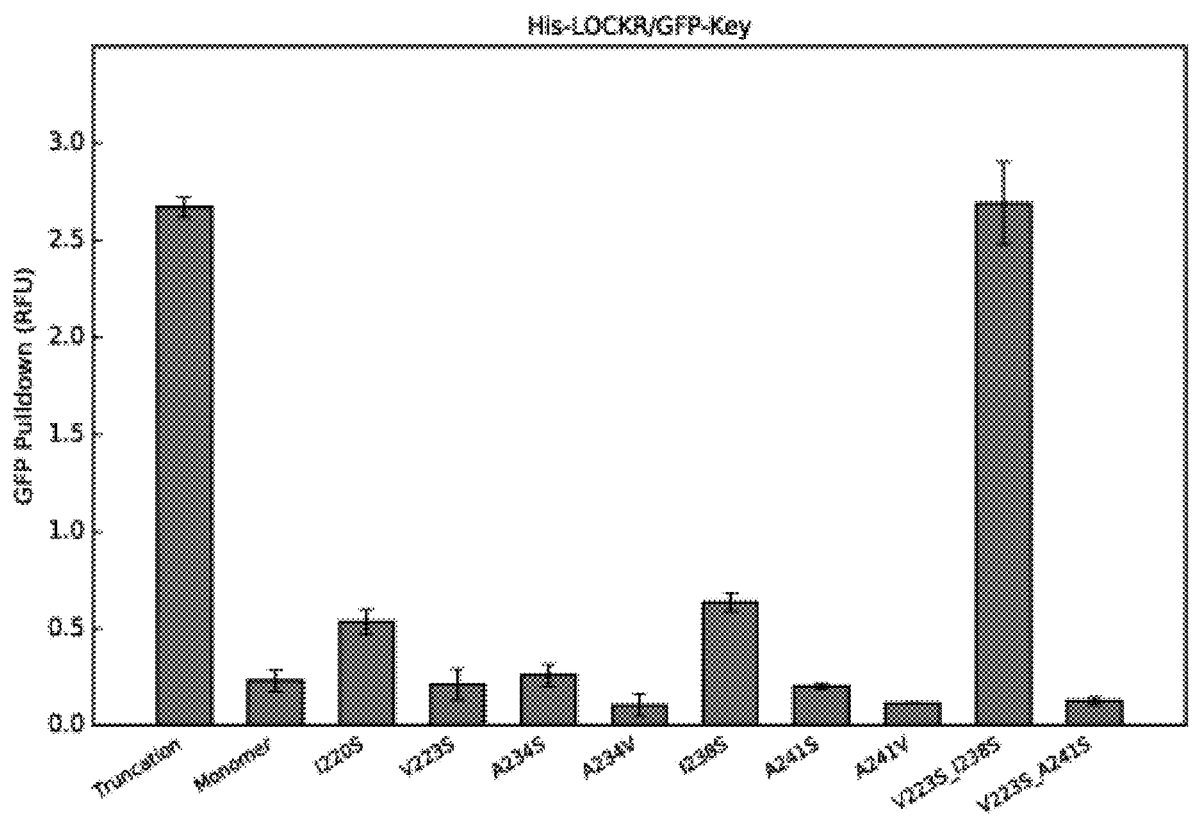
FIG. 10: GFP Plate assay to find mutations for LOCKR. Different putative LOCKR constructs were adhered via 6×-His tag to a Ni coated 96-well plate, Key-GFP was applied, and excess washed. Resulting fluorescence represents Key-GFP bound to LOCKR constructs. The truncation was used as a positive control, since the key binds to the open interface. The monomer as a negative control since it does not bind the key. Error bars represent the standard deviation of three replicates.

In one embodiment, the dynamic range of activation by key polypeptides can be tuned by truncating the latch region length to be shorter than the alpha-helices in the structural region, simultaneously weakening the cage polypeptide-latch region interaction and opening an exposed region on the cage polypeptide that the key polypeptide can bind to as a "toehold" (FIG. 2). Similarly, the dynamic range of activation by key polypeptides can also be tuned in a similar manner by designing mutations into the Latch that weaken the cage polypeptide-latch region interaction (FIGS. 1-2, and 10). In other embodiments, the latch region can be one or more helices totaling in length between 18-150 amino acids, between 18-100 amino acids, between 18-58 amino acids, or any range encompassed by these ranges. In other embodiments the latch region could consist of helical secondary structure, beta strand secondary structure, loop secondary structure, or combinations thereof.

In a second aspect, the disclosure provides non-naturally occurring polypeptides comprising a polypeptide having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along its length to the amino acid sequence of a cage polypeptide disclosed herein, not including optional amino acid residues, and optionally not including amino acid residues in the latch region, such as such SEQ ID NOS:1-49, 51-52, 54-59, 61, 65, 67-91, 92-2033 (submitted in U.S. Provisional Application Ser. No. 62/700,681 filed Jul. 19, 2018 and/or 62/785,537 filed Dec. 27, 2018 as Appendix 1), SEQ ID NOS:2034-14317 (submitted in U.S. Provisional Application Ser. No. 62/700,681 filed Jul. 19, 2018 and/or 62/785,537 filed Dec. 27, 2018 as Appendix 2), 27094-27117, 27120-27125, 27,278 to 27,321, and cage polypeptides listed in Table 2 (polypeptides with an even-numbered SEQ ID NO between SEQ ID NOS: 27126 and 27276), Table 3, and/or Table 4. In each embodiment, the N-terminal and/or C-terminal 60 amino acids of each cage polypeptides may be optional, as the terminal 60 amino acid residues may comprise a latch region that can be modified, such as by replacing all or a portion of a latch with a bioactive peptide. In one embodiment, the N-terminal 60 amino acid residues are optional; in another embodiment, the C-terminal 60 amino acid residues are optional; in a further embodiment, each of the N-terminal 60 amino acid residues and the C-terminal 60 amino acid residues are optional. In one embodiment, these optional N-terminal and/or C-terminal 60 residues are not included in determining the percent sequence identity. In another embodiment, the optional residues may be included in determining percent sequence identity.

As disclosed herein, bioactive peptides to be sequestered by the polypeptides of the disclosure are located within the latch region. The latch region is denoted by brackets in the sequence of each cage polypeptide. The bioactive peptide may be added to the latch region without removing any residues of the latch region, or may replace one or more (1, 2, 3, 4, 5, 6, 7, 8, 9, 10, or more) amino acid residues in the cage scaffold latch region to produce the final polypeptide. Thus, the latch region may be significantly modified upon inclusion of the bioactive peptide. In one embodiment, the optional residues are not included in determining percent sequence identity. In another embodiment, the latch region residues may be included in determining percent sequence identity. In a further embodiment, each of the optional residues and the latch residues may are not included in determining percent sequence identity.

In one embodiment of this second aspect, the polypeptides are polypeptides according to any embodiment or combination of embodiments of the first aspect and also having the required 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along its length to the amino acid sequence of the listed reference cage polypeptides disclosed herein. In another embodiment, polypeptides further comprise a bioactive peptide within (or replacing) the latch region of the cage polypeptide.

The cage polypeptide may be a cage scaffold polypeptide (i.e.: without a bioactive peptide) For example, see SEQ ID NOS:1-17, 2034-14317, and certain cage polypeptides listed in Table 2, Table 3, and/or Table 4, or may further include a sequestered bioactive peptide (present as a fusion with the cage scaffold polypeptide) in the latch region of the cage scaffold polypeptide, as described in more detail herein (for example, see SEQ ID NOS:18-49, 51-52, 54-59, 61, 65, 67-2033, 27094-27117, 27120-27125, and certain cage polypeptides listed in Table 2, 3, and/or 4). In a specific embodiment, the cage polypeptides share 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along their length to the amino acid sequence of a cage polypeptide in Table 2, Table 3, and/or Table 4.

In another specific embodiment, the cage polypeptides share 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along their length to the amino acid sequence of a cage polypeptide in Table 3. In another specific embodiment, the cage polypeptides share 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along their length to the amino acid sequence of a cage polypeptide in Table 4. In one embodiment of each of these embodiments, the optional N-terminal and/or C-terminal 60 residues are not included in determining the percent sequence identity. In another embodiment, the optional residues may be included in determining percent sequence identity.

As disclosed in the examples that follow, exemplary cage and key polypeptides of the disclosure have been identified and subjected to mutational analysis. Furthermore, different designs starting from the same exemplary cage and key polypeptides yield different amino acid sequences while maintaining the same intended function. In various embodiments, a given amino acid can be replaced by a residue having similar physiochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are known. Polypeptides comprising conservative amino acid substitutions can be tested in any one of the assays described herein to confirm that the desired activity is retained. Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions will entail exchanging a member of one of these classes for another class. Particular conservative substitutions include, for example; Ala into Gly or into Ser; Arg into Lys; Asn into Gln or into H is; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

Exemplary Cage Polypeptides (See Also SEQ ID NOS: 92-14317, 27094-27117, 27120-27125, 27,728-27321, and Cage Polypeptides Listed in Table 2, Table 3, and/or Table 4):

1) Exemplary Reference Cage Polypeptides; Latch Regions Denoted by Brackets [ ]

6His-MBP-TEV, 6His-TEV, and flexible linker sequences are underlined text fused functional domains (DARPins, componants of the split intein, and fluorescent proteins) are bolded text Functional peptide is italicized underlined text Exemplary positions that have been mutated to any amino acid to tune responsiveness are underlined bolded text. These positions are exemplary, and not an exhaustive list of residues able to tune responsiveness.

C-terminal sequences that can be removed to tune responsiveness are contained within brackets. A range from one (1) to all residues encompassed within the brackets may be removed, starting from the C-terminus and removing successive residues therein.

All sequences in parentheses are optional

```
>SB76L
                                                                    (SEQ ID NO: 1)
(MGSSHHHHHHSSGLVPRGSHM)SKEAVTKLQALNIKLAEKLLEALARLQELNIALVYLAVELTDPKRIADEIKK

VKDKSKEIVERAEEEIARAAAESKKILDEGSGSGSDAVAELQALNLKLAELLLEAIAKLQELNIKLVELLTKLTD

PATIREAIRKVKEDSERIVAEAERLIAAAKAESERIIREGSGSGDPDVARLQELNIELARELLRAAAELQELNIK

LVELASELTDP[DEARKAIARVKRESKRIVEDAERLIREAAAASEKISRE]

>SB76L_17
                                                                    (SEQ ID NO: 2)
(MGSSHHHHHHSSGLVPRGSHM)GSKEAVTKLMALNLKLAEKLLEAIARLQELNIALVYLATELTDPERIREEIR

KVKEESARIVEEAEEEIRRAAARSEDILREGSGSGSDAVAELQRLNLELAELLLRAAAKLQELNIDLVRLLTELT
```

DPKTIRDAIERVKAESERIVREAERLIREAKADSERILREGSGSGDPDVARLQELFIELARELLEALARLQELNI
DLVRLASELTDP[DTIRDAIRRVKEESARIVEDARRLIKKAAEEAEKISRE]

>SB76L_18 (SEQ ID NO: 3)
(MGSSHHHHHHSSGLVPRGSHM)GSKRAVTELQKLNIELARKLLRALAELMELNIALVYLAVELTDPRRIREEIR
KVKEKSDEIVKRAEDEIRKAAAESEKILREGSGSGSDAVAELQRLNLELAKLLLEAIAKLQALNIDLVRLLTELT
DPETIRRAIKRVKDESARIVEEAEKLIRAAKDKAREIIDKGSGSGDPDVARLQELNIELARELLEAAARLQELFI
DLVRLASELTDP[DEARKAIERVKREAERIVREAERLIREAKRASKEISDE]

>LOCKR_extend5 (SEQ ID NO: 4)
(MGSSHHHHHHSSGLVPRGSHM)KLLEAVTKLQALNIKLAEKLLEALARLQELNIALVYLAVELTDPKRIADEIK
KVKDKSKEIVERAEEEIARAAAESKKILDEAEEEGSGSGSELLLEAVAELQALNLKLAELLLEAIAKLQELNIKL
VELLTKLTDPATIREAIRKVKEDSERIVAEAERLIAAAKAESERIIREAERLAGSGSGSRELLRDVARLQELNIE
LARELLRAAAELQELNIKLVELASELTDP[DEARKAIARVKRESKRIVEDAERLIREAAAASEKISREAERLI]

>LOCKR_extend9 (SEQ ID NO: 5)
(MGSSHHHHHHSSGLVPRGSHM)KLAEKLLEAVTKLQALNIKLAEKLLEALARLQELNIALVYLAVELTDPKRIA
DEIKKVKDKSKEIVERAEEEIARAAAESKKILDEAEEEIARAGSGSGSLKLAELLLEAVAELQALNLKLAELLLE
AIAKLQELNIKLVELLTKLTDPATIREAIRKVKEDSERIVAEAERLIAAAKAESERIIREAERLIAAAAGSGSGS
IELARELLRDVARLQELNIELARELLRAAAELQELNIKLVELASELTDP[DEARKAIARVKRESKRIVEDAERLI
REAAAASEKISREAERLIREAA]

>LOCKR_extend18 (SEQ ID NO: 6)
(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDP[DEARKAIARVKRESKRIVEDAERLIREAAAASEKISREAERLIREAAA
ASEKISRE]

>LOCKRb (SEQ ID NO: 7)
(MGSSHHHHHHSSGLVPRGSHM)SHAAVIKLSDLNIRLLDKLLQAVIKLTELNAELNRKLIEALQRLFDLNVALV
HLAAELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSNDPQVAQNQETFIELARDALRLVAENQEAFIEVAR
LTLRAAALAQEVAIKAVEAASEGGSGSG[NKEEIEKLAKEAREKLKKAEKEHKEIHDKLRKKNKKAREDLKKKAD
ELRETNKRVN]

>LOCKRc (SEQ ID NO: 8)
(MGSSHHHHHHSSGLVPRGSHM)SLEAVLKLAELNLKLSDKLAEAVQKLAALLNKLLEKLSEALQRLFELNVALV
TLAIELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSNDPLVARLQELLIEHARELLRLVATSQEIFIELAR
AFLANAAQLQEAAIKAVEAASENGSGSG[SSEKVRRELKESLKENHKQNQKLLKDHKRAQEKLNRELEELKKKHK
KTLDDIRRES]

-continued

>LOCKRd
(SEQ ID NO: 9)
(MGSSHHHHHHSSGLVPRGSHM)SLEAVLKLFELNHKLSEKLLEAVLKLHALNQKLSQKLLEALARLLELNVALV

ELAIELTDPKRIADEIKKVKDKSKEIVERAEEEIARAAAESKKILDEAEEEIARAAAESKKILDEGSGSGSDAVA

ELQALNLKLAELLLEAVAELQALNLKLAELLLEAIAKLQELNIKLVELLTKLTDPATIREAIRKVKEDSERIVAE

AERLIAAAKAESERIIREAERLIAAAKAESERIIREGSGSGDPEVARLQEAFIEQAREILRNVAAAQEALIEQAR

RLLALAALAQEAAIKAVELASEHGSGSG[DTVKRILEELRRRFEKLAKDLDDIARKLLEDHKKHNKELKDKQRKI

KKEADDAARS]

>LOCKRe
(SEQ ID NO: 10)
(MGSSHHHHHHSSGLVPRGSHM)SLEAVLKLQDLNSKLSEKLSEAQLKLQALNNKLLRKLLEALLRLQDLNQALV

NLALQLTDPKRIADEIKKVKDKSKEIVERAEEEIARAAAESKKILDEAEEEIARAAAESKKILDEGSGSGSDAVA

ELQALNLKLAELLLEAVAELQALNLKLAELLLEAIAKLQELNIKLVELLTKLTDPATIREAIRKVKEDSERIVAE

AERLIAAAKAESERIIREAERLIAAAKAESERIIREGSGSGDPDVAKSQEHLIEHARELLRQVAKSQELFIELAR

QLLRLAAKSQELAIKAVELASEAGSGSG[DDVERRLRKANKESKKEAEELTEEAKKANEKTKEDSKELTKENRKT

NKTIKDEARS]

>LOCKRf
(SEQ ID NO: 11)
(MGSSHHHHHHSSGLVPRGSHM)SREAVEKLAELNHKLSHKLQQAQQKLQALNLKLLQKLLEALDRLQDLNNALV

KLAQRLTDPKRIADEIKKVKDKSKEIVERAEEEIARAAAESKKILDEAEEEIARAAAESKKILDEGSGSGSDAVA

ELQALNLKLAELLLEAVAELQALNLKLAELLLEAIAKLQELNIKLVELLTKLTDPATIREAIRKVKEDSERIVAE

AERLIAAAKAESERIIREAERLIAAAKAESERIIREGSGSGDPDVARQQETLIEQARRLLRNVAESQELFIEAAR

TVLRLAAKLQEINIKQVELASEAGSGSG[DDEERRSEKTVQDAKREIKKVEDDLQRLNEEQKKKVKKQEDENQKT

LKKHKDDARS]

>miniLOCKRa_1
(SEQ ID NO: 12)
(MGSSHHHHHHSSGLVPRGSHM)NKEDATEAQKKAIRAAEELLKDVTRIQERAIREAEKALERLARVQEEAIRRV

YEAVESKNKEELKKVKEEIEELLRRLKRELDELEREIRELLKEIKEKADRLEKEIRDLIERIRRDRNASDEVVTR

LARLNEELIRELREDVRRLAELNKELLRELERAARELARLNEKLLELADRVETE[EEARKAIARVKRESKRIVED

AERLIREAAAASEKISREAERLIREAAAASEKISRE]

>miniLOCKRa_2
(SEQ ID NO: 13)
(MGSSHHHHHHSSGLVPRGSHM)DERLKRLNERLADELDKDLERLLRLNEELARELTRAAEELRELNEKLVELAK

KLQGGRSREVAERAEKEREKIRRKLEEIKKEIKEDADRIKKRADELRRRLEKTLEDAARELEKLKREPRTEELKR

KATELQKEAIRRAEELLKEVTDVQRRAIERAEELLEKLARLQEEAIRTVYLLVELNKV[DRARKAIARVKRESKR

IVEDAERLIREAAAASEKISREAERLIREAAAASEKISRE]

>miniLOCKRc_1
(SEQ ID NO: 14)
(MGSSHHHHHHSSGLVPRGSHM)LIERLTRLEKEHVRELKRLLDTSLEILRRLVEAFETNLRQLKEALKRALEAA

NLHNEEVEEVLRKLEEDLRRLEEELRKTLDDVRKEVKRLKEELDKRIKEVEDELRKIKEKLKKGDKNEKRVLEEI

LRLAEDVLKKSDKLAKDVQERARELNEILEELSRKLQELFERVVEEVTRNVPT[TERIEKVRRELKESLKENHKQ

NQKLLKDHKRAQEKLNRELEELKKKHKKTLDDIRRES]

>miniLOCKRc_2
(SEQ ID NO: 15)
(MGSSHHHHHHSSGLVPRGSHM)SEERVLELAEEEALRLSDEAAKEIQELARRLNEELEKLSKELQDLFERIVETV

TRLIDADEETLKRAAEEIKKRLEDARKKAKEAADKAREELDRARKKLKELVDEIRKKAKDALEKAGADEELVARL

LRLLEEHARELERLLRTSARIIERLLDAFRRNLEQLKEAADKAVEAAEEAVRRVED[VRVWSEKVRRELKESLKE

NHKQNQKLLKDHKRAQEKLNRELEELKKKHKKTLDDIRRES]

-continued

>1fix-short-noBim-t0 (SEQ ID NO: 16)
(MGSHHHHHGSGSENLYFQGSGG)SELARKLLEASTKLQRLNIRLAEALLEAIARLQELNLELVYLAVELTDPK
RIRDEIKEVKDKSKEIIRRAEKEIDDAAKESEKILEEAREAISGSGSELAKLLLKAIAETQDLNLRAAKAFLEAA
AKLQELNIRAVELLVKLTDPATIREALEHAKRRSKEIIDEAERAIRAAKRESERIIEEARRLIEKGSGSGS[ELA
RELLRAHAQLQRLNLELLRELLRALAQLQELNLDLLRLASELTDPDEARKAIARVKRESKRIVEDAERLIREAAA
ASEKISREAERLIR]

>1fix-short-noBim(AYYA)-t0 (SEQ ID NO: 17)
(MGSHHHHHGSGSENLYFQGSGG)SELARKLLEASTKLQRLNIRLAEALLEAIARLQELNLELVYLAVELTDPK
RIRDEIKEVKDKSKEIIRRAEKEIDDAAKESEKILEEAREAISGSGSELAKLLLKAIAETQDLNLRAAKAFLEAA
AKLQELNIRAVELLVKLTDPATIREALEHAKRRSKEIIDEAERAIRAAKRESERIIEEARRLIEKGSGSGS[ELA
RELLRAHAQLQRLNLELLRELLRALAQLQELNLDLLRLASELTDPDEARKAIARVKRESNAYYADAERLIREAAA
ASEKISREAERLIR]

"(3) Functional LOCKR Cage designs with bioactive peptides encoded into the Latch",
>aBcl2LOCKR (SEQ ID NO: 18)
(MGSSHHHHHHSSGLVPRGSHM)GSKEAVTKLQALNIKLAEKLLEALARLQELNIALVYLAVELTDPKRIADEIK
KVKDKSKEIVERAEEEIARAAAESKKILDEGSGSGSDAVAELQALNLKLAELLLEAIAKLQELNIKLVELLTKLT
DPATIREAIRKVKEDSERIVAEAERLIAAAKAESERIIREGSGSGDPDVARLQELNIELARELLRAAAELQELNI
KLVELASELT(GSGSGSG)[DP_KMAQELIDKVRAASLQINGDAFYAILRAL_AASEKLSKE]

>pBimLOCKR (SEQ ID NO: 19)
(MGSSHHHHHHSSGLVPRGSHM)KEAVTKLQALNIKLAEKLLEALARLQELNIALVYLAVELTDPKRIADEIKKV
KDKSKEIVERAEEEIARAAAESKKILDEGSGSGSDAVAELQALNLKLAELLLEAIAKLQELNIKLVELLTKLTDP
ATIREAIRKVKEDSERIVAEAERLIAAAKAESERIIREGSGSGDPDVARLQELNIELARELLRAAAELQELNIKL
VELASEGSGSGS[E_I_AEA_LRA_IGD_V_FNES_Y_RIVEDAERL_I_REAAAASEKISRE]

>BimLOCKR_extend5 (SEQ ID NO: 20)
(MGSSHHHHHHSSGLVPRGSHM)KLLEAVTKLQALNIKLAEKLLEALARLQELNIALVYLAVELTDPKRIADEIK
KVKDKSKEIVERAEEEIARAAAESKKILDEAEEEGSGSGSELLLEAVAELQALNLKLAELLLEAIAKLQELNIKL
VELLTKLTDPATIREAIRKVKEDSERIVAEAERLIAAAKAESERIIREAERLAGSGSGSRELLRDVARLQELNIE
LARELLRAAAELQELNIKLVELASELTD[_EIWIAQELRRIGDEFNAYYA_DAERLIREAAAASEKISREAERLI]

>BimLOCKR_extend9 (SEQ ID NO: 21)
(MGSSHHHHHHSSGLVPRGSHM)KLAEKLLEAVTKLQALNIKLAEKLLEALARLQELNIALVYLAVELTDPKRIA
DEIKKVKDKSKEIVERAEEEIARAAAESKKILDEAEEEIARAGSGSGSLKLAELLLEAVAELQALNLKLAELLLE
AIAKLQELNIKLVELLTKLTDPATIREAIRKVKEDSERIVAEAERLIAAAKAESERIIREAERLIAAAAGSGSGS
IELARELLRDVARLQELNIELARELLRAAAELQELNIKLVELASELTD[_EIWIAQELRRIGDEFNAYYA_DAERLI
REAAAASEKISREAERLIREAA]

>BimLOCKR_extend18 (SEQ ID NO: 22)
(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTD[_EIWIAQELRRIGDEFNAYYA_DAERLIREAAAASEKISREAERLIREAAA
ASEKISRE]

>BimLOCKRb (SEQ ID NO: 23)
(MGSSHHHHHHSSGLVPRGSHM)SHAAVIKLSDLNIRLLDKLLQAVIKLTELNAELNRKLIEALQRLFDLNVALV
HLAAELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSNDPQVAQNQETFIELARDALRLVAENQEAFIEVAR
LTLRAAALAQEVAIKAVEAASEGGSGSG[NEIWIAQELRRIGDEFNAYYAEHKEIHDKLRKKNKKAREDLKKKAD
ELRETNKRVN]

>BimLOCKRc (SEQ ID NO: 24)
(MGSSHHHHHHSSGLVPRGSHM)SLEAVLKLAELNLKLSDKLAEAVQKLAALLNKLLEKLSEALQRLFELNVALV
TLAIELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSNDPLVARLQELLIEHARELLRLVATSQEIFIELAR
AFLANAAQLQEAAIKAVEAASENGSG[EIWIAQELRRIGDEFNAYYAQNQKLLKDHKRAQEKLNRELEELKKKHK
KTLDDIRRES]

>BimLOCKRd (SEQ ID NO: 25)
(MGSSHHHHHHSSGLVPRGSHM)SLEAVLKLFELNHKLSEKLLEAVLKLHALNQKLSQKLLEALARLLELNVALV
ELAIELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPEVARLQEAFIEQAREILRNVAAAQEALIEQAR
RLLALAALAQEAAIKAVELASEHGSGS[EIWIAQELRRIGDEFNAYYADLDDIARKLLEDHKKHNKELKDKQRKI
KTIKDEARS]

>StrepLOCKRa_300 (SEQ ID NO: 26)
(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELAS(GG)[NWSHPQFEKKAIARVKRESKRIVEDAERLIREAAAASEKISREAERLIR
EAAAASEKISRE]

>strepLOCKRa_306 (SEQ ID NO: 27)
(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[ENWSHPQFEKRESKRIVEDAERLIREAAAASEKISREAERLIREAAA
ASEKISRE]

>strepLOCKRa_309 (SEQ ID NO: 28)
(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR ELLRAAAELQELNIKLVELASELTDPD[EARK*NWSHPQFEK*KRIVEDAERLIREAAAASEKISREAERLIREAAA
ASEKISRE]

>strepLOCKRa_312  (SEQ ID NO: 29)
(<u>MGSSHHHHHHSSGLVPRGSHM</u>)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EARKAIA*NWSHPQFEK*VEDAERLIREAAAASEKISREAERLIREAAA
ASEKISRE]

>strepLOCKRa_313  (SEQ ID NO: 30)
(<u>MGSSHHHHHHSSGLVPRGSHM</u>)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EARKAIAR*NWSHPQFEK*EDAERLIREAAAASEKISREAERLIREAAA
ASEKISRE]

>strepLOCKRa_317  (SEQ ID NO: 31)
(<u>MGSSHHHHHHSSGLVPRGSHM</u>)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EARKAIARVKRE*NWSHPQFEK*RLIREAAAASEKISREAERLIREAAA
ASEKISRE]

>strepLOCKRa_320  (SEQ ID NO: 32)
(<u>MGSSHHHHHHSSGLVPRGSHM</u>)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EARKAIARVKRESKR*NWSHPQFEK*REAAAASEKISREAERLIREAAA
ASEKISRE]

>strepLOCKRa_323  (SEQ ID NO: 33)
(<u>MGSSHHHHHHSSGLVPRGSHM</u>)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EARKAIARVKRESKRIVE*NWSHPQFEK*AAASEKISREAERLIREAAA
ASEKISRE]

>strepLOCKRa_329  (SEQ ID NO: 34)
(<u>MGSSHHHHHHSSGLVPRGSHM</u>)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE -continued

AERLIAAAKAESERIIREAERLIAAAKAESERIIREGSGSGDPDVARLQELNIELARELLRDVARLQELNIELAR

ELLRAAAELQELNIKLVELASELTDPD[EARKAIARVKRESKRIVEDAERLI<u>NWSHPQFEK</u>ISREAERLIREAAA

ASEKISRE]

>SB13_LOCKR (SEQ ID NO: 35)
(<u>MGSSHHHHHHSSGLVPRGSHM</u>)GSKEAVTKLQALNIKLAEKLLEALARLQELNIALVYLAVELTDPKRIADEIK

KVKDKSKEIVERAEEEIARAAAESKKILDEGSGSGSDAVAELQALNLKLAELLLEAIAKLQELNIKLVELLTKLT

DPATIREAIRKVKEDSERIVAEAERLIAAAKAESERIIREGSGSGDPDVARLQELNIELARELLRAAAELQELNI

KLVELASEGSGSGSG[<u>YELRRALEELEKALRELKKSLDEIERSLEELEKNPSEDALVENNRLNVENNKIIVEVLR</u>

<u>IIAEVLKINAKS</u>]

>ZCX12_LOCKR (SEQ ID NO: 36)
(<u>MGSSHHHHHHSSGLVPRGSHM</u>)GSKEAVTKLQALNIKLAEKLLEALARLQELNIALVYLAVELTDPKRIADEIK

KVKDKSKEIVERAEEEIARAAAESKKILDEGSGSGSDAVAELQALNLKLAELLLEAIAKLQELNIKLVELLTKLT

DPATIREAIRKVKEDSERIVAEAERLIAAAKAESERIIREGSGSGDPDVARLQELNIELARELLRAAAELQELNI

KINEIASEGSGSGSG[<u>KKLVEEVERALRELLKTSEDLVRKVEKALRELLELIRRGGTKDKIEEKIRRVLEEIKRE</u>

<u>LERQKRKIEDVLRQIKEELYRS</u>]

>SB13_LOCKR_extend18 (SEQ ID NO: 37)
(<u>MGSSHHHHHHSSGLVPRGSHM</u>)SKEAVTKLQALNIKLAEKLLEAVTKLQALNIKLAEKLLEALARLQELNIALV

YLAVELTDPKRIADEIKKVKDKSKEIVERAEEEIARAAAESKKILDEAEEEIARAAAESKKILDEGSGSGSDAVA

ELQALNLKLAELLLEAVAELQALNLKLAELLLEAIAKLQELNIKLVELLTKLTDPATIREAIRKVKEDSERIVAE

AERLIAAAKAESERIIREAERLIAAAKAESERIIREGSGSGDPDVARLQELNIELARELLRDVARLQELNIELAR

ELLRAAAELQELNIKLVELASEGSGSGSG[<u>YELRRALEELEKALRELKKSLDELERSLEELEKNPSEDALVENNR</u>

<u>LNVENNKIIVEVLRIIAEVLKINAKS</u>]

>ZCX12_LOCKR_extend18 (SEQ ID NO: 38)
(<u>MGSSHHHHHHSSGLVPRGSHM</u>)SKEAVTKLQALNIKLAEKLLEAVTKLQALNIKLAEKLLEALARLQELNIALV

YLAVELTDPKRIADEIKKVKDKSKEIVERAEEEIARAAAESKKILDEAEEEIARAAAESKKILDEGSGSGSDAVA

ELQALNLKLAELLLEAVAELQALNLKLAELLLEAIAKLQELNIKLVELLTKLTDPATIREAIRKVKEDSERIVAE

AERLIAAAKAESERIIREAERLIAAAKAESERIIREGSGSGDPDVARLQELNIELARELLRDVARLQELNIELAR

ELLRAAAELQELNIKLVELASEGSGSGSG[<u>KKLVEEVERALRELLKTSEDLVRKVEKALRELLELIRRGGTKDKI</u>

<u>EEKIRRVLEEIKRELERQKRKIEDVLRQIKEELYRS</u>]

>fretLOCKRa (SEQ ID NO: 39)
(<u>GHHHHHHHHHHG</u>VSKGEELFTGVVPILVELDGDVNGHKFSVSGEGEGDATYGKLTLKFICTTGKLPVPWPTLVT

TLSWGVQCFARYPDHMKQHDFFKSAMPEGYVQERTIFFKDDGNYKTRAEVKFEGDTLVNRIELKGIDFKEDGNIL

GHKLEYNYFSDNVYITADKQKNGIKANFKIRHNIEDGGVQLADHYQQNTPIGDPVLLPDNHYLSTQSKLSKDPN

EKRDHMVLLEFVTAAGITLGMDELYK<u>GSGCSLQGM</u>)SKEAVTKLQALNIKLAEKLLEAVTKLQALNIKLAEKLLE

ALARLQELNIALVYLAVELTDPKRIADEIKKVKDKSKEIVERAEEEIARAAAESKKILDEAEEEIARAAAESKKI

LDEGSGSGSDAVAELQALNLKLAELLLEAVAELQALNLKLAELLLEAIAKLQELNIKLVELLTKLTDPATIREAI

RKVKEDSERIVAEAERLIAAAKAESERIIREAERLIAAAKAESERIIREGSGSGDPDVARLQELNIELARELLRD

VARLQELNIELARELLRAAAELQELNIKLVELASELTDPD[EARKAIARVKRESKRIVEDAERLIREAAASEKI

SREAERLIREAAASEKISRE](VSKGEELFTGVVPILVELDGDVNGHKFSVSGEGEGDATYGKLTLKLICTTGK

LPVPWPTLVTTLGYGVQCFARYPDHMKQHDFFKSAMPEGYVQERTIFFKDDGNYKTRAEVKFEGDTLVNRIELKG

-continued

IDFKEDGNILGHKLEYNYNSHNVYITADKQKNGIKANFKIRHNIEDGGVQLADHYQQNTPIGDGPVLLPDNHYLS

YQSKLSKDPNEKRDHMVLLEFVTAAGITLGMDELYK)

>fretLOCKRb (SEQ ID NO: 40)

(MGHHHHHHHHHHGVSKGEELFTGVVPILVELDGDVNGHKFSVSGEGEGDATYGKLTLKFICTTGKLPVPWPTLV

TTLSWGVQCFARYPDHMKQHDFFKSAMPEGYVQERTIFFKDDGNYKTRAEVKFEGDTLVNRIELKGIDFKEDGNI

LGHKLEYNYFSDNVYITADKQKNGIKANFKIRHNIEDGGVQLADHYQQNTPIGDGPVLLPDNHYLSTQSKLSKDP

NEKRDHMVLLEFVTAAGITLGMDELYKGSGCSLQGM)SHAAVIKLSDLNIRLLDKLLQAVIKLTELNAELNRKLI

EALQRLFDLNVALVHLAAELTDPKRIADEIKKVKDKSKEIVERAEEEIARAAAESKKILDEAEEEIARAAAESKK

ILDEGSGSGSDAVAELQALNLKLAELLLEAVAELQALNLKLAELLLEAIAKLQELNIKLVELLTKLTDPATIREA

IRKVKEDSERIVAEAERLIAAAKAESERIIREAERLIAAAKAESERIIREGSGSNDPQVAQNQETFIELARDALR

LVAENQEAFIEVARLTLRAAALAQEVAIKAVEAASEGGSGSG[NKEEIEKLAKEAREKLKKAEKEHKEIHDKLRK

KNKKAREDLKKKADELRETNKRVN](VSKGEELFTGVVPILVELDGDVNGHKFSVSGEGEGDATYGKLTLKLICT

TGKLPVPWPTLVTTLGYGVQCFARYPDHMKQHDFFKSAMPEGYVQERTIFFKDDGNYKTRAEVKFEGDTLVNRIE

LKGIDFKEDGNILGHKLEYNYNSHNVYITADKQKNGIKANFKIRHNIEDGGVQLADHYQQNTPIGDGPVLLPDNH

YLSYQSKLSKDPNEKRDHMVLLEFVTAAGITLGMDELYK)

>fretLOCKRc (SEQ ID NO: 41)

(GHHHHHHHHHHGVSKGEELFTGVVPILVELDGDVNGHKFSVSGEGEGDATYGKLTLKFICTTGKLPVPWPTLVT

TLSWGVQCFARYPDHMKQHDFFKSAMPEGYVQERTIFFKDDGNYKTRAEVKFEGDTLVNRIELKGIDFKEDGNIL

GHKLEYNYFSDNVYITADKQKNGIKANFKIRHNIEDGGVQLADHYQQNTPIGDGPVLLPDNHYLSTQSKLSKDPN

EKRDHMVLLEFVTAAGITLGMDELYKGSGCSLQGM)SLEAVLKLAELNLKLSDKLAEAVQKLAALLNKLLEKLSE

ALQRLFELNVALVTLAIELTDPKRIADEIKKVKDKSKEIVERAEEEIARAAAESKKILDEAEEEIARAAAESKKI

LDEGSGSGSDAVAELQALNLKLAELLLEAVAELQALNLKLAELLLEAIAKLQELNIKLVELLTKLTDPATIREAI

RKVKEDSERIVAEAERLIAAAKAESERIIREAERLIAAAKAESERIIREGSGSNDPLVARLQELLIEHARELLRL

VATSQEIFIELARAFLANAAQLQEAAIKAVEAASENGSGSGS[SEKVRRELKESLKENHKQNQKLLKDHKRAQEK

LNRELEELKKHKKTLDDIRRES](VSKGEELFTGVVPILVELDGDVNGHKFSVSGEGEGDATYGKLTLKLICTT

GKLPVPWPTLVTTLGYGVQCFARYPDHMKQHDFFKSAMPEGYVQERTIFFKDDGNYKTRAEVKFEGDTLVNRIEL

KGIDFKEDGNILGHKLEYNYNSHNVYITADKQKNGIKANFKIRHNIEDGGVQLADHYQQNTPIGDGPVLLPDNHY

LSYQSKLSKDPNEKRDHMVLLEFVTAAGITLGMDELYK)

>fretLOCKRd (SEQ ID NO: 42)

(GHHHHHHHHHHGVSKGEELFTGVVPILVELDGDVNGHKFSVSGEGEGDATYGKLTLKFICTTGKLPVPWPTLVT

TLSWGVQCFARYPDHMKQHDFFKSAMPEGYVQERTIFFKDDGNYKTRAEVKFEGDTLVNRIELKGIDFKEDGNIL

GHKLEYNYFSDNVYITADKQKNGIKANFKIRHNIEDGGVQLADHYQQNTPIGDGPVLLPDNHYLSTQSKLSKDPN

EKRDHMVLLEFVTAAGITLGMDELYKGSGCSLQGM)SLEAVLKLFELNHKLSEKLLEAVLKLHALNQKLSQKLLE

ALARLLELNVALVELAIELTDPKRIADEIKKVKDKSKEIVERAEEEIARAAAESKKILDEAEEEIARAAAESKKI

LDEGSGSGSDAVAELQALNLKLAELLLEAVAELQALNLKLAELLLEAIAKLQELNIKLVELLTKLTDPATIREAI

RKVKEDSERIVAEAERLIAAAKAESERIIREAERLIAAAKAESERIIREGSGSGDPEVARLQEAFIEQAREILRN

VAAAQEALIEQARRLLALAALAQEAAIKAVELASEHGSGSG[DTVKRILEELRRRFEKLAKDLDDIARKLLEDHK

KHNKELKDKQRKIKKEADDAARS](VSKGEELFTGVVPILVELDGDVNGHKESVSGEGEGDATYGKLTLKLICTT

GKLPVPWPTLVTTLGYGVQCFARYPDHMKQHDFFKSAMPEGYVQERTIFFKDDGNYKTRAEVKFEGDTLVNRIEL

KGIDFKEDGNILGHKLEYNYNSHNVYITADKQKNGIKANFKIRHNIEDGGVQLADHYQQNTPIGDGPVLLPDNHY

LSYQSKLSKDPNEKRDHMVLLEFVTAAGITLGMDELYK)

>tevLOCKR (SEQ ID NO: 43)

(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EARKAIARVKRESKRIVEDAE*ENLYFQG*AASEKISREAERLIREAAA
ASEKISRE]

>spyLOCKR (SEQ ID NO: 44)

(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EAR*AHIVMVDAYK*KRIVEDAERLIREAAAASEKISREAERLIREAAA
ASEKISRE]

>1_nesLOCKR (SEQ ID NO: 45)

SKEAVTKLQALNIKLAEKLLEAVTKLQALNIKLAEKLLEALARLQELNIALVYLAVELTDPKRIADEIKKVKDKS
KEIVERAEEEIARAAAESKKILDEAEEEIARAAAESKKILDEGSGSGSDAVAELQALNLKLAELLLEAVAELQAL
NLKLAELLLEAIAKLQELNIKLVELLTKLTDPATIREAIRKVKEDSERIVAEAERLIAAAKAESERIIREAERLI
AAAKAESERIIREGSGSGDPDVARLQELNIELARELLRDVARLQELNIELARELLRAAAELQELNIKLVELASEL
TDPD[EARKAIARVKRESKRIVED*LALKLAGLDIN*SEKISREAERLIREAAAASEKISRE]

>2_nesLOCKR (SEQ ID NO: 46)

SKEAVTKLQALNIKLAEKLLEAVTKLQALNIKLAEKLLEALARLQELNIALVYLAVELTDPKRIADEIKKVKDKS
KEIVERAEEEIARAAAESKKILDEAEEEIARAAAESKKILDEGSGSGSDAVAELQALNLKLAELLLEAVAELQAL
NLKLAELLLEAIAKLQELNIKLVELLTKLTDPATIREAIRKVKEDSERIVAEAERLIAAAKAESERIIREAERLI
AAAKAESERIIREGSGSGDPDVARLQELNIELARELLRDVARLQELNIELARELLRAAAELQELNIKLVELASEL
TDPD[EARKAIARVKRESKRIVEDAERLIR*ELAEKLAGLDIN*AERLIREAAAASEKISRE]

>3_nesLOCKR (SEQ ID NO: 47)

SKEAVTKLQALNIKLAEKLLEAVTKLQALNIKLAEKLLEALARLQELNIALVYLAVELTDPKRIADEIKKVKDKS
KEIVERAEEEIARAAAESKKILDEAEEEIARAAAESKKILDEGSGSGSDAVAELQALNLKLAELLLEAVAELQAL
NLKLAELLLEAIAKLQELNIKLVELLTKLTDPATIREAIRKVKEDSERIVAEAERLIAAAKAESERIIREAERLI
AAAKAESERIIREGSGSGDPDVARLQELNIELARELLRDVARLQELNIELARELLRAAAELQELNIKLVELASEL
TDPD[EARKAIARVKRESK*ELAEKLRAGLDLN*AAASEKISREAERLIREAAAASEKISRE]

>nlsLOCKR (SEQ ID NO: 48)

SKEAVTKLQALNIKLAEKLLEAVTKLQALNIKLAEKLLEALARLQELNIALVYLAVELTDPKRIADEIKKVKDKS
KEIVERAEEEIARAAAESKKILDEAEEEIARAAAESKKILDEGSGSGSDAVAELQALNLKLAELLLEAVAELQAL
NLKLAELLLEAIAKLQELNIKLVELLTKLTDPATIREAIRKVKEDSERIVAEAERLIAAAKAESERIIREAERLI
AAAKAESERIIREGSGSGDPDVARLQELNIELARELLRDVARLQELNIELARELLRAAAELQELNIKLVELASEL
TDPD[EARKAIARVKRESK*AAAKRARTS*IREAAAASEKISREAERLIREAAAASEKISRE]

>ezh2LOCKR
(SEQ ID NO: 49)

(MGSSHHHHHHSSGLVPRGSHM)SKEAVTKLQALNIKLAEKLLEAVTKLQALNIKLAEKLLEALARLQELNIALV
YLAVELTDPKRIADEIKKVKDKSKEIVERAEEEIARAAAESKKILDEAEEEIARAAAESKKILDEGSGSGSDAVA
ELQALNLKLAELLLEAVAELQALNLKLAELLLEAIAKLQELNIKLVELLTKLTDPATIREAIRKVKEDSERIVAE
AERLIAAAKAESERIIREAERLIAAAKAESERIIREGSGSGDPDVARLQELNIELARELLRDVARLQELNIELAR
ELLRAAAELQELNIKLVELASELTDPD[EARKAIARVK*TMFSSNRQ*KILERTETLNQEWKQRRIQAERLIREAAA
ASEKISRE]

>1fix_VMAc_C_BIMlatcht9
(SEQ ID NO: 51)

(MGSHHHHHHGSGSENLYFQG)SKKAAKKLQDLNIELARKLLEASTKLQRLNIRLAKALLEAIARLQELNLELVY
LAVELTDPKRIRDEIKEVKDKSKEIIRRAEKEIDDAAKESKKILEEARKAIRDAAEESRKILEEGSGSGSDALDE
LQKLNLELAKLLLKAIAETQDLNLRAAKAFLEAAAKLQELNIRAVELLVKLTDPATIRRALEHAKRRSKEIIDEA
ERAIRAAKRESERIIEEARRLIEKAKEESERIIREGSGSGDPDIKKLQDLNIELARELLRAHAQLQRLNLELLRE
LLRALAQLQELNLDLLRLASELTGGSGGSGGS(**VLLNVLSKCAGSKKFRPAPAAAFARECRGFYFELQELKEDDY
YGITLSDDSDHQFLLANQVVVHNC**)GGSGGS[D*EIWIAQELRRIGDEFNAYYA*DAERLIREAAAASEKISREAER
LIREAA

>sfGFP_VMAn_1fix_BIM_t0_latch
(SEQ ID NO: 52)

(MGSHHHHHHGSGSENLYFQG)HMSKGEELFTGVVPILVELDGDVNGHKFSVRGEGEGDATNGKLTLKFICTTGK
LPVPWPTLVTTLTYGVQCFARYPDHMKQHDFFKSAMPEGYVQERTISFKDDGTYKTRAEVKFEGDTLVNRIELKG
IDFKEDGNILGHKLEYNFNSHNVYITADKQKNGIKANFKIRHNVEDGSVQLADHYQQNTPIGDGPVLLPDNHYLS
TQSVLSKDPNEKRDHMVLLEFVTAAGITHGMDELYKSGSGSGCFAKGTNVLMADGSIECIENIEVGNKVMGKDGR
PREVIKLPRGRETMYSVVQKSQHRAHKSDSSREVPELLKFTCNATHELVVRTPRSVRRLSRTIKGVEYFEVITFE
MGQKKAPDGRIVELVEEVSKSYPISEGPERANELVESYRKASNKAYFEWTIEARDLSLLGSHVRKATYQTYAPIL
YGGSGGSGGGGSGGSGSKKAAKKLQDLNIELARKLLEASTKLQRLNIRLAEALLEAIARLQELNLELVYLAVELT
DPKRIRDEIKEVKDKSKEIIRRAEKEIDDAAKESKKILEEARKAIRDAAEESRKILEEGSGSGSDALDELQKLNL
ELAKLLLKAIAETQDLNLRAAKAFLEAAAKLQELNIRAVELLVKLTDPATIRRALEHAKRRSKEIIDEAERAIRA
AKRESERIIEEARRLIEKAKEESERIIREGSGSGDPDIKKLQDLNIELARELLRAHAQLQRLNLELLRELLRALA
QLQELNLDLLRLASELT[D*EIWIAQELRRIGDEFNAYYA*DAERLSREAAAASEKISREAERSIREAAAASEKISR
E]

Asymmetrized Functional Cages Encoding Bim and GFP11 (i.e.: Bioactive Peptides)
(6His-MBP-TEV, 6His-TEV, and flexible linker sequences are underlined text)
(Co-localization domain is bolded text)
(Functional peptide is italicized underlined text)
(Positions that can be mutated to any amino acid to tune responsiveness are underlined bolded text)
(C-terminal sequences that can be removed to tune responsiveness are italicized text)
(all sequences in parentheses are optional)

>1fix-long-BIM-t0
(SEQ ID NO: 54)

(MGSHHHHHHGSGSENLYFQG)SKEAAKKLQDLNIELARKLLEASTKLQRLNIRLAEALLEAIARLQELNLELVY
LAVELTDPKRIRDEIKEVKDKSKEIIRRAEKEIDDAAKESKKILEEARKAIRDAAEESRKILEEGSGSGSDALDE
LQKLNLELAKLLLKAIAETQDLNLRAAKAFLEAAAKLQELNIRAVELLVKLTDPATIRRALEHAKRRSKEIIDEA
ERAIRAAKRESERIIEEARRLIEKAKEESERIIREGSGSGDPDIKKLQDLNIELARELLRAHAQLQRLNLELLRE
LLRALAQLQELNLDLLRLASEL(TD[*EIWIAQELRRIGDEFNAYYA*])DAERLIREAAAASEKISREAERLIREAA
AASEKISRE]

-continued

>1fix-long-GFP-t0

(SEQ ID NO: 55)

(MGSHHHHHHGSGSENLYFQG)SKEAAKKLQDLNIELARKLLEASTKLQRLNIRLAEALLEAIARLQELNLELVY

LAVELTDPKRIRDEIKEVKDKSKEIIRRAEKEIDDAAKESKKILEEARKAIRDAAEESRKILEEGSGSGSDALDE

LQKLNLELAKLLLKAIAETQDLNLRAAKAFLEAAAKLQELNIRAVELLVKLTDPATIRRALEHAKRRSKEIIDEA

ERAIRAAKRESERIIEEARRLIEKAKEESERIIREGSGSGDPDIKKLQDLNIELARELLRAHAQLQRLNLELLRE

LLRALAQLQELNLDLLRLASEL[(*RDHMVLHEYVNAAGIT*FNAYYA)DAERLIREAAAASEKISREAERLIREAA

AASEKISRE]

>1fix-short-BIM-t0

(SEQ ID NO: 56)

(MGSHHHHHHGSGSENLYFQGSGG)SELARKLLEASTKLQRLNIRLAEALLEAIARLQELNLELVYLAVELTDPK

RIRDEIKEVKDKSKEIIRRAEKEIDDAAKESEKILEEAREAISGSGSELAKLLLKAIAETQDLNLRAAKAFLEAA

AKLQELNIRAVELLVKLTDPATIREALEHAKRRSKEIIDEAERAIRAAKRESERIIEEARRLIEKGSGSGSELAR

ELLRAHAQLQRLNLELLRELLRALAQLQELNLDLLRLASEL(TD[*EIWIAQELRRIGDEF*NAYYA)DAERLIREA

AAASEKISREAERLIR]

>1fix-short-GFP-t0

(SEQ ID NO: 57)

(MGSHHHHHHGSGSENLYFQGSGG)SELARKLLEASTKLQRLNIRLAEALLEAIARLQELNLELVYLAVELTDPK

RIRDEIKEVKDKSKEIIRRAEKEIDDAAKESEKILEEAREAISGSGSELAKLLLKAIAETQDLNLRAAKAFLEAA

AKLQELNIRAVELLVKLTDPATIREALEHAKRRSKEIIDEAERAIRAAKRESERIIEEARRLIEKGSGSGSELAR

ELLRAHAQLQRLNLELLRELLRALAQLQELNLDLLRLASEL[(*RDHMVLHEYVNAAGIT*FNAYYA)DAERLIREA

AAASEKISREAERLIR]

>Spycatcher-1fix-long-GFP-t0

(SEQ ID NO: 58)

(MGSHHHHHHGSGSENLYFQGS)AMVDTLSGLSSEQGQSGDMTIEEDSATHIKFSKRDEDGKELAGATMELRDSS

GKTISTWISDGQVKDFYLYPGKYTFVETAAPDGYEVATAITFTVNEQGQVTVNGKATKGSGGSKEAAKKLQDLNI

ELARKLLEASTKLQRLNIRLAEALLEAIARLQELNLELVYLAVELTDPKRIRDEIKEVKDKSKEIIRRAEKEIDD

AAKESKKILEEARKAIRDAAEESRKILEEGSGSGSDALDELQKLNLELAKLLLKAIAETQDLNLRAAKAFLEAAA

KLQELNIRAVELLVKLTDPATIRRALEHAKRRSKEIIDEAERAIRAAKRESERIIEEARRLIEKAKEESERIIRE

GSGSGDPDIKKLQDLNIELARELLRAHAQLQRLNLELLRELLRALAQLQELNLDLLRLASEL[(*RDHMVLHEYVN*

*AAGIT*FNAYYA)DAERLIREAAAASEKISREAERLIREAAAASEKISRE]

>Spycatcher-1fix-short-GFP-t0

(SEQ ID NO: 59)

(MGSHHHHHHGSGSENLYFQGS)AMVDTLSGLSSEQGQSGDMTIEEDSATHIKFSKRDEDGKELAGATMELRDSS

GKTISTWISDGQVKDFYLYPGKYTFVETAAPDGYEVATAITFTVNEQGQVTVNGKATKGSGGSELARKLLEASTK

LQRLNIRLAEALLEAIARLQELNLELVYLAVELTDPKRIRDEIKEVKDKSKEIIRRAEKEIDDAAKESEKILEEA

REAISGSGSELAKLLLKAIAETQDLNLRAAKAFLEAAAKLQELNIRAVELLVKLTDPATIREALEHAKRRSKEII

DEAERAIRAAKRESERIIEEARRLIEKGSGSGSELARELLRAHAQLQRLNLELLRELLRALAQLQELNLDLLRLA

SEL[(*RDHMVLHEYVNAAGIT*FNAYYA)DAERLIREAAAASEKISREAERLIR]

>1fix-latch_Mad1SID_t0_1

(SEQ ID NO: 61)

(MGSHHHHHHGSGSENLYFQG)SKEAAKKLQDLNIELARKLLEASTKLQRLNIRLAEALLEAIARLQELNLELVY

LAVELTDPKRIRDEIKEVKDKSKEIIRRAEKEIDDAAKESKKILEEARKAIRDAAEESRKILEEGSGSGSDALDE

LQKLNLELAKLLLKAIAETQDLNLRAAKAFLEAAAKLQELNIRAVELLVKLTDPATIRRALEHAKRRSKEIIDEA

ERAIRAAKRESERIIEEARRLIEKAKEESERIIREGSGSGDPDIKKLQDLNIELARELLRAHAQLQRLNLELLRE

LLRALAQLQELNLDLLRLASELT[(*NIQMLLEAADYLE*)RESKRIVEDAERLIREAAAASEKISREAERSIREAA

AASEKISRE]

-continued

>1fix-latch_Mad1SID_T0_2
(SEQ ID NO: 65)
(MGSHHHHHGSGSENLYFQG)SKEAAKKLQDLNIELARKLLEASTKLQRLNIRLAEALLEAIARLQELNLELVY
LAVELTDPKRIRDEIKEVKDKSKEIIRRAEKEIDDAAKESKKILEEARKAIRDAAEESRKILEEGSGSGSDALDE
LQKLNLELAKLLLKAIAETQDLNLRAAKAFLEAAAKLQELNIRAVELLVKLTDPATIRRALEHAKRRSKEIIDEA
ERAIRAAKRESERIIEEARRLIEKAKEESERIIREGSGSGDPDIKKLQDLNIELARELLRAHAQLQRLNLELLRE
LLRALAQLQELNLDLLRLASELTDP[DEARK(*NIQMLLEAADYLE*)EDAERLIREAAAASEKISREAERLIREAA
SEKISRE]

>1fix-short-Bim-t0-relooped
(SEQ ID NO: 67)
[MDEARKAIARVKRESKRI(*EIWIAQELRRIGDEFNAYYA*)EAEKLAT]DELWHRLLEASTKLQRLNIRLAEALL
EAIARLQELNLELVYLAVELTDPKRIRDEIKEVKDKSKEIIRRAEKEIDDAAKESEKILEEAREAISGSGSELAK
LLLKAIAETQDLNLRAAKAFLEAAAKLQELNIRAVELLVKLTDPATIREALEHAKRRSKEIIDEAERAIRAAKRE
SERIIEEARRLIEKGSGSGSELARELLRAHAQLQRLNLELLRELLRALAQLQELNLDLLRLASE >1fix-short-spytag-t0_2
(SEQ ID NO: 68)
(MGSSHHHHHHSSGLVPRGSHM)SELARKLLEASTKLQRLNIRLAEALLEAIARLQELNLELVYLAVELTDPKRI
RDEIKEVKDKSKEIIRRAEKEIDDAAKESEKILEEAREAISGSGSELAKLLLKAIAETQDLNLRAAKAFLEAAAK
LQELNIRAVELLVKLTDPATIREALEHAKRRSKEIIDEAERAIRAAKRESERIIEEARRLIEKGSGSGSELAREL
LRAHAQLQRLNLELLRELLRALAQLQELNLDLLRLASELTDPD[EAR(*AHIVMVDAYK*)KRIVEDAERLIREAAA
ASEKISREAERLIR]

>1fix-short-spytag-t0_8
(SEQ ID NO: 69)
(MGSSHHHHHHSSGLVPRGSHM)SELARKLLEASTKLQRLNIRLAEALLEAIARLQELNLELVYLAVELTDPKRI
RDEIKEVKDKSKEIIRRAEKEIDDAAKESEKILEEAREAISGSGSELAKLLLKAIAETQDLNLRAAKAFLEAAAK
LQELNIRAVELLVKLTDPATIREALEHAKRRSKEIIDEAERAIRAAKRESERIIEEARRLIEKGSGSGSELAREL
LRAHAQLQRLNLELLRELLRALAQLQELNLDLLRLASELTDPD[EARKAIARVKRESK(*AHIVMVDAYK*)REAAA
ASEKISREAERLIR]

>1fix-short-TEV-t0_1
(SEQ ID NO: 70)
(MGSSHHHHHHSSGLVPRGSHM)SELARKLLEASTKLQRLNIRLAEALLEAIARLQELNLELVYLAVELTDPKRI
RDEIKEVKDKSKEIIRRAEKEIDDAAKESEKILEEAREAISGSGSELAKLLLKAIAETQDLNLRAAKAFLEAAAK
LQELNIRAVELLVKLTDPATIREALEHAKRRSKEIIDEAERAIRAAKRESERIIEEARRLIEKGSGSGSELAREL
LRAHAQLQRLNLELLRELLRALAQLQELNLDLLRLASELTDP[DEAR(*ENLYFQGS*)ESKRIVEDAERLIREAAA
ASEKISREAERLIR]

>1fix-short-TEV-t0_6
(SEQ ID NO: 71)
(MGSSHHHHHHSSGLVPRGSHM)SELARKLLEASTKLQRLNIRLAEALLEAIARLQELNLELVYLAVELTDPKRI
RDEIKEVKDKSKEIIRRAEKEIDDAAKESEKILEEAREAISGSGSELAKLLLKAIAETQDLNLRAAKAFLEAAAK
LQELNIRAVELLVKLTDPATIREALEHAKRRSKEIIDEAERAIRAAKRESERIIEEARRLIEKGSGSGSELAREL
LRAHAQLQRLNLELLRELLRALAQLQELNLDLLRLASELTDP[DEARKAIARVKRESKRIV(*ENLYFQGS*)EAAA
ASEKISREAERLIR]

>1fix-short-nanoBit-t0_1
(SEQ ID NO: 72)
(MGSSHHHHHHSSGLVPRGSHM)SELARKLLEASTKLQRLNIRLAEALLEAIARLQELNLELVYLAVELTDPKRI
RDEIKEVKDKSKEIIRRAEKEIDDAAKESEKILEEAREAISGSGSELAKLLLKAIAETQDLNLRAAKAFLEAAAK
LQELNIRAVELLVKLTDPATIREALEHAKRRSKEIIDEAERAIRAAKRESERIIEEARRLIEKGSGSGSELAREL

```
LRAHAQLQRLNLELLRELLRALAQLQELNLDLLRLASELTDP[DEAR(VSGWRLFKKIS)RIVEDAERLIREAAA

ASEKISREAERLIR]

>1fix-short-nanoBit-t0_3
                                                              (SEQ ID NO: 73)
(MGSSHHHHHHSSGLVPRGSHM)SELARKLLEASTKLQRLNIRLAEALLEAIARLQELNLELVYLAVELTDPKRI

RDEIKEVKDKSKEIIRRAEKEIDDAAKESEKILEEAREAISGSGSELAKLLLKAIAETQDLNLRAAKAFLEAAAK

LQELNIRAVELLVKLTDPATIREALEHAKRRSKEIIDEAERAIRAAKRESERIIEEARRLIEKGSGSGSELAREL

LRAHAQLQRLNLELLRELLRALAQLQELNLDLLRLASELTDP[DEARKAIARVKRESK(VSGWRLFRKIS)EAAA

ASEKISREAERLIR]

>1fix-short-RHIM-t0_8
                                                              (SEQ ID NO: 74)
(MGSSHHHHHHSSGLVPRGSHM)SELARKLLEASTKLQRLNIRLAEALLEAIARLQELNLELVYLAVELTDPKRI

RDEIKEVKDKSKEIIRRAEKEIDDAAKESEKILEEAREAISGSGSELAKLLLKAIAETQDLNLRAAKAFLEAAAK

LQELNIRAVELLVKLTDPATIREALEHAKRRSKEIIDEAERAIRAAKRESERIIEEARRLIEKGSGSGSELAREL

LRAHAQLQRLNLELLRELLRALAQLQELNLDLLRLASELTDP[DEARKAI(IQIG)RESKRIVEDAERLIREAAA

ASEKIS(VQLG)RLIR]

>1fix-short-RHIM-t0_19
                                                              (SEQ ID NO: 75)
(MGSSHHHHHHSSGLVPRGSHM)SELARKLLEASTKLQRLNIRLAEALLEAIARLQELNLELVYLAVELTDPKRI

RDEIKEVKDKSKEIIRRAEKEIDDAAKESEKILEEAREAISGSGSELAKLLLKAIAETQDLNLRAAKAFLEAAAK

LQELNIRAVELLVKLTDPATIREALEHAKRRSKEIIDEAERAIRAAKRESERIIEEARRLIEKGSGSGSELAREL

LRAHAQLQRLNLELLRELLRALAQLQELNLDLLRLASELTDP+DEARKAIARVKRESKRIV(IQIG)RLI(VQLG

)AASEKISREAERLIR

>1fix-short-RHIM-t0_22
                                                              (SEQ ID NO: 76)
(MGSSHHHHHHSSGLVPRGSHM)SELARKLLEASTKLQRLNIRLAEALLEAIARLQELNLELVYLAVELTDPKRI

RDEIKEVKDKSKEIIRRAEKEIDDAAKESEKILEEAREAISGSGSELAKLLLKAIAETQDLNLRAAKAFLEAAAK

LQELNIRAVELLVKLTDPATIREALEHAKRRSKEIIDEAERAIRAAKRESERIIEEARRLIEKGSGSGSELAREL

LRAHAQLQRLNLELLRELLRALAQLQELNLDLLRLASELTDP[DEARKAIARVKRESKRIV(IQIG)RLIREAAA

ASEKIS(VQLG)RLIR]

>1fix-short-gcn4-t0_4
                                                              (SEQ ID NO: 77)
(MGSSHHHHHHSSGLVPRGSHM)SELARKLLEASTKLQRLNIRLAEALLEAIARLQELNLELVYLAVELTDPKRI

RDEIKEVKDKSKEIIRRAEKEIDDAAKESEKILEEAREAISGSGSELAKLLLKAIAETQDLNLRAAKAFLEAAAK

LQELNIRAVELLVKLTDPATIREALEHAKRRSKEIIDEAERAIRAAKRESERIIEEARRLIEKGSGSGSELAREL

LRAHAQLQRLNLELLRELLRALAQLQELNLDLLRLASELTDP[DESVKE(LEDKVEELLSKNYHLENEVARLKKL

VGER)SREAERLIR]

>1fix-short-ccDi-t0_6
                                                              (SEQ ID NO: 78)
(MGSSHHHHHHSSGLVPRGSHM)SELARKLLEASTKLQRLNIRLAEALLEAIARLQELNLELVYLAVELTDPKRI

RDEIKEVKDKSKEIIRRAEKEIDDAAKESEKILEEAREAISGSGSELAKLLLKAIAETQDLNLRAAKAFLEAAAK

LQELNIRAVELLVKLTDPATIREALEHAKRRSKEIIDEAERAIRAAKRESERIIEEARRLIEKGSGSGSELAREL

LRAHAQLQRLNLELLRELLRALAQLQELNLDLLRLASELTDP[DEARKAIA(GEIAALKQEIAALKKENAALKWE

IAALKQG)AERLIR]

>1fix-short-cc-a-t0_6
                                                              (SEQ ID NO: 79)
(MGSSHHHHHHSSGLVPRGSHM)SELARKLLEASTKLQRLNIRLAEALLEAIARLQELNLELVYLAVELTDPKRI

RDEIKEVKDKSKEIIRRAEKEIDDAAKESEKILEEAREAISGSGSELAKLLLKAIAETQDLNLRAAKAFLEAAAK
```

-continued

LQELNIRAVELLVKLTDPATIREALEHAKRRSKEIIDEAERAIRAAKRESERIIEEARRLIEKGSGSGSELAREL
LRAHAQLQRLNLELLRELLRALAQLQELNLDLLRLASELTDP[DEARKAIARVKR(*GLEQEIAALEKENAALEWE
IAALEQGG*)ERLIR]

>1fix-short-cc-b-t0_6
(SEQ ID NO: 80)
(MGSSHHHHHHSSGLVPRGSHM)SELARKLLEASTKLQRLNIRLAEALLEAIARLQELNLELVYLAVELTDPKRI
RDEIKEVKDKSKEIIRRAEKEIDDAAKESEKILEEAREAISGSGSELAKLLLKAIAETQDLNLRAAKAFLEAAAK
LQELNIRAVELLVKLTDPATIREALEHAKRRSKEIIDEAERAIRAAKRESERIIEEARRLIEKGSGSGSELAREL
LRAHAQLQRLNLELLRELLRALAQLQELNLDLLRLASELTDP[DEARKAIARVKR(*GLKQKIAALKYKNAALKKK
IAALKQGG*)ERLIR]

STREPII-LOCKR functional Cages:
>STREPII-2plus1_LOCK_1
(SEQ ID NO: 81)
SRVEEIIEDLRRLLEEIRKENADSIRASKELLDRVKEINDTIIAELERLLKDIEKEVREKGSESEEVKKALRRVL
EELEKLLRRVAEINEEVLRRNSKLVEEDARRNAEVLKELKRLVEELMREIGDED[KVRKVAEVAEKVLRDIDKLD
R(*WSHPQFEK*)TNGEISKLDEDTRRVAERVKKAIEDLAK]

>STREPII-2plus1_LOCK_2
(SEQ ID NO: 82)
[SEVDEIIADNERALDEVRREVEEIDKENAERLGE(*WSHPQFEK*)GDRLAKALEEIRK]GVRSRLVDELERAIRE
VEEVIRRVLERVRRLIEEVSKIITDVLREVERLHEEVTKELRKVEDGNSREALDALRRLIEKVVEDSARLIKKVD
EALKAVNKEIEDLSREVADLVRAVAEELDARVK >STREPII-2plus1_LOCK3
(SEQ ID NO: 83)
SSDEVLKEIEEIIRRLEAEVRRVNAEVNASTEDLAREVEEVLRATNELIEELERRVTGTEELKRVIDELRDRDRK
VRRRVERVIEESAKRDDESRKRLTRAVEKLRADLKKLADDGVPE[EALSKAIKDVRDIVKKVKDELKE(*WSHPQF
EK*)VDRLSEELKEWLKDVERVLKELTDKDR]

>STREPII-2plus1_LOCK_4C
(SEQ ID NO: 84)
SDAEELLKRVADLLKASLESLEKILRDSKELMDRWRKKLEDLLRESEELVDRAEKILRRGGSDKEVLDKIAEEVR
RTNDDSRRLDEELHRLSRDTLRKLEENLRRTEKEVREMDKRAAERG[VDERVREELKKLLTRVE(*WSHPQFEK*)G
DKKILKEAHKESKEVNDRDRELLERLEESVR]

>STREPII-2plus1_LOCK_4N
(SEQ ID NO: 85)
[SDAEELLKRVADLLKASLESLEKILRDSKELMDR(*WSHPQFEK*)LGESEELVDRAEKILRR]GGSDKEVLDKIA
EEVRRTNDDSRRLDEELHRLSRDTLRKLEENLRRTEKEVREMDKRAAERGVDERVREELKKLLTRVEEEHRKVLE
TDKKILKEAHKESKEVNDRDRELLERLEESVR >STREPII-3plus1_LOCK_1
(SEQ ID NO: 86)
SEAEDLLERVKRVLDELIEIVDRNHELNARVVETSARLVERLLEEVERALETLEREIPGRELLDKAIKDLRDVLR
RVAEKVKRSIEELKEVLEESRRVLEEVVRALAEVIDRVRRLVEKGVDLRDLIRELKRVLEEAVSLIERLVRLNTR
AAEKDNESLRELVRAIKEALKRAVDMVRADGL[DSRLVKKLDEIVKEVAKKLEDVVRANEEL(*WSHPQFEK*)GSS
VARLREAVERVARDLEETAR]

>STREPII-3plus1_LOCK_2
(SEQ ID NO: 87)
[SDEERLEKVVKDVIEKVRRILEK(*WSHPQFEK*)GSELRRILEEWEKIIREVLDKVRR]GSGSADALVEVLEEIL
RLAEEELSKRVEEVLREILKLAKALSDELVKVLAEIVEAAKRISRDDELRKAVEDVARELEDLAAKDRKILDDVRE
ALERIAKEDKDILREAEETLRRLADEMRRSGVDERLLKRVVDILARLLELNATTIERLLRILEELLKLNKELAER
VIRVLEKLLEEIKR -continued >STREPII-3plus1_LOCK3
(SEQ ID NO: 88)
SVLETVKKALEDSSEKIERIVEEDERVAKESSDRIRRLVEEDKRVADEILDLIEKGGDTDTLAKLVEEWSRTSKK
LLDDVLKLHKDWSDDSRRLLEEILRVHEELIRAVKEILDRGGKPEEVVRELEKVLKESLDTLEEIIRRLDEANAR
TVKRVADVIRELEDANAKVLEEIERKGD[DKDAVIKVIEELIRANAAV(*WSHPQFEK*)GDLVRVNKTVWKELLRV
NEKLARDLERVVK]

>STREPII-3plus1_LOCK_4
(SEQ ID NO: 89)
[SLVDELRKSLERNVRVSEEVARRLKEALGR(*WSHPQFEK*)GGDLIRLNEDVVRVVEKV]GVDESAIERVRRIIE
ELNRALDAVLKKNEDLVRRLTELLDKLLEENRRLVEELDEDLKRRGGTEEVIDTILELIERSIERLKRLLDELLR
IVREALKDNARVADENLKALKEILDELRKDGVSDEELKRVLEKAADLHARLKDAHRKLLEDLERIIRELKKKLDE
VVEENKRSVDELKR >STREPII-3plus1_LOCK_3-relooped
(SEQ ID NO: 90)
[MKDAVIKVIEELIRANAAV(*WSHPQFEK*)GDLVRVNKTVWKELLRVNEKLARDLERAL]DERDVSAWETVKKAL
EDSSEKIERIVEEDERVAKESSDRIRRLVEEDKRVADEILDLIEKGGDTDTLAKLVEEWSRTSKKLLDDVLKLHK
DWSDDSRRLLEEILRVHEELIRAVKEILDRGGAPEEVVRELEKVLKESLDTLEEIIRRLDEANARTVKRVADVIR
ELEDANAKVLEEIERK >STREPII-2plus1_LOCK_3-relooped
(SEQ ID NO: 91)
[MEEAASKAIKDVRDIVKKVKDELKE(*WSHPQFEK*)VDRLSEELKEWLKDVERVLKELT]DREEASEEELKRVID
ELRDRDRKVRRRVERVIEESAKRDDESRKRLTRAVEKLRADLKKLSVEGASDEVLKEIEEIIRRLEAEVRRVNAE
VNASTEDLAREVEEVLRATNELIEELERR >BimLOCKR_a_short_Nterm
(SEQ ID NO: 27094)
[MDEARKAIARVKRESKRI(*EIWIAQELRRIGDEFNAYYA*)EAEKLATDEL]WHRLLEASTKLQRLNIRLAEALL
EAIARLQELNLELVYLAVELTDPKRIRDEIKEVKDKSKEIIRRAEKEIDDAAKESEKILEEAREAISGSGSELAK
LLLKAIAETQDLNLRAAKAFLEAAAKLQELNIRAVELLVKLTDPATIREALEHAKRRSKEIIDEAERAIRAAKRE
SERIIEEARRLIEKGSGSGSELARELLRAHAQLQRLNLELLRELLRALAQLQELNLDLLRLASE >BimLOCKR_g
(SEQ ID NO: 27095)
[MSLVDEL(*EIWIAQELRRIGDEFNAYYA*)ALKRWVDVVRKVVEDLIRLNEDVVRVVEKV]GVDESAIERVRRII
EELNRALDAVLKKNEDLVRRLTELLDKLLEENRRLVEELDEDLKRRGGTEEVIDTILELIERSIERLKRLLDELL
RIVREALKDNARVADENLKALKEILDELRKDGVSDEELKRVLEKAADLHARLKDAHRKLLEDLERIIRELKKKLD
EVVEENKRSVDELKR >reloop_strepLOCKRh
(SEQ ID NO: 27096)
[MKDAVIKVIEELIRANAAV(*WSHPQFEK*)GDLVRVNKTVWKELLRVNEKLARDLERALDER]DVSAWETVKKAL
EDSSEKIERIVEEDERVAKESSDRIRRLVEEDKRVADEILDLIEKGGDTDTLAKLVEEWSRTSKKLLDDVLKLHK
DWSDDSRRLLEEILRVHEELIRAVKEILDRGGAPEEVVRELEKVLKESLDTLEEIIRRLDEANARTVKRVADVIR
ELEDANAKVLEEIERK >reloop_strepLOCKRi
(SEQ ID NO: 27097)
[MEEAASKAIKDVRDIVKKVKDELKE(*WSHPQFEK*)VDRLSEELKEWLKDVERVLKELTDREEA]SEEELKRVID
ELRDRDRKVRRRVERVIEESAKRDDESRKRLTRAVEKLRADLKKLSVEGASDEVLKEIEEIIRRLEAEVRRVNAE
VNASTEDLAREVEEVLRATNELIEELERR >spyLOCKRa_2
(SEQ ID NO: 27098)
MSELARKLLEASTKLQRLNIRLAEALLEAIARLQELNLELVYLAVELTDPKRIRDEIKEVKDKSKEIIRRAEKEI
DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEAR(*AHIVMVDAYK*)KRIVEDAERLIREAAAASEKISREAERLIR]

>spyLOCKRa_8
(SEQ ID NO: 27099)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDPDEARKAIARVKRESK(*AHIVMVDAYK*)REAAAASEKISREAERLIR

>tevLOCKRa_1
(SEQ ID NO: 27100)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEAR(*ENLYFQGS*)ESKRIVEDAERLIREAAAASEKISREAERLIR]

>tevLOCKRa_6
(SEQ ID NO: 27101)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEARKAIARVKRESKRIV(*ENLYFQGS*)EAAAASEKISREAERLIR]

>lucLOCKRa_1
(SEQ ID NO: 27102)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEAR(*VSGWRLFRKIS*)RIVEDAERLIREAAAASEKISREAERLIR]

>lucLOCKRa_3
(SEQ ID NO: 27103)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEARKAIARVKRESK(*VSGWRLFKKIS*)EAAAASEKISREAERLIR]

>rhimLOCKRa_8
(SEQ ID NO: 27104)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEARKAI(*IQIG*)RESKRIVEDAERLIREAAAASEKIS(*VQLG*)RLIR]

>rhimLOCKRa_19
(SEQ ID NO: 27105)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEARKAIARVKRESKRIV(*IQIG*)RLI(*VQLG*)AASEKISREAERLIR]

>rhimLOCKRa_22
(SEQ ID NO: 27106)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

-continued

EALEHAKRRSKEIIDEAERAIRAAKRESERIIEEARRLIEKGSGSGSELARELLRAHAQLQRLNLELLRELLRAL

AQLQELNLDLLRLASELTDP[DEARKAIARVKRESKRIV(*IQIG*)RLIREAAAASEKIS(*VQLG*)RLIR]

>gcn4LOCKRa_4

(SEQ ID NO: 27107)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DESVKE(*LEDRVEELLSKNYHLENEVARLKKLVGER*)SREAERLIR]

>cc-DiLOCKRa_6

(SEQ ID NO: 27108)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

EALEHAKRRSKEIIDEAERAIRAAKRESERIIEEARRLIEKGSGSGSELARELLRAHAQLQRLNLELLRELLRAL

AQLQELNLDLLRLASELTDP[DEARKAIA(*GEIAALKQEIAALKKENAALKWEIAALKQG*)AERLIR]

>cc-aLOCKRa_6

(SEQ ID NO: 27109)
MSELARKLLEASTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

KALEHAKRRSKEIIDEAERAIRAAKRESERIIEEARRLIEKGSGSGSELARELLRAHAQLQRLNLELLRELLRAL

AQLQELNLDLLRLASELTDP[DEARKAIARVKR(*GLEQEIAALEKENAALEWEIAALEQGG*)ERLIR]

>cc-bLOCKRa_6

(SEQ ID NO: 27110)
MSELARKLLEATTKLQRLNIRLAEALLEAIARLQELNLELVYLAVELTDPKRIRDEIKEVKDKSKEIIRRAEKEI

DDAAKESEKILEEAREAISGSGSELAKLLLKAIAETQDLNLRAAKAFLEAAAKLQELNIRAVELLVKLTDPATIR

KALEHAKRRSKEIIDEAERAIRAAKRESERIIEEARRLIEKGSGSGSELARELLRAHAQLQRLNLELLRELLRAL

AQLQELNLDLLRLASELTDP[DEARKAIARVKR(*GLKQKIAALKYRNAALKKKIAALKQGG*)ERLIR]

>tev-spyLOCKRa_short_40

(SEQ ID NO: 27111)
SELARKLLEASTKLQRLNIRLAEALLEAIARLQELNLELVYLAVELTDPKRIRDEIKEVKDKSKEIIRRAEKEID

DAAKESEKILEEAREAISGSGSELAKLLLKAIAETQDLNLRAAKAFLEAAAKLQELNIRAVELLVKLTDPATIRE

ALEHAKRRSKEIIDEAERAIRAAKRESERIIEEARRLIEKGSGSGSELARELLRAHAQLQRLNLELLRELLRALA

QLQELNLDLLRLASELTDP[DEARKAI(*ENLYFQGS*)RIVEDAE(*AHIVMVDAYK*)EKISREAERLIR]

>tev-spyLOCKRa_short_57

(SEQ ID NO: 27112)
SELARKLLEASTKLQRLNIRLAEALLEAIARLQELNLELVYLAVELTDPKRIRDEIKEVKDKSKEIIRRAEKEID

DAAKESEKILEEAREAISGSGSELAKLLLKAIAETQDLNLRAAKAFLEAAAKLQELNIRAVELLVKLTDPATIRE

ALEHAKRRSKEIIDEAERAIRAAKRESERIIEEARRLIEKGSGSGSELARELLRAHAQLQRLNLELLRELLRALA

QLQELNLDLLRLASELTDP[DEARKAIARV(*ENLYFQGS*)EDAERLIREA(*AHIVMVDAYK*)AERLIR]

>tev-spyLOCKRa_short_63

(SEQ ID NO: 27113)
SELARKLLEASTKLQRLNIRLAEALLEAIARLQELNLELVYLAVELTDPKRIRDEIKEVKDKSKEIIRRAEKEID

DAAKESEKILEEAREAISGSGSELAKLLLKAIAETQDLNLRAAKAFLEAAAKLQELNIRAVELLVKLTDPATIRE

ALEHAKRRSKEIIDEAERAIRAAKRESERIIEEARRLIEKGSGSGSELARELLRAHAQLQRLNLELLRELLRALA

QLQELNLDLLRLASELTDP[DEARKAIARVK(*ENLYFQGS*)DAERLIREA(*AHIVMVDAYK*)AERLIR]

>tev-spyLOCKRa_29

(SEQ ID NO: 27114)
SKEAAKKLQDLNIELARKLLEASTKLQRLNIRLAEALLEAIARLQELNLELVYLAVELTDPKRIRDEIKEVKDKS

KEIIRRAEKEIDDAAKESKKILEEARKAIRDAAEESRKILEEGSGSGSDALDELQKLNLELAKLLLKAIAETQDL

NLRAAKAFLEAAAKLQELNIRAVELLVKLTDPATIRRALEHAKRRSKEIIDEAERAIRAAKRESERIIEEARRLI

-continued

EKAKEESERIIREGSGSGDP[DIKKLQDLNIELARELLRAHAQLQRLNLELLRELLRALAQLQELNLDLLRLASE
LTDPDEARKAIARVK(_ENLYFQGS_)DAERLIREAAAASE(_AHIVMVDAYK_)REAAAASEKISRE]

>tev-spyLOCKRa_32
(SEQ ID NO: 27115)
SKEAAKKLQDLNIELARKLLEASTKLQRLNIRLAEALLEAIARLQELNLELVYLAVELTDPKRIRDEIKEVKDKS
KEIIRRAEKEIDDAAKESKKILEEARKAIRDAAEESRKILEEGSGSGSDALDELQKLNLELAKLLLKAIAETQDL
NLRAAKAFLEAAAKLQELNIRAVELLVKLTDPATIRRALEHAKRRSKEIIDEAERAIRAAKRESERIIEEARRLI
EKAKEESERIIREGSGSGDP[DIKKLQDLNIELARELLRAHAQLQRLNLELLRELLRALAQLQELNLDLLRLASE
LTDPDEARKAIARVK(_ENLYFQGS_)DAERLIREAAAASEKISREAE(_AHIVMVDAYK_)EKISRE]

>Bim-fretLOCKRa_short
(SEQ ID NO: 27116)
(**VSKGEELFTGVVPIEVELDGDVNGHKFSVSGEGEGDATYGKLTLKFICTTGKLPVPWPTLVTTLSWGVQCFARY
PDHMKQHDFFKSAMPEGYVQERTIFFKDDGNYKTRAEVKFEGDTLVNRIELKGIDFKEDGNILGHKLEYNYFSDN
VYITADEQKNGIKANFKIRHNIEDGGVQLADHYQQNTPIGDGPVLLPDNHYLSTQSKLSKDPNEKRDHMVLLEFV
TAAGITLE**)LARKLLEASTKLQRLNIRLAEALLEAIARLQELNLELVYLAVELTDPKRIRDEIKEVKDKSKEIIR
RAEKEIDDAAKESEKILEEAREAISGSGSELAKLLLKAIAETQDLNLRAAKAFLEAAAKLQELNIRAVELLVKLT
DPATIREALEHAKRRSKEIIDEAERAIRAAKRESERIIEEARRLIEKGSGSGSELARELLRAHAQLQRLNLELLR
ELLRALAQLQELNLDLLRLASELT[D(_EIWIAQELRRIGDEFNAYYA_)DAERLIREAAAASEKISREAERLIR](
**VSKGEELFTGVVPILVELDGDVNGHKFSVSGEGEGDATYGKLTLKLICTTGKLPVPWPTLVTTLGYGVQCFARYP
DHMKQHDFFKSAMPEGYVQERTIFFKDDGNYKTRAEVKFEGDTLVNRIELKGIDFKEDGNILGHKLEYNYNSHNV
YITADKQKNGIKANFKIRHNIEDGGVQLADHYQQNTPIGDGPVLLPDNHYLSYQSKLSKDPNEKRDHMVLLEFVT
AAGITLGMDELYKGSGC**)

>fretLOCKRa_short
(SEQ ID NO: 27117)
(**VSKGEELFTGVVPILVELDGDVNGHKFSVSGEGEGDATYGKLTLKFICTTGKLPVPWPTLVTTLSWGVQCFARY
PDHMKQHDFFKSAMPEGYVQERTIFFKDDGNYKTRAEVKFEGDTLVNRIELKGIDFKEDGNILGHKLEYNYFSDN
VYITADKQKNGIKANFKIRHNIEDGGVQLADHYQQNTPIGDGPVLLPDNHYLSTQSKLSKDPNEKRDHMVLLEFV
TAAGITL**)ELARKLLEASTKLQRLNIRLAEALLEAIARLQELNLELVYLAVELTDPKRIRDEIKEVKDKSKEIIR
RAEKEIDDAAKESEKILEEAREAISGSGSELAKLLLKAIAETQDLNLRAAKAFLEAAAKLQELNIRAVELLVKLT
DPATIREALEHAKRRSKEIIDEAERAIRAAKRESERIIEEARRLIEKGSGSGSELARELLRAHAQLQRLNLELLR
ELLRALAQLQELNLDLLRLASELTDP[DEARKAIARVKRESNAYYADAERLIREAAAASEK](**VSKGEELFTGVV
PILVELDGDVNGHKFSVSGEGEGDATYGKLTLKLICTTGKLPVPWPTLVTTLGYGVQCFARYPDHMKQHDFFKSA
MPEGYVQERTIFFKDDGNYKTRAEVKFEGDTLVNRIELKGIDFKEDGNILGHKLEYNYNSHNVYITADKQKNGIK
ANFKIRHNIEDGGVQLADHYQQNTPIGDGPVLLPDNHYLSYQSKLSKDPNEKRDHMVLLEFVTAAGITLGMDELY
KGSGC**)

E18_KRAB_full
(SEQ ID NO: 27120)
MSKEAVTKLQALNIKLAEKLLEAVTKLQALNIKLAEKLLEALARLQELNIALVYLAVELTDPKRIADEIKKVKDK
SKEIVERAEEEIARAAAESKKILDEAEEEIARAAAESKKILDEGSGSGSDAVAELQALNLKLAELLLEAVAELQA
LNLKLAELLLEAIAKLQELNIKLVELLTKLTDPATIREAIRKVKEDSERIVAEAERLIAAAKAESERIIREAERL
IAAAKAESERIIREGSGSGDPDVARLQELNIELARELLRDVARLQELNIELARELLRAAAELQELNIKLVELASE
LTGS[(_RTLVTFKDVFVDFTREEWKLLDTAQQIVYRNVMLENYRNLVSLGYG_)SDEARKAIARVKRESKRIVEDA
ERLIREAAAASEKISREAERLIREAAAASEKISRE]

E18_KRAB_N13t (SEQ ID NO: 27121)

MSKEAVTKLQALNIKLAEKLLEAVTKLQALNIKLAEKLLEALARLQELNIALVYLAVELTDPKRIADEIKKVKDK
SKEIVERAEEEIARAAAESKKILDEAEEEIARAAAESKKILDEGSGSGSDAVAELQALNLKLAELLLEAVAELQA
LNLKLAELLLEAIAKLQELNIKLVELLTKLTDPATIREAIRKVKEDSERIVAEAERLIAAAKAESERIIREAERL
IAAAKAESERIIREGSGSGDPDVARLQELNIELARELLRDVARLQELNIELARELLRAAAELQELNIKLVELASE
LTGS[(*RTLVTFKDVFVDFTREEWKLLDTAQQIVYRNVMLENYRNLVSLGY*)GSSKRIVEDAERLIREAA+\ASEK
ISREAERLIREAAAASEKISRE]

E18_KRAB_C9t (SEQ ID NO: 27122)

MSKEAVTKLQALNIKLAEKLLEAVTKLQALNIKLAEKLLEALARLQELNIALVYLAVELTDPKRIADEIKKVKDK
SKEIVERAEEEIARAAAESKKILDEAEEEIARAAAESKKILDEGSGSGSDAVAELQALNLKLAELLLEAVAELQA
LNLKLAELLLEAIAKLQELNIKLVELLTKLTDPATIREAIRKVKEDSERIVAEAERLIAAAKAESERIIREAERL
IAAAKAESERIIREGSGSGDPDVARLQELNIELARELLRDVARLQELNIELARELLRAAAELQELNIKLVELASE
LTGS[(*RTLVTFKDVFVDFTREEWKLLDTAQQIVYRNVMLENYRNLVSLGY*)GSDEARKAIARVKRESKRIVEDA
ERLIREAAAASEKISREAERLIREAA]

E18_KRAB_Cterm1

(SEQ ID NO: 27123)

MSKEAVTKLQALNIKLAEKLLEAVTKLQALNIKLAEKLLEALARLQELNIALVYLAVELTDPKRIADEIKKVKDK
SKEIVERAEEEIARAAAESKKILDEAEEEIARAAAESKKILDEGSGSGSDAVAELQALNLKLAELLLEAVAELQA
LNLKLAELLLEAIAKLQELNIKLVELLTKLTDPATIREAIRKVKEDSERIVAEAERLIAAAKAESERIIREAERL
IAAAKAESERIIREGSGSGDPDVARLQELNIELARELLRDVARLQELNIELARELLRAAAELQELNIKLVELASE
LT[DEARKAIARVKRESKRIVEDAE(*RTLVTFKDVFVDFTREEWKLLDTAQQIVYRNVMLENYKNLVSLGY*)]

E18_KRAB_Cterm2

(SEQ ID NO: 27124)

MSKEAVTKLQALNIKLAEKLLEAVTKLQALNIKLAEKLLEALARLQELNIALVYLAVELTDPKRIADEIKKVKDK
SKEIVERAEEEIARAAAESKKILDEAEEEIARAAAESKKILDEGSGSGSDAVAELQALNLKLAELLLEAVAELQA
LNLKLAELLLEAIAKLQELNIKLVELLTKLTDPATIREAIRKVKEDSERIVAEAERLIAAAKAESERIIREAERL
IAAAKAESERIIREGSGSGDPDVARLQELNIELARELLRDVARLQELNIELARELLRAAAELQELNIKLVELASE
LT[DEARKAIARVKRESKRIVEDAERLI(*RTLVTFKDVFVDFTREEWKLLDTAQQIVYRNVMLENYRNLVSLGY*)]

E18_KRAB_Cterm3

(SEQ ID NO: 27125)

MSKEAVTKLQALNIKLAEKLLEAVTKLQALNIKLAEKLLEALARLQELNIALVYLAVELTDPKRIADEIKKVKDK
SKEIVERAEEEIARAAAESKKILDEAEEEIARAAAESKKILDEGSGSGSDAVAELQALNLKLAELLLEAVAELQA
LNLKLAELLLEAIAKLQELNIKLVELLTKLTDPATIREAIRKVKEDSERIVAEAERLIAAAKAESERIIREAERL
IAAAKAESERIIREGSGSGDPDVARLQELNIELARELLRDVARLQELNIELARELLRAAAELQELNIKLVELASE
LT[DEARKAIARVKRESKRIVEDAERLIREAAAASEKI*SRTLVTFKDVFVDFTREEWKLLDTAQQIVYRNVMLEN
YRNLVSLGY*)]

>3plus1_Cage_Nterm_GFP11_668

(SEQ ID NO: 27,278)

DEAKELLDEIRKAVKESEDRLEKLLRDYEKELRRDHMVLHEYVNAAGITLEELRRGSLDAKELLKTLEDLLREVL
EVARRVVETLKELNRRVLEVVREDIEANERLLRRVLDTLRRGGVDERRIKDLERLIRESLKKAEEVLREAAEKSR
EIVDEIREVLKRADEALKRIIKKIRETRGADALSRLLEELLRVVDDLIRVLKELIDKSRKVIEELLELLKRINEE
NLKVLAEIIK

>3plus1_Cage_Cterm_GFP11_668

(SEQ ID NO: 27,279)

DEAKELLDEIRKAVKESEDRLEKLLRDYEKELRRLEKELRDLKRRIEEKLEELRRGSLDAKELLKTLEDLLREVL
EVARRVVETLKELNRRVLEVVREDIERNERLLRRVLDTLRRGGVDERRIKDLERLIRESLKKAEEVLREAAEKSR

```
EIVDEIREVLKRADEALKRIIKKIRETRGADADHMVLHEYVNAAGITIRVLKELIDKSRKVIEELLELLKRINEE
NLKVLAEIIK

>3plus1_Cage_Cterm_GFP11_668
                                                          (SEQ ID NO: 27,280)
DEAKELLDEIRKAVKESEDRLEKLLRDYEKELRRLEKELRDLKRRIEEKLEELRRGSLDAKELLKTLEDLLREVL
EVARRVVETLKELNRRVLEVVREDIERNERLLRRVLDTLRRGGVDERRIKDLERLIRESLKKAEEVLREAAEKSR
EIVDEIREVLKRADEALKRIIKKIRETRGADARDHMVLHEYVNAAGITRVLKELIDKSRKVIEELLELLKRINEE
NLKVLAEIIK >3plus1_Cage_Cterm_GFP11_668
                                                          (SEQ ID NO: 27,281)
DEAKELLDEIRKAVKESEDRLEKLLRDYEKELRRLEKELRDLKRRIEEKLEELRRGSLDAKELLKTLEDLLREVL
EVARRVVETLKELNRRVLEVVREDIERNERLLRRVLDTLRRGGVDERRIKDLERLIRESLKKAEEVLREAAEKSR
EIVDEIREVLKRADEALKRIIKKIRETRGADALSRDHMVLHEYVNAAGITLKELIDKSRKVIEELLELLKRINEE
NLKVLAEIIK >3plus1_Cage_Cterm_GFP11_668
                                                          (SEQ ID NO: 27,282)
DEAKELLDEIRKAVKESEDRLEKLLRDYEKELRRLEKELRDLKRRIEEKLEELRRGSLDAKELLKTLEDLLREVL
EVARRVVETLKELNRRVLEVVREDIERNERLLRRVLDTLRRGGVDERRIKDLERLIRESLKKAEEVLREAAEKSR
EIVDEIREVLKRADEALKRIIKKIRDHMVLHEYVNAAGITLRVVDDLIRVLKELIDKSRKVIEELLELLKRINEE
NLKVLAEIIK >3plus1_Cage_Nterm_GFP11_669
                                                          (SEQ ID NO: 27,283)
SEKEKLLKESEEEVRRLRRTLEELLRKYREVLERLRDHMVLHEYVNAAGITIRLKEVLDRSGLDIDTIIKEVEDLL
KTVLDRLRELLDKIARLTKEAIEVVREIIERIVRHAERVKDELRKGGADKRKLDRVDRLIKENTRHLKEILDRIE
DLVRRSEKKLRDIIREVRRLIEELRKKAEEIKKDPDERLVKTLIEDVERVIKRILELITRVAEDNERVLERIIRE
LTDNLERHLKIVREIVK >3plus1_Cage_Nterm_GFP11_670
                                                          (SEQ ID NO: 27,284)
SEKEDLARKLRKLVEELTREYEELVKKLERLIEEIERDHMVLHEYVNAAGITISEEVRKLGTDERVLKRLLERLR
RIIEEDHELNTELLKRLLDLLKEILDTSRELLKRLLDILRKGVRDEEVLRDLERTLREVLEENERAIEEAERVLR
KVLEDSERAVRDARRVLAEVDKSPTGDEALRKLVELLVEVLRRLIRVNRELVKLLREVLERLLRILRESVKKLKR
LIEKVIKDAT >3plus1_Cage_Cterm_GFP11_670
                                                          (SEQ ID NO: 27,285)
SEKEDLARKLRKLVEELTREYEELVKKLERLIEEIEKVSEESVRKLEKLLREISEEVRKLGTDERVLKRLLERLR
RIIEEDHELNTELLKRLLDLLKEILDTSRELLKRLLDILRKGVRDEEVLRDLERTLREVLEENERAIEEAERVLR
KVLEDSERAVRDARRVLAEVDKSPTGDEARDHMVLHEYVNAAGITRVNRELVKLLREVLERLLRILRESVKKLKR
LIEKVIKDAT >3plus1_Cage_Cterm_GFP11_670
                                                          (SEQ ID NO: 27,286)
SEKEDLARKLRKLVEELTREYEELVKKLERLIEEIEKVSEESVRKLEKLLREISEEVRKLGTDERVLKRLLERLR
RIIEEDHELNTELLKRLLDLLKEILDTSRELLKRLLDILRKGVRDEEVLRDLERTLREVLEENERAIEEAERVLR
KVLEDSERAVRDARRVLAEVDKSPTGDERDHMVLHEYVNAAGITIRVNRELVKLLREVLERLLRILRESVKKLKR
LIEKVIKDAT >3plus1_Cage_Cterm_GFP11_670
                                                          (SEQ ID NO: 27,287)
SEKEDLARKLRKLVEELTREYEELVKKLERLIEEIEKVSEESVRKLEKLLREISEEVRKLGTDERVLKRLLERLR
RIIEEDHELNTELLKRLLDLLKEILDTSRELLKRLLDILRKGVRDEEVLRDLERTLREVLEENERAIEEAERVLR
```

-continued

KVLEDSERAVRDARRVLAEVDKSPTGRDHMVLHEYVNAAGITRLIRVNRELVKLLREVLERLLRILRESVKKLKR

LIEKVIKDAT

>3plus1_Cage_Nterm_GFP11_670

(SEQ ID NO: 27,288)

SEKEDLARKLRKLVEELTREYEELVKKLERLIEEIRDHMVLHEYVNAAGITEISEEVRKLGTDERVLKRLLERLR

RIIEEDHELNTELLKRLLDLLKEILDTSRELLKRLLDILRKGVRDEEVLRDLERTLREVLEENERAIEEAERVLR

KVLEDSERAVRDARRVLAEVDKSPTGDEALRKLVELLVEVLRRLIRVNRELVKLLREVLERLLRILRESVKKLKR

LIEKVIKDAT

>3plus1_Cage_Cterm_GFP11_670

(SEQ ID NO: 27,289)

SEKEDLARKLRKLVEELTREYEELVKKLERLIEEIEKVSEESVRKLEKLLREISEEVRKLGTDERVLKRLLERLR

RIIEEDHELNTELLKRLLDLLKEILDTSRELLKRLLDILRKGVRDEEVLRDLERTLREVLEENERAIEEAERVLR

KVLEDSERAVRDARRVLAEVDKSPTRDHMVLHEYVNAAGITRRLIRVNRELVKLLREVLERLLRILRESVKKLKR

LIEKVIKDAT

>3plus1_Cage_Nterm_GFP11_670

(SEQ ID NO: 27,290)

SEKEDLARKLRKLVEELTREYEELVKKLERLIERDHMVLHEYVNAAGITLREISEEVRKLGTDERVLKRLLERLR

RIIEEDHELNTELLKRLLDLLKEILDTSRELLKRLLDILRKGVRDEEVLRDLERTLREVLEENERAIEEAERVLR

KVLEDSERAVRDARRVLAEVDKSPTGDEALRKLVELLVEVLRRLIRVNRELVKLLREVLERLLRILRESVKKLKR

LIEKVIKDAT

>3plus1_Cage_Nterm_GFP11_670

(SEQ ID NO: 27,291)

SEKEDLARKLRKLVEELTREYEELVKKLERLIEEIEKRDHMVLHEYVNAAGITSEEVRKLGTDERVLKRLLERLR

RIIEEDHELNTELLKRLLDLLKEILDTSRELLKRLLDILRKGVRDEEVLRDLERTLREVLEENERAIEEAERVLR

KVLEDSERAVRDARRVLAEVDKSPTGDEALRKLVELLVEVLRRLIRVNRELVKLLREVLERLLRILRESVKKLKR

LIEKVIKDAT

>3plus1_Cage_Nterm_GFP11_670

(SEQ ID NO: 27,292)

SEKEDLARKLRKLVEELTREYEELVKKLERLIEEIEKVSEESRDHMVLHEYVNAAGITKLGTDERVLKRLLERLR

RIIEEDHELNTELLKRLLDLLKEILDTSRELLKRLLDILRKGVRDEEVLRDLERTLREVLEENERAIEEAERVLR

KVLEDSERAVRDARRVLAEVDKSPTGDEALRKLVELLVEVLRRLIRVNRELVKLLREVLERLLRILRESVKKLKR

LIEKVIKDAT

>3plus1_Cage_Nterm_GFP11_670

(SEQ ID NO: 27,293)

SEKEDLARKLRKLVEELTREYEELVKKLERLIEEIEKVSEESVRDHMVLHEYVNAAGITLGTDERVLKRLLERLR

RIIEEDHELNTELLKRLLDLLKEILDTSRELLKRLLDILRKGVRDEEVLRDLERTLREVLEENERAIEEAERVLR

KVLEDSERAVRDARRVLAEVDKSPTGDEALRKLVELLVEVLRRLIRVNRELVKLLREVLERLLRILRESVKKLKR

LIEKVIKDAT

>3plus1_Cage_Cterm_GFP11_671

(SEQ ID NO: 27,294)

SEEEDLLERVKRVLDELIEIVDRNHELNRRVVETSAALVERLLEEVERALETLEREIPGSSLLDKAIKDLRDVLR

RVKEKVKRSIEELKEVLEESRRVLEEVVRKLREVIDRVRRLVEKGVDLRDLIRELKRVLEEAVKLIERLVRLNTR

AAEKDNESLRELVRAIKEALKRAVDAVRKGGLDSRAVKKLDRDHMVLHEYVNAAGITNEELWRALVELNKESVRR

LREIVERVARDLEETAR

>3plus1_Cage_Cterm_GFP11_671

(SEQ ID NO: 27,295)

SEEEDLLERVKRVLDELIEIVDRNHELNRRVVETSAALVERLLEEVERALETLEREIPGSSLLDKAIKDLRDVLR

RVKEKVKRSIEELKEVLEESRRVLEEVVRKLREVIDRVRRLVEKGVDLRDLIRELKRVLEEAVKLIERLVRLNTR

```
AAEKDNESLRELVRAIKEALKRAVDAVRKGGLDSRARDHMVLHEYVNAAGITDVVRRNEELWRALVELNKESVRR

LREIVERVARDLEETAR

>3plus1_Cage_Cterm_GFP11_671
                                                              (SEQ ID NO: 27,296)
SEEEDLLERVKRVLDELIEIVDRNHELNRRVVETSAALVERLLEEVERALETLEREIPGSSLLDKAIKDLRDVLR

RVKEKVKRSIEELKEVLEESRRVLEEVVRKLREVIDRVRRLVEKGVDLRDLIRELKRVLEEAVKLIERLVRLNTR

AAEKDNESLRELVRAIKEALKRAVDAVRKGGLDSRRDHMVLHEYVNAAGITEDVVRRNEELWRALVELNKESVRR

LREIVERVARDLEETAR

>3plus1_Cage_Cterm_GFP11_671
                                                              (SEQ ID NO: 27,297)
SEEEDLLERVKRVLDELIEIVDRNHELNRRVVETSAALVERLLEEVERALETLEREIPGSSLLDKAIKDLRDVLR

RVKEKVKRSIEELKEVLEESRRVLEEVVRKLREVIDRVRRLVEKGVDLRDLIRELKRVLEEAVKLIERLVRLNTR

AAEKDNESLRELVRAIKEALKRAVDAVRKGGLRDHMVLHEYVNAAGITKKLEDVVRRNEELWRALVELNKESVRR

LREIVERVARDLEETAR

>3plus1_Cage_Cterm_GFP11_672
                                                              (SEQ ID NO: 27,298)
DETEEVIKKIAKLIDELIETLKKIVEDSAKLIKELIDLLEEIIKRSADLIRELEKVSKRGDRDRLKKLIDRMRRE

TERALEELRRVIEELKEATERALKTIEDLIREIEEAIRRELGDEDLAREILEVIRRILELLREDMELNLRALEEI

LRLLEEVIKLNKDAIDEILELLKRDHMVLHEYVNAAGITESKKLVRDVVEEAKRLLKENRDSTRKIIEDIRRLLR

KIEDSTR

>3plus1_Cage_Cterm_GFP11_672
                                                              (SEQ ID NO: 27,299)
DETEEVIKKIAKLIDELIETLKKIVEDSAKLIKELIDLLEEIIKRSADLIRELEKVSKRGDRDRLKKLIDRMRRE

TERALEELRRVIEELKEATERALKTIEDLIREIEEAIRRELGDEDLAREILEVIRRILELLREDMELNLRALEEI

LRLLEEVIKLNKDAIDEILELLKGRDHMVLHEYVNAAGITSKKLVRDVVEEAKRLLKENRDSTRKIIEDIRRLLR

KIEDSTR

>3plus1_Cage_Nterm_GFP11_67>3
                                                              (SEQ ID NO: 27,300)
SKEETLRKEAEDLLRRLEELTRRLEKKARELLERAKKLSRDLARDHMVLHEYVNAAGITEELIKVLEEVAKTSID

LNKEVIDVIRRVIEESLELNKRVLDVLRRVLDIAARKGRDKKAIRDVVREAARVIKEVIDEDEKVNRDLKRVIER

VIDDDRKALERLRKAVEEVASRGDDEAAKRLVEELLKAVTDLSRKNKRILEELLKAIETLSDENKKILTEILDAL

RRLVEKIEK

>3plus1_Cage_Nterm_GFP11_67>3
                                                              (SEQ ID NO: 27,301)
SKEETLRKEAEDLLRRLEELTRRLEKKARELLERAKKLSRRDHMVLHEYVNAAGITGVPEELIKVLEEVAKTSID

LNKEVIDVIRRVIEESLELNKRVLDVLRRVLDIAARKGRDKKAIRDVVREAARVIKEVIDEDEKVNRDLKRVIER

VIDDDRKALERLRKAVEEVASRGDDEAAKRLVEELLKAVTDLSRKNKRILEELLKAIETLSDENKKILTEILDAL

RRLVEKIEK

>3plus1_Cage_Cterm_GFP11_67>3
                                                              (SEQ ID NO: 27,302)
SKEETLRKEAEDLLRRLEELTRRLEKKARELLERAKKLSRDLAEELKRLLKELREKGVPEELIKVLEEVAKTSID

LNKEVIDVIRRVIEESLELNKRVLDVLRRVLDIAARKGRDKKAIRDVVREAARVIKEVIDEDEKVNRDLKRVIER

VIDDDRKALERLRKAVEEVASRGDDEARDHMVLHEYVNAAGITRKNKRILEELLKAIETLSDENKKILTEILDAL

RRLVEKIEK

>3plus1_Cage_Nterm_GFP11_67>3
                                                              (SEQ ID NO: 27,303)
SKEETLRKEAEDLLRRLEELTRRLEKKARELLERARDHMVLHEYVNAAGITELREKGVPEELIKVLEEVAKTSID

LNKEVIDVIRRVIEESLELNKRVLDVLRRVLDIAARKGRDKKAIRDVVREAARVIKEVIDEDEKVNRDLKRVIER
```

```
VIDDDRKALERLRKAVEEVASRGDDEAAKRLVEELLKAVTDLSRKNKRILEELLKAIETLSDENKKILTEILDAL

RRLVEKIEK

>3plus1_Cage_Nterm_GFP11_67>3
                                                       (SEQ ID NO: 27,304)
SKEETLRKEAEDLLRRLEELTRRLEKKARELLERAKKLSRDHMVLHEYVNAAGITKGVPEELIKVLEEVAKTSID

LNKEVIDVIRRVIEESLELNKRVLDVLRRVLDIAARKGRDKKAIRDVVREAARVIKEVIDEDEKVNRDLKRVIER

VIDDDRKALERLRKAVEEVASRGDDEAAKRLVEELLKAVTDLSRKNKRILEELLKAIETLSDENKKILTEILDAL

RRLVEKIEK

>3plus1_Cage_Nterm_GFP11_67>3
                                                       (SEQ ID NO: 27,305)
SKEETLRKEAEDLLRRLEELTRRLEKKARELLERAKKLRDHMVLHEYVNAAGITEKGVPEELIKVLEEVAKTSID

LNKEVIDVIRRVIEESLELNKRVLDVLRRVLDIAARKGRDKKAIRDVVREAARVIKEVIDEDEKVNRDLKRVIER

VIDDDRKALERLRKAVEEVASRGDDEAAKRLVEELLKAVTDLSRKNKRILEELLKAIETLSDENKKILTEILDAL

RRLVEKIEK

>3plus1_Cage_Nterm_GFP11_67>3
                                                       (SEQ ID NO: 27,306)
SKEETLRKEAEDLLRRLEELTRRLEKKARELLERAKKLSRDLRDHMVLHEYVNAAGITPEELIKVLEEVAKTSID

LNKEVIDVIRRVIEESLELNKRVLDVLRRVLDIAARKGRDKKAIRDVVREAARVIKEVIDEDEKVNRDLKRVIER

VIDDDRKALERLRKAVEEVASRGDDEAAKRLVEELLKAVTDLSRKNKRILEELLKAIETLSDENKKILTEILDAL

RRLVEKIEK

>3plus1_Cage_Nterm_GFP11_674
                                                       (SEQ ID NO: 27,307)
SEREEVKEKLDRLLEEVEKTVRELKREHDELLKEVEKLVRDLKRDHMVLHEYVNAAGITKEILDVIREHVRTNKE

ILDRVLEVVEEHLRRNKEILDKLLDDIRKVVEDAKRILGIGDDETLRRAVRRILEELRKLVEDIRKKVKDSLETL

ERALEEAEERIRRSLEDLKRVLKEAKDKTKDKDRLDKVEELVKKLLEDTKRTVDRVRELVRKILKKSRETLEELE

RLIEKILRELEKDAR

>3plus1_Cage_Cterm_GFP11_674
                                                       (SEQ ID NO: 27,308)
SEREEVKEKLDRLLEEVEKTVRELKREHDELLKEVEKLVRDLKKEHDELLKKVKDDGVPKEILDVIREHVRTNKE

ILDRVLEVVEEHLRRNKEILDKLLDDIRKVVEDAKRILGIGDDETLRRAVRRILEELRKLVEDIRKKVKDSLETL

ERALEEAEERIRRSLEDLKRVLKEAKDKTKDKDRDHMVLHEYVNAAGITKRTVDRVRELVRKILKKSRETLEELE

RLIEKILRELEKDAR

>3plus1_Cage_Nterm_GFP11_675
                                                       (SEQ ID NO: 27,309)
SERETVKRRLEELLKEVKRTLDKLKEEHDRLLEDVRRVVEELRDHMVLHEYVNAAGITPEELLRVIAKVLETNKR

ILDDLLRVVKKHVDLNKEILDRILEMIKEIVERVKRVLGDGDEKTLRDKIRDIIRRLEDAAREAEERVRRSLEEL

KKAVEKIRKKIEDSLRELEEALKRVRDKEEDDKRLEDISRLVKRLLDESRRVLRELEETIRKRAEESKRVLEEVK

RLVEKLIRELRKEAE

>3plus1_Cage_Nterm_GFP11_676
                                                       (SEQ ID NO: 27,310)
SEDEIIKKIIEDLRRVLKEVEEIHKEVEERLDKRDHMVLHEYVNAAGITDRVLDEVKRIGDVETVLRLAIEAVRR

ALEIVRKVTEDLIRVVRKLLEIVDAVNKRVKKAVEDVLKLLRDTLKGSKDVERVLDEARRLLEKLHRDSRRILKR

IAELLDELKELSERILERIKRLLEEVERRGSDDERLLEELIEELKDLIRRHIELLRRLIERLKELLKKHIEDLRR

LLEEIEKLLEEARK

>3plus1_Cage_Nterm_GFP11_677
                                                       (SEQ ID NO: 27,311)
SREEVLRELEEVIEDNRRLLEELIEKSKKVLDESLKLIDELLRRDHMVLHEYVNAAGITSKGDDEETARRIVTKI

RKELEDVLDEVRRIVKEILDRDRRVAEDLKRVVDENLEKLKKVLDELDKKLGDRRLVEILRDIVRLLIEINERAL
```

-continued

RELLKLHEEHTRIVAELLRELERVVEELRRLVELIARGEISEDDLKRVVDEVEKKLRELKRRYKEALERIKEKIK

ELKDRYERAVREVVAELRKTTK

>3plus1_Cage_Cterm_GFP11_677
(SEQ ID NO: 27,312)
SREEVLRELEEVIEDNRRLLEELIEKSKKVLDESLKLIDELLRRLEEVLERVLRLLEELSKGDDEETARRIVTKI

RKELEDVLDEVRRIVKEILDRDRRVAEDLKRVVDENLEKLKKVLDELDKKLGDRRLVEILRDIVRLLIEINERAL

RELLKLHEEHTRIVAELLRELERVVEELRRLVELIARGEISEDDRDHMVLHEYVNAAGITRRYKEALERIKEKIK

ELKDRYERAVREVVAELRKTTK

>3plus1_Cage_Cterm_GFP11_677
(SEQ ID NO: 27,313)
SREEVLRELEEVIEDNRRLLEELIEKSKKVLDESLKLIDELLRRLEEVLERVLRLLEELSKGDDEETARRIVTKI

RKELEDVLDEVRRIVKEILDRDRRVAEDLKRVVDENLEKLKKVLDELDKKLGDRRLVEILRDIVRLLIEINERAL

RELLKLHEEHTRIVAELLRELERVVEELRRLVELIARGERDHMVLHEYVNAAGITLRELKRRYKEALERIKEKIK

ELKDRYERAVREVVAELRKTTK

>3plus1_Cage_Nterm_GFP11_678
(SEQ ID NO: 27,314)
SKAEEIAEKLDRLLEENRRALEEITTRLDDLLRRDHMVLHEYVNAAGITLDDLRGGIREELLKRIADVIRDIMR

LLKELHDHTAEVIKTIKKLLKELHDINKEIIERLKRLKDGNVPKEELLKRVEELVRTSARLTTEVLKTVEKLIRD

DKRLSEEILKRVKELIEELKRGVDSERVKEILERILRVVEEAVRLNEESLRRILDVVRKAVKLDRESLKKILDVV

EEAVR

>3plus1_Cage_Cterm_GFP11_678
(SEQ ID NO: 27,315)
SKAEEIAEKLDRLLEENRRALEEITTRLDDLLRRNKDALRKVMEKLKRLLDDLRRGGIREELLKRIADVIRDIMR

LLKELHDHTAEVIKTIKKLLKELHDINKEIIERLKRLKDGNVPKEELLKRVEELVRTSARLTTEVLKTVEKLIRD

DKRLSEEILKRVKELIEELRDHMVLHEYVNAAGITLRVVEEAVRLNEESLRRILDVVRKAVKLDRESLKKILDVV

EEAVR

>3plus1_Cage_Nterm_GFP11_678
(SEQ ID NO: 27,316)
SKAEEIAEKLDRLLEENRRALEEITTRLDDLLRRNKDRDHMVLHEYVNAAGITRRGGIREELLKRIADVIRDIMR

LLKELHDHTAEVIKTIKKLLKELHDINKEIIERLKRLKDGNVPKEELLKRVEELVRTSARLTTEVLKTVEKLIRD

DKRLSEEILKRVKELIEELKRGVDSERVKEILERILRVVEEAVRLNEESLRRILDVVRKAVKLDRESLKKILDVV

EEAVR

>3plus1_Cage_Cterm_GFP11_678
(SEQ ID NO: 27,317)
SKAEEIAEKLDRLLEENRRALEEITTRLDDLLRRNKDALRKVMEKLKRLLDDLRRGGIREELLKRIADVIRDIMR

LLKELHDHTAEVIKTIKKLLKELHDINKEIIERLKRLKDGNVPKEELLKRVEELVRTSARLTTEVLKTVEKLIRD

DKRLSEEILKRVKELIEELKRGRDHMVLHEYVNAAGITVEEAVRLNEESLRRILDVVRKAVKLDRESLKKILDVV

EEAVR

>3plus1_Cage_Nterm_GFP11_678
(SEQ ID NO: 27,318)
SKAEEIAEKLDRLLEENRRALEEITTRLDDLLRRNKRDHMVLHEYVNAAGITLRRGGIREELLKRIADVIRDIMR

LLKELHDHTAEVIKTIKKLLKELHDINKEIIERLKRLKDGNVPKEELLKRVEELVRTSARLTTEVLKTVEKLIRD

DKRLSEEILKRVKELIEELKRGVDSERVKEILERILRVVEEAVRLNEESLRRILDVVRKAVKLDRESLKKILDVV

EEAVR

>3plus1_Cage_Nterm_GFP11_678
(SEQ ID NO: 27,319)
SKAEEIAEKLDRLLEENRRALEEITTRLDDLLRRNKDALRDHMVLHEYVNAAGITGGIREELLKRIADVIRDIMR

LLKELHDHTAEVIKTIKKLLKELHDINKEIIERLKRLKDGNVPKEELLKRVEELVRTSARLTTEVLKTVEKLIRD

-continued

```
DKRLSEEILKRVKELIEELKRGVDSERVKEILERILRVVEEAVRLNEESLRRILDVVRKAVKLDRESLKKILDVV

EEAVR

>3plus1_Cage_Cterm_GFP11_679
                                                             (SEQ ID NO: 27,320)
SRVEELKKLIEDILRISREVVERIKRVAEDIHRINRRVLDDLRKLIEDILRTVEEILARKVGDTEIAERLRDTIA

RVVDEIAKLLEEHEKRSRELLEEIRKLLEDILRRSERAVEEIRELLKKGVSTKDVLRIIEEILREHLELLERVVR

RIEEILRELLKTIEEIVKRIKEILEELKEVLKRGRVKDDEVERDHMVLHEYVNAAGITYRRLLEEIKRKLEEILR

RVEELHRRLRRKLEEIDR

>3plus1_Cage_Nterm_GFP11_679
                                                             (SEQ ID NO: 27,321)
SRVEELKKLIEDILRISREVVERIKRVAEDIHRINRRVRDHMVLHEYVNAAGITEILARKVGDTEIAERLRDTIA

RVVDEIAKLLEEHEKRSRELLEEIRKLLEDILRRSERAVEEIRELLKKGVSTKDVLRIIEEILREHLELLERVVR

RIEEILRELLKTIEEIVKRIKEILEELKEVLKRGRVKDDEVEREIRRVKEDLDRILEEYRRLLEEIKRKLEEILR

RVEELHRRLRRKLEEIDR
```

In a fourth aspect, the disclosure provides non-naturally occurring polypeptides comprising a polypeptide having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along its length to the amino acid sequence of a key polypeptide disclosed herein or selected from the group consisting of SEQ ID NOS: 14318-26601 (submitted in U.S. Provisional Application Ser. No. 62/700,681 filed Jul. 19, 2018 and/or 62/785,537 filed Dec. 27, 2018 as Appendix 3), 26602-27015 (submitted in U.S. Provisional Application Ser. No. 62/700,681 filed Jul. 19, 2018 and/or 62/785,537 filed Dec. 27, 2018 as 3plus1_GFP11_Key_Cterm_1" nos. 1-67 and 97-117, 3plus1_GFP11_Key_Nterm_1" nos. 68-96 and 118-140, 2plus1_GFP11_Key_Cterm_" nos. 1-173, and GFP11_Key_Nterm_" nos. 174-274), 27016-27050, 27,322 to 27,358, and key polypeptides in Table 2 (polypeptides with an odd-numbered SEQ ID NO between SEQ ID NOS: 27127 and 27277), Table 3, and/or Table 4, not including optional amino acid residues.

As disclosed herein, the polypeptides of this aspect can be used, for example, as key polypeptides in conjunction with the cage polypeptides to displace the latch through competitive intermolecular binding that induces conformational change, exposing the encoded bioactive peptide or domain and thus activating the system (see, for example, FIG. 1).

As noted in the disclosure, key polypeptides may include residues that are optional; these residues are provided in parentheses and in one embodiment are not included in determining the percent sequence identity. In another embodiment, the optional residues may be included in determining percent sequence identity.

In another embodiment, non-naturally occurring polypeptides comprising a polypeptide having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along its length to the amino acid sequence of a key polypeptide selected from the group consisting of SEQ ID NOS: 26602-27050, and 27,322 to 27,358, as detailed below.

Key sequences are normal text

6His-MBP-TEV, 6His-TEV, and flexible linker sequences are underlined text sequence in bold, italics, are optional residues necessary for biotinylation of MBP_key all sequences in parentheses are optional Any number of consecutive amino acids from the N or C terminus in the non-optional key sequence may be removed to tune responsiveness

```
>SB76_C-helix
                                                             (SEQ ID NO: 27016)
DEARKAIARVKRESKRIVEDAERLIREAAAASEKIS >SB76_C-helix-biotin
                                                             (SEQ ID NO: 27017)
DEARKAIARVKRESKRIVEDAERLIREAAAASEKISGSGK-Biotin >p5_MBP
                                                             (SEQ ID NO: 27018)
(MDP)DEARKAIARVKRESKRIVEDAERLIREAAAASEKISREA(SSGLVPRGSHMKIEEGKLVIWINGDKGYNG

LAEVGKKFEKDTGIKVTVEHPDKLEEKFPQVAATGDGPDIIFWAHDRFGGYAQSGLLAEITPDKAFQDKLYPFTW

DAVRYNGKLIAYPIAVEALSLIYNKDLLPNPPKTWEEIPALDKELKAKGKSALMFNLQEPYFTWPLIAADGGYAF

KYENGKYDIKDVGVDNAGAKAGLTFLVDLIKNKHMNADTDYSIAEAAFNKGETAMTINGPWAWSNIDTSKVNYGV

TVLPTFKGQPSKPFVGVLSAGINAASPNKELAKEFLENYLLTDEGLEAVNKDKPLGAVALKSYEEELVKDPRIAA

TMENAQKGEIMPNIPQMSAFWYAVRTAVINAASGRQTVDEALKDAQTNSSGSGLNDIFEAQKIEWHELEHHHHHH)
```

-continued

>p9_MBP
(SEQ ID NO: 27019)
(MDP)DEARKAIARVKRESKRIVEDAERLIREAAAASEKISREAERLIREAA(SSGLVPRGSHMKIEEGKLVIWI
NGDKGYNGLAEVGKKFEKDTGIKVTVEHPDKLEEKFPQVAATGDGPDIIFWAHDRFGGYAQSGLLAEITPDKAFQ
DKLYPFTWDAVRYNGKLIAYPIAVEALSLIYNKDLLPNPPKTWEEIPALDKELKAKGKSALMFNLQEPYFTWPLI
AADGGYAFKYENGKYDIKDVGVDNAGAKAGLTFLVDLIKNKHMNADTDYSIAEAAFNKGETAMTINGPWAWSNID
TSKVNYGVTVLPTFKGQPSKPFVGVLSAGINAASPNKELAKEFLENYLLTDEGLEAVNKDKPLGAVALKSYEEEL
VKDPRIAATMENAQKGEIMPNIPQMSAFWYAVRTAVINAASGRQTVDEALKDAQTNSSGSGLNDIFEAQKIEWHE
LEHHHHHH)

>p18_MBP
(SEQ ID NO: 27020)
(MDP)DEARKAIARVKRESKRIVEDAERLIREAAAASEKISREAERLIREAAAASEKISRE(SSGLVPRGSHMKI
EEGKLVIWINGDKGYNGLAEVGKKFEKDTGIKVTVEHPDKLEEKFPQVAATGDGPDIIFWAHDRFGGYAQSGLLA
EITPDKAFQDKLYPFTWDAVRYNGKLIAYPIAVEALSLIYNKDLLPNPPKTWEEIPALDKELKAKGKSALMFNLQ
EPYFTWPLIAADGGYAFKYENGKYDIKDVGVDNAGAKAGLTFLVDLIKNKHMNADTDYSIAKAAFNKGETAMTIN
GPWAWSNIDTSKVNYGVTVLPTFKGQPSKPFVGVLSAGINAASPNKELAKEFLENYLLTDEGLEAVNKDKPLGAV
ALKSYEEELVKDPRIAATMENAQKGEIMPNIPQMSAFWYAVRTAVINAASGRQTVDEALKDAQTNSSGSGLNDIF
EAQKIEWHELEHHHHHH)

>MBP_p18 (aka. p76)
(SEQ ID NO: 27021)
(MGSSHHHHHHSSGLVPRGSHMKIEEGKLVIWINGDKGYNGLAEVGKKFEKDTGIKVTVEHPDKLEEKFPQVAAT
GDGPDIIFWAHDRFGGYAQSGLLAEITPDKAFQDKLYPFTWDAVRYNGKLIAYPIAVEALSLIYNKDLLPNPPKT
WEEIPALDKELKAKGKSALMFNLQEPYFTWPLIAADGGYAFKYENGKYDIKDVGVDNAGAKAGLTFLVDLIKNKH
MNADTDYSIAEAAFNKGETAMTINGPWAWSNIDTSKVNYGVTVLPTFKGQPSKPFVGVLSAGINAASPNKELAKE
FLENYLLTDEGLEAVNKDKPLGAVALKSYEEELVKDPRIAATMENAQKGEIMPNIPQMSAFWYAVRTAVINAASG
RQTVDEALKDAQTNSGSGSGENLYFQ)DEARKAIARVKRESKRIVEDAERLIREAAAASEKISRE(*AERLIREAA
AASEKISRE*)

>key_b
(SEQ ID NO: 27022)
(M)NKEEIEKLAKEAREKLKKAEKEHKEIHDKLRKKNKKAREDLKKKADELRETNKRVN(GSENLYFQGSGSGKI
EEGKLVIWINGDKGYNGLAEVGKKFEKDTGIKVTVEHPDKLEEKFPQVAATGDGPDIIFWAHDRFGGYAQSGLLA
EITPDKAFQDKLYPFTWDAVRYNGKLIAYPIAVEALSLIYNKDLLPNPPKTWEEIPALDKELKAKGKSALMFNLQ
EPYFTWPLIAADGGYAFKYENGKYDIKDVGVDNAGAKAGLTFLVDLIKNKHMNADTDYSIAEAAFNKGETAMTIN
GPWAWSNIDTSKVNYGVTVLPTFKGQPSKPFVGVLSAGINAASPNKELAKEFLENYLLTDEGLEAVNKDKPLGAV
ALKSYEEELVKDPRIAATMENAQKGEIMPNIPQMSAFWYAVRTAVINAASGRQTVDEALKDAQTNLEHHHHHH)

>key_c
(SEQ ID NO: 27023)
(M)SSEKVRRELKESLKENHKQNQKLLKDHKRAQEKLNRELEELKKKHKKTLDDIRRES(GSENLYFQGSGSGKI
EEGKLVIWINGDKGYNGLAEVGKKFEKDTGIKVTVEHPDKLEEKFPQVAATGDGPDIIFWAHDRFGGYAQSGLLA
EITPDKAFQDKLYPFTWDAVRYNGKLIAYPIAVEALSLIYNKDLLPNPPKTWEEIPALDKELKAKGKSALMFNLQ
EPYFTWPLIAADGGYAFKYENGKYDIKDVGVDNAGAKAGLTFLVDLIKNKHMNADTDYSIAKAAFNKGETAMTIN
GPWAWSNIDTSKVNYGVTVLPTFKGQPSKPFVGVLSAGINAASPNKELAKEFLENYLLTDEGLEAVNKDKPLGAV
ALKSYEEELVKDPRIAATMENAQKGEIMPNIPQMSAFWYAVRTAVINAASGRQTVDEALKDAQTNLEHHHHHH)

>key_d
(SEQ ID NO: 27024)
(M)DTVKRILEELRRRFEKLAKDLDDIARKLLEDHKKHNKELKDKQRKIKKEADDAARS(GSENLYFQGSGSGKI
EEGKLVIWINGDKGYNGLAEVGKKFEKDTGIKVTVEHPDKLEEKFPQVAATGDGPDIIFWAHDRFGGYAQSGLLA -continued

EITPDKAFQDKLYPFTWDAVRYNGKLIAYPIAVEALSLIYNKDLLPNPPKTWEEIPALDKELKAKGKSALMFNLQ

EPYFTWPLIAADGGYAFKYENGKYDIKDVGVDNAGAKAGLTFLVDLIKNKHMNADTDYSIAKAAFNKGETAMTIN

GPWAWSNIDTSKVNYGVTVLPTFKGQPSKPFVGVLSAGINAASPNKELAKEFLENYLLTDEGLEAVNKDKPLGAV

ALKSYEEELVKDPRIAATMENAQKGEIMPNIPQMSAFWYAVRTAVINAASGRQTVDEALKDAQTNLEHHHHHH)

>key_e (SEQ ID NO: 27025)
(M)DDVERRLRKANKESKKEAEELTEEAKKANEKTKEDSKELTKENRKTNKTIKDEARS(GSENLYFQGSGSGKI

EEGKLVIWINGDKGYNGLAEVGKKFEKDTGIKVTVEHPDKLEEKFPQVAATGDGPDIIFWAHDRFGGYAQSGLLA

EITPDKAFQDKLYPFTWDAVRYNGKLIAYPIAVEALSLIYNKDLLPNPPKTWEEIPALDKELKAKGKSALMFNLQ

EPYFTWPLIAADGGYAFKYENGKYDIKDVGVDNAGAKAGLTFLVDLIKNKHMNADTDYSIAKAAFNKGETAMTIN

GPWAWSNIDTSKVNYGVTVLPTFKGQPSKPFVGVLSAGINAASPNKELAKEFLENYLLTDEGLEAVNKDKPLGAV

ALKSYEEELVKDPRIAATMENAQKGEIMPNIPQMSAFWYAVRTAVINAASGRQTVDEALKDAQTNLEHHHHHH)

>key_f (SEQ ID NO: 27026)
(M)DDEERRSEKTVQDAKREIKKVEDDLQRLNEEQKKKVKKQEDENQKTLKKHKDDARS(GSENLYFQGSGSGKI

EEGKLVIWINGDKGYNGLAEVGKKFEKDTGIKVTVEHPDKLEEKFPQVAATGDGPDIIFWAHDRFGGYAQSGLLA

EITPDKAFQDKLYPFTWDAVRYNGKLIAYPIAVEALSLIYNKDLLPNPPKTWEEIPALDKELKAKGKSALMFNLQ

EPYFTWPLIAADGGYAFKYENGKYDIKDVGVDNAGAKAGLTFLVDLIKNKHMNADTDYSIAKAAFNKGETAMTIN

GPWAWSNIDTSKVNYGVTVLPTFKGQPSKPFVGVLSAGINAASPNKELAKEFLENYLLTDEGLEAVNKDKPLGAV

ALKSYEEELVKDPRIAATMENAQKGEIMPNIPQMSAFWYAVRTAVINAASGRQTVDEALKDAQTNLEHHHHHH)

Additional Keys:
Key sequences are normal text
(6His-MBP-TEV, 6His-TEV, and flexible linker sequences are underlined text)
(Co-localization domain is bolded text)
(Positions that can be mutated to any amino acid to tune responsiveness are underlined bolded text. These are exemplary but not exhaustive.)
(Any number of consecutive amino acids from the N or C terminus in the non-optional key sequence may be removed to tune responsiveness)
(all sequences in parentheses are optional)

>p76-long (SEQ ID NO: 27027)
(MGSSHHHHHHSSGLVPRGSHMKIEEGKLVIWINGDKGYNGLAEVGKKFEKDTGIKVTVEHPDKLEEKFPQVAAT

GDGPDIIFWAHDRFGGYAQSGLLAEITPDKAFQDKLYPFTWDAVRYNGKLIAYPIAVEALSLIYNKDLLPNPPKT

WEEIPALDKELKAKGKSALMFNLQEPYFTWPLIAADGGYAFKYENGKYDIKDVGVDNAGAKAGLTFLVDLIKNKH

MNADTDYSIAEAAFNKGETAMTINGPWAWSNIDTSKVNYGVTVLPTFKGQPSKPFVGVLSAGINAASPNKELAKE

FLENYLLTDEGLEAVNKDKPLGAVALKSYEEELVKDPRIAATMENAQKGEIMPNIPQMSAFWYAVRTAVINAASG

RQTVDEALKDAQTNSGSGSGENLYFQ)DEARKAIARVKRESKRIVEDAERLIREAAAASEKISREAERLIREAAA

ASEKISRE

>p76-short (SEQ ID NO: 27028)
(MGSSHHHHHHSSGLVPRGSHMKIEEGKLVIWINGDKGYNGLAEVGKKFEKDTGIKVTVEHPDKLEEKFPQVAAT

GDGPDIIFWAHDRFGGYAQSGLLAEITPDKAFQDKLYPFTWDAVRYNGKLIAYPIAVEALSLIYNKDLLPNPPKT

WEEIPALDKELKAKGKSALMFNLQEPYFTWPLIAADGGYAFKYENGKYDIKDVGVDNAGAKAGLTFLVDLIKNKH

MNADTDYSIAEAAFNKGETAMTINGPWAWSNIDTSKVNYGVTVLPTFKGQPSKPFVGVLSAGINAASPNKELAKE

-continued

FLENYLLLTDEGLEAVNKDKPLGAVALKSYEEELVKDPRIAATMENAQKGEIMPNIPQMSAFWYAVRTAVINAASG

RQTVDEALKDAQTNSGSGSGENLYFQ)DEARKAIARVKRESKRIVEDAERLIREAAAASEKISREAERLIR

>k76-long
(SEQ ID NO: 27029)
(MGSSHHHHHHSSGLVPRGSHMKIEEGKLVIWINGDKGYNGLAEVGKKFEKDTGIKVTVEHPDKLEEKFPQVAAT

GDGPDIIFWAHDRFGGYAQSGLLAEITPDKAFQDKLYPFTWDAVRYNGKLIAYPIAVEALSLIYNKDLLPNPPKT

WEEIPALDKELKAKGKSALMFNLQEPYFTWPLIAADGGYAFKYENGKYDIKDVGVDNAGAKAGLTFLVDLIKNKH

MNADTDYSIAEAAFNKGETAMTINGPWAWSNIDTSKVNYGVTVLPTFKGQPSKPFVGVLSAGINAASPNKELAKE

FLENYLLLTDEGLEAVNKDKPLGAVALKSYEEELVKDPRIAATMENAQKGEIMPNIPQMSAFWYAVRTAVINAASG

RQTVDEALKDAQTNSGSGSGENLYFQ)DEARKAIARVKRESKRIVEDAERLIREAAQASEKISREARELIERAAQ

ASEKISRE

>k76-short
(SEQ ID NO: 27030)
(MGSSHHHHHHSSGLVPRGSHMKIEEGKLVIWINGDKGYNGLAEVGKKFEKDTGIKVTVEHPDKLEEKFPQVAAT

GDGPDIIFWAHDRFGGYAQSGLLAEITPDKAFQDKLYPFTWDAVRYNGKLIAYPIAVEALSLIYNKDLLPNPPKT

WEEIPALDKELKAKGKSALMFNLQEPYFTWPLIAADGGYAFKYENGKYDIKDVGVDNAGAKAGLTFLVDLIKNKH

MNADTDYSIAEAAFNKGETAMTINGPWAWSNIDTSKVNYGVTVLPTFKGQPSKPFVGVLSAGINAASPNKELAKE

FLENYLLLTDEGLEAVNKDKPLGAVALKSYEEELVKDPRIAATMENAQKGEIMPNIPQMSAFWYAVRTAVINAASG

RQTVDEALKDAQTNSGSGSGENLYFQ)DEARKAIARVKRESKRIVEDAERLIREAAQASEKISREAERLIR

>p76_GLISE
(SEQ ID NO: 27031)
(MGSHHHHHHGSGSENLYFQGSGGS)DEARKAIARVKRESKRIVEDAEGLISEAAAASEKISREAERLIREAAAA
SEKISRE

>p76_GSSEKIS
(SEQ ID NO: 27032)
(MGSHHHHHHGSGSENLYFQGSGGS)DEARKAIARVKRESKRIVEDAERLIREAAGSSEKISREAERLIREAAAA
SEKISRE

>p76_R26G
(SEQ ID NO: 27033)
(MGSHHHHHHGSGSENLYFQGSGGS)DEARKAIARVKRESKRIVEDAERLIGEAAAASEKISREAERLIREAAAA
SEKISRE

>p76-short_E19G
(SEQ ID NO: 27034)
(MGSHHHHHHGSGSENLYFQGSGGS)DEARKAIARVKRESKRIVGDAERLIREAAAASEKISREAERLIR >p76-short_GLISE_E01_EGFR
(SEQ ID NO: 27035)
(MGSHHHHHHGSGSENLYFQGSGGS)DEARKAIARVKRESKRIVEDAEGLISEAAAASEKISREAERLIR >p76-short_AE_EGFR
(SEQ ID NO: 27036)
(MGSHHHHHHGSGSENLYFQGSGGS)DEARKAIARVAEESKRIVEDAERLIREAAAASEKISREAERLIR >p76-short_AAE_EGFR
(SEQ ID NO: 27037)
(MGSHHHHHHGSGSENLYFQGSGGS)DEAAKAIARVAEESKRIVEDAERLIREAAAASEKISREAERLIR >p76-short_EE_EGFR
(SEQ ID NO: 27038)
(MGSHHHHHHGSGSENLYFQGSGGS)DEARKAIARVKRESKRIVEDAERLIREAAAEASEEISREAERLIR >p76-spytag
(SEQ ID NO: 27039)
(MGSHHHHHHGSGSENLYFQGSGGSMKIEEGKLVIWINGDKGYNGLAEVGKKFEKDTGIKVTVEHPDKLEEKFPQ

VAATGDGPDIIFWAHDRFGGYAQSGLLAEITPDKAFQDKLYPFTWDAVRYNGKLIAYPIAVEALSLIYNKDLLPN

PPKTWEEIPALDKELKAKGKSALMFNLQEPYFTWPLIAADGGYAFKYENGKYDIKDVGVDNAGAKAGLTFLVDLI

KNKHMNADTDYSIAEAAFNKGETAMTINGPWAWSNIDTSKVNYGVTVLPTFKGQPSKPFVGVLSAGINAASPNKE

LAKEFLENYLLLTDEGLEAVNKDKPLGAVALKSYEEELVKDPRIAATMENAQKGEIMPNIPQMSAFWYAVRTAVIN

-continued

AASGRQTVDEALKDAQTNSGSGSGENLYFQ)DEARKAIARVKRESKRIVEDAERLIREAAAASEKISREAERLIR
EAAAASEKISRE(GGGSGSGSGSGKPGQASGS)AHIVINDAYKPTK

>p76-short-spytag
(SEQ ID NO: 27040)
(MGSHHHHHHGSGSENLYFQGSGGSMKIEEGKLVIWINGDKGYNGLAEVGKKFEKDTGIKVTVEHPDKLEEKFPQ
VAATGDGPDIIFWAHDRFGGYAQSGLLAEITPDKAFQDKLYPFTWDAVRYNGKLIAYPIAVEALSLIYNKDLLPN
PPKTWEEIPALDKELKAKGKSALMFNLQEPYFTWPLIAADGGYAFKYENGKYDIKDVGVDNAGAKAGLTFLVDLI
KNKHMNADTDYSIAEAAFNKGETAMTINGPWAWSNIDTSKVNYGVTVLPTFKGQPSKPFVGVLSAGINAASPNKE
LAKEFLENYLLTDEGLEAVNKDKPLGAVALKSYEEELVKDPRIAATMENAQKGEIMPNIPQMSAFWYAVRTAVIN
AASGRQTVDEALKDAQTNSGSGSGENLYFQ)DEARKAIARVKRESKRIVEDAERLIREAAAASEKISREAERLIR
(GGGSGSGSGSGKPGQASGS)AHIVMVDAYKPTK

>sfGFP_VMAn_p18
(SEQ ID NO: 27041)
(MGSSHHHHHHSSGLVPRGSHMSKGEELFTGVVPILVELDGDVNGHKFSVRGEGEGDATNGKLTLKFICTTGKLP
VPWPTLVTTLTYGVQCFARYPDHMKQHDFFKSAMPEGYVQERTISFKDDGTYKTRAEVKFEGDTLVNRIELKGID
FKEDGNILGHKLEYNFNSHNVYITADKQKNGIKANFKIRHNVEDGSVQLADHYQQNTPIGDGPVLLPDNHYLSTQ
SVLSKDPNEKRDHMVLLEFVTAAGITHGMDELYKSGSGSGCFAKGTNVLMADGSIECIENIEVGNKVMGKDGRPR
EVIKLPRGRETMYSVVQKSQHRAHKSDSSREVPELLKFTCNATHELVVRTPRSVRRLSRTIKGVEYFEVITFEMG
QKKAPDGRIVELVKEVSKSYPISEGPERANELVESYRKASNKAYFEWTIEARDLSLLGSHVRKATYQTYAPILYG
GSGGS)DEARKAIARVKRESKRIVEDAERLIREAAAASEKISREAERLIREAAAASEKISRE

>p18_VMAc_mCherry
(SEQ ID NO: 27042)
(MGSHHHHHHGSGSENLYFQGSG)DEARKAIARVKRESKRIVEDAERLIREAAAASEKISREAERLIREAAAASE
KISRE(GSGGSGSGGGVLLNVLSKCAGSKKFRPAPAAAFARECRGFYFELQELKEDDYYGITLSDDSDHQFLLAN
QVVVHNCGSGGSVSKGEEDNMAIIKEFMRFKVHMEGSVNGHEFEIEGEGEGRPYEGTQTAKLKVTKGGPLPFAWD
ILSPQFMYGSKAYVKHPADIPDYLKLSFPEGFKWERVMNFEDGGVVTVTQDSSLQDGEFIYKVKLRGTNFPSDGP
VMQKKTMGWEASSERMYPEDGALKGEIKQRLKLKDGGHYDAEVKTTYKAKKPVQLPGAYNVNIKLDITSHNEDYT
IVEQYERAEGRHSTGGMDELYK)

(Cognate Keys for 2plus1 and 3plus1 STREPII-LOCKR
Functional Cage Designs):

>2plus1_KEY_100000.fasta alt_STREP_2plus1_1
(SEQ ID NO: 27043)
DKVRKVAEVAEKVLRDIDKLDRESKEAFRRTNGEISKLDEDTRRVAERVKKAIEDLAK >2plus1_KEY_2
(SEQ ID NO: 27044)
SEVDEIIADNERALDEVRREVEEIDKENAERLKEWVEEAREILDRLAKALEEIR >2plus1_KEY_3
(SEQ ID NO: 27045)
PEEALSKAIKDVRDIVKKVKDELKEWRDRNKELVDRLSEELKEWLKDVERVLKELTDKDR >2plus1_KEY_4
(SEQ ID NO: 27046)
DERVREELKKLLTRVEEEHRKVLETDKKILKEAHKESKEVNDRDRELLERLEESVR >3plus1_KEY_1
(SEQ ID NO: 27047)
SRLVKKLDEIVKEVAKKLEDVVRANEELWRKLVELNKESVARLREAVERVARDLEETAR >3plus1_KEY_2
(SEQ ID NO: 27048)
SDEERLEKVVKDVIEKVRRILEKWKKDIDKVVKELRRILEEWEKIIREVLDKVR

```
-continued
>3plus1_KEY_3
                                                    (SEQ ID NO: 27049)
DKDAVIKVIEKLIRANAAVWDALLKINEDLVRVNKTVWKELLRVNEKLARDLERVVK >3plus1_KEY_4
                                                    (SEQ ID NO: 27050)
SLVDELRKSLERNVRVSEEVARRLKEALKRWVDVVRKVVEDLIRLNEDVVRVVEK SEQ ID NOs: 26,602-27,015:
>3plus1_GFP11_Key_Cterm_1
                                                    (SEQ ID NO: 26602)
SGSKEVLDILERAVEVVRRVIKALKEVLERHVDATREVIERVKRVNKRLLEAVREVVT >3plus1_GFP11_Key_Cterm_2
                                                    (SEQ ID NO: 26603)
GVPEEIDRELKRVVEELRRLHEEIKERLDDVARRSEEELRRIIKKLKEVVKEIRKKLK >3plus1_GFP11_Key_Cterm_3
                                                    (SEQ ID NO: 26604)
DLLRKLEEELRRIKEKLRKALEELEREHRELEKELDKLHDESRKEHERIEEELRR >3plus1_GFP11_Key_Cterm_4
                                                    (SEQ ID NO: 26605)
DEDLLEKIKRVIREHIKALEKLARDLKEILRRHIEALKELARDLAEVIRKLLEDVKR >3plus1_GFP11_Key_Cterm_5
                                                    (SEQ ID NO: 26606)
DLERLRRKVEELEDRLRRLLEKLARDSAELMRELERILDRYARESEELDRRLAE >3plus1_GFP11_Key_Cterm_6
                                                    (SEQ ID NO: 26607)
DLEDILRKNLDRLRKLLERLREILRENLEALKKTLKRLEDVVREILEDLKRERK >3plus1_GFP11_Key_Cterm_7
                                                    (SEQ ID NO: 26608)
DLERLRRKVEELEDRLRRLLEKLARDSAELMRELERILDRYARESEELDRRLAE >3plus1_GFP11_Key_Cterm_8
                                                    (SEQ ID NO: 26609)
SGSKEVLDILERAVEVVRRVIKALKEVLERHVDATREVIERVKRVNKRLLEAVREVVT >3plus1_GFP11_Key_Cterm_9
                                                    (SEQ ID NO: 26610)
DLERLRRKVEELEDRLRRLLEKLARDSAELMRELERILDRYARESEELDRRLAE >3plus1_GFP11_Key_Cterm_10
                                                    (SEQ ID NO: 26611)
RLIEEVVRLLRENLDVVRRILEALAKLIKELLEALEEVLRRNKELIRELLRVLDEALK >3plus1_GFP11_Key_Cterm_11
                                                    (SEQ ID NO: 26612)
DIVRAMEEVIRRLIEILRRDVELNLDVAKKLLELLKEDSKLNLDVARELLELLDR >3plus1_GFP11_Key_Cterm_12
                                                    (SEQ ID NO: 26613)
DIVRAMEEVIRRLIEILRRDVELNLDVAKKLLELLKEDSKLNLDVARELLELLDR >3plus1_GFP11_Key_Cterm_13
                                                    (SEQ ID NO: 26614)
RLIEEVVRLLRENLDVVRRILEALAKLIKELLEALEEVLRRNKELIRELLRVLDEALK >3plus1_GFP11_Key_Cterm_14
                                                    (SEQ ID NO: 26615)
RLIEEVVRLLRENLDVVRRILEALAKLIKELLEALEEVLRRNKELIRELLRVLDEALK >3plus1_GFP11_Key_Cterm_15
                                                    (SEQ ID NO: 26616)
DLLRKLEEELRRIKEKLRKALEELEREHRELEKELDKLHDESRKEHERIEEELRR >3plus1_GFP11_Key_Cterm_16
                                                    (SEQ ID NO: 26617)
DLLRKLEEELRRIKEKLRKALEELEREHRELEKELDKLHDESRKEHERIEEELRR >3plus1_GFP11_Key_Cterm_17
                                                    (SEQ ID NO: 26618)
ELAREVERVIKELLDKSKEILERIERAIDELLKVSEEILKLSEDASEELLKILREFAK >3plus1_GFP11_Key_Cterm_18
                                                    (SEQ ID NO: 26619)
DVKDIIRTILEVARDLLRLLEEDSRTNSEVVKRLLDLLREDSKANSEVVKRLLDVLRE
```

```
-continued
>3plus1_GFP11_Key_Cterm_19
                                      (SEQ ID NO: 26620)
DLERLRRKVEELEDRLRRLLEKLARDSAELMRELERILDRYARESEELDRRLAE >3plus1_GFP11_Key_Cterm_20
                                      (SEQ ID NO: 26621)
DLERLRRKVEELEDRLRRLLEKLARDSAELMRELERILDRYARESEELDRRLAE >3plus1_GFP11_Key_Cterm_21
                                      (SEQ ID NO: 26622)
RLIEEVVRLLRENLDVVRRILEALAKLIKELLEALEEVLRRNKELIRELLRVLDEALK >3plus1_GFP11_Key_Cterm_22
                                      (SEQ ID NO: 26623)
DLEDILRKNLDRLRKLLERLREILRENLEALKKTLKRLEDVVREILEDLKRERK >3plus1_GFP11_Key_Cterm_23
                                      (SEQ ID NO: 26624)
DLLRKLEEELRRIKEKLRKALEELEREHRELEKELDKLHDESRKEHERIEEELRR >3plus1_GFP11_Key_Cterm_24
                                      (SEQ ID NO: 26625)
DEDLLEKIKRVIREHIKALEKLARDLKEILRRHIEALKELARDLAEVIRKLLEDVKR >3plus1_GFP11_Key_Cterm_25
                                      (SEQ ID NO: 26626)
ELVRIAIEVLKRLLEIIEELVRLNNEILERLLKIVRELHKDNIKILEDLLRIIEEVLR >3plus1_GFP11_Key_Cterm_26
                                      (SEQ ID NO: 26627)
ELVRIAIEVLKRLLEIIEELVRLNNEILERLLKIVRELHKDNIKILEDLLRIIEEVLR >3plus1_GFP11_Key_Cterm_27
                                      (SEQ ID NO: 26628)
RLARLLKALADKLIRVLEEILKINEELNRKIIKFARENLERNRRVNKKVIEVLREAAR >3plus1_GFP11_Key_Cterm_28
                                      (SEQ ID NO: 26628)
DLERLRRKVEELEDRLRRLLEKLARDSAELMRELERILDRYARESEELDRRLAE >3plus1_GFP11_Key_Cterm_29
                                      (SEQ ID NO: 26630)
ELVRIAIEVLKRLLEIIEELVRLNNEILERLLKIVRELHKDNIKILEDLLRIIEEVLR >3plus1_GFP11_Key_Cterm_30
                                      (SEQ ID NO: 26631)
ELVRIAIEVLKRLLEIIEELVRLNNEILERLLKIVRELHKDNIKILEDLLRIIEEVLR >3plus1_GFP11_Key_Cterm_31
                                      (SEQ ID NO: 26632)
DIVRAMEEVIRRLIEILRRDVELNLDVAKKLLELLKEDSKLNLDVARELLELLDR >3plus1_GFP11_Key_Cterm_32
                                      (SEQ ID NO: 26633)
RKIAKIIEELKRLLEDLARDTRRVIEEAKRLLKEWRDRNKEVADTLKKLLEDLIRKIR >3plus1_GFP11_Key_Cterm_33
                                      (SEQ ID NO: 26634)
DLLRKLEEELRRIKEKLRKALEELEREHRELEKELDKLHDESRKEHERIEEELRR >3plus1_GFP11_Key_Cterm_34
                                      (SEQ ID NO: 26635)
DLLRKLEEELRRIKEKLRKALEELEREHRELEKELDKLHDESRKEHERIEEELRR >3plus1_GFP11_Key_Cterm_35
                                      (SEQ ID NO: 26636)
RKIAKIIEELKRLLEDLARDTRRVIEEAKRLLKEWRDRNKEVADTLKKLLEDLIRKIR >3plus1_GFP11_Key_Cterm_36
                                      (SEQ ID NO: 26637)
ELVRIAIEVLKRLLEIIEELVRLNNEILERLLKIVRELHKDNIKILEDLLRIIEEVLR >3plus1_GFP11_Key_Cterm_37
                                      (SEQ ID NO: 26638)
TVRRLREALKKLEDDLRKIERDAEREYKKLKDELEELTERYRREIRKLKEELKADRK >3plus1_GFP11_Key_Cterm_38
                                      (SEQ ID NO: 26639)
DEAERRRRELKDKLDRLREEHEEVKRRLEEELTRLRETHKKIEKELREALKRVRDRST
```

-continued

>3plus1_GFP11_Key_Cterm_39
(SEQ ID NO: 26640)
DEAERRRRELKDKLDRLREEHEEVKRRLEEELTRLRETHKKIEKELREALKRVRDRST >3plus1_GFP11_Key_Cterm_40
(SEQ ID NO: 26641)
DLEDILRKNLDRLRKLLERLREILRENLEALKKTLKRLEDVVREILEDLKRERK >3plus1_GFP11_Key_Cterm_41
(SEQ ID NO: 26642)
DLERLRRKVEELEDRLRRLLEKLARDSAELMRELERILDRYARESEELDRRLAE >3plus1_GFP11_Key_Cterm_42
(SEQ ID NO: 26643)
DEAERRRRELKDKLDRLREEHEEVKRRLEEELTRLRETHKKIEKELREALKRVRDRST >3plus1_GFP11_Key_Cterm_43
(SEQ ID NO: 26644)
DEAERRRRELKDKLDRLREEHEEVKRRLEEELTRLRETHKKIEKELREALKRVRDRST >3plus1_GFP11_Key_Cterm_44
(SEQ ID NO: 26645)
DEAERRRRELKDKLDRLREEHEEVKRRLEEELTRLRETHKKIEKELREALKRVRDRST >3plus1_GFP11_Key_Cterm_45
(SEQ ID NO: 26646)
DKAVEELEKALEEIKRRLKEVIDRYEDELRKLRKEYKEKIDKYERKLEEIERRERT >3plus1_GFP11_Key_Cterm_46
(SEQ ID NO: 26647)
DVKRALEELVSRLRKLLEDVKKASEDIVREVERIVRELAKRSDEILKKLEDIVEKLRE >3plus1_GFP11_Key_Cterm_47
(SEQ ID NO: 26648)
DVKRALEELVSRLRKLLEDVKKASEDIVREVERIVRELAKRSDEILKKLEDIVEKLRE >3plus1_GFP11_Key_Cterm_48
(SEQ ID NO: 26649)
DEAERRRRELKDKLDRLREEHEEVKRRLEEELTRLRETHKKIEKELREALKRVRDRST >3plus1_GFP11_Key_Cterm_49
(SEQ ID NO: 26650)
DVKRALEELVSRLRKLLEDVKKASEDIVREVERIVRELAKRSDEILKKLEDIVEKLRE >3plus1_GFP11_Key_Cterm_50
(SEQ ID NO: 26651)
EVKRRLEEKERRIRTRYEELRRRLRKRVKDYEDKLREIEKKVRRDAERIEEELERAKK >3plus1_GFP11_Key_Cterm_51
(SEQ ID NO: 26652)
DEAERRRRELKDKLDRLREEHEEVKRRLEEELTRLRETHKKIEKELREALKRVRDRST >3plus1_GFP11_Key_Cterm_52
(SEQ ID NO: 26653)
KIAEEIERELEELRRMIKRLHEDLERKLKESEDELREIEARLEEKIRRLEEKLERKRR >3plus1_GFP11_Key_Cterm_53
(SEQ ID NO: 26654)
KIAEEIERELEELRRMIKRLHEDLERKLKESEDELREIEARLEEKIRRLEEKLERKRR >3plus1_GFP11_Key_Cterm_54
(SEQ ID NO: 26655)
DKAVEELEKALEEIKRRLKEVIDRYEDELRKLRKEYKEKIDKYERKLEEIERRERT >3plus1_GFP11_Key_Cterm_55
(SEQ ID NO: 26656)
KIAEEIERELEELRRMIKRLHEDLERKLKESEDELREIEARLEEKIRRLEEKLERKRR >3plus1_GFP11_Key_Cterm_56
(SEQ ID NO: 26657)
ELVRIAIEVLKRLLEIIEELVRLNNEILERLLKIVRELHKDNIKILEDLLRIIEEVLR >3plus1_GFP11_Key_Cterm_57
(SEQ ID NO: 26658)
DEVEREIRRVKEDLDRILEEYRRLLEEIKRKLEEILRRVEELHRRLRRKLEEIDR >3plus1_GFP11_Key_Cterm_58
(SEQ ID NO: 26659)
DVKRALEELVSRLRKLLEDVKKASEDIVREVERIVRELAKRSDEILKKLEDIVEKLRE

```
>3plus1_GFP11_Key_Cterm_59
                                          (SEQ ID NO: 26660)
DEAERRRRELKDKLDRLREEHEEVKRRLEEELTRLRETHKKIEKELREALKRVRDRST >3plus1_GFP11_Key_Cterm_60
                                          (SEQ ID NO: 26661)
DEAERRRRELKDKLDRLREEHEEVKRRLEEELTRLRETHKKIEKELREALKRVRDRST >3plus1_GFP11_Key_Cterm_61
                                          (SEQ ID NO: 26662)
TLREVVRKVLEEAKRLLDELEEVHKRVKKELEDIIEENRRVVKRVRDELREIKRELDE >3plus1_GFP11_Key_Cterm_62
                                          (SEQ ID NO: 26663)
DVKRALEELVSRLRKLLEDVKKASEDIVREVERIVRELAKRSDEILKKLEDIVEKLRE >3plus1_GFP11_Key_Cterm_63
                                          (SEQ ID NO: 26664)
DVKRALEELVSRLRKLLEDVKKASEDIVREVERIVRELAKRSDEILKKLEDIVEKLRE >3plus1_GFP11_Key_Cterm_64
                                          (SEQ ID NO: 26665)
DEAERRRRELKDKLDRLREEHEEVKRRLEEELTRLRETHKKIEKELREALKRVRDRST >3plus1_GFP11_Key_Cterm_65
                                          (SEQ ID NO: 26666)
DEAERRRRELKDKLDRLREEHEEVKRRLEEELTRLRETHKKIEKELREALKRVRDRST >3plus1_GFP11_Key_Cterm_66
                                          (SEQ ID NO: 26667)
KIAEEIERELEELRRMIKRLHEDLERKLKESEDELREIEARLEEKIRRLEEKLERKRR >3plus1_GFP11_Key_Cterm_67
                                          (SEQ ID NO: 26668)
DVKRALEELVSRLRKLLEDVKKASEDIVREVERIVRELAKRSDEILKKLEDIVEKLRE >3plus1_GFP11_Key_Nterm_68
                                          (SEQ ID NO: 26669)
SEAERLADEVRKAVKKSEEDNETLVREVEKAVRELKKNNKTWVDEVRKLMKRLVDLLR >3plus1_GFP11_Key_Nterm_69
                                          (SEQ ID NO: 26670)
SEAERLADEVRKAVKKSEEDNETLVREVEKAVRELKKNNKTWVDEVRKLMKRLVDLLR >3plus1_GFP11_Key_Nterm_70
                                          (SEQ ID NO: 26671)
DKDKRLEELLKRLKELNDKTFEELERILEELKRANEASLREAERILEELRARIEGGNL >3plus1_GFP11_Key_Nterm_71
                                          (SEQ ID NO: 26672)
SEAEDLEELIKELAELLKDVIRKLEKINRRLVKILEDIIRRLKEISKEAEEELRKGTV >3plus1_GFP11_Key_Nterm_72
                                          (SEQ ID NO: 26673)
SDKEEIKRRVEKTARDLETEHDKIKKRLEDTVRDIKRELDELLEKYERVLRKIEKTLR >3plus1_GFP11_Key_Nterm_73
                                          (SEQ ID NO: 26674)
SEAEKIREALETNLRLLEELIKRLKEILDTHNELLRRVIETLERLLKELLELLEEGGL >3plus1_GFP11_Key_Nterm_74
                                          (SEQ ID NO: 26675)
SEAEKIREALETNLRLLEELIKRLKEILDTHNELLRRVIETLERLLKELLELLEEGGL >3plus1_GFP11_Key_Nterm_75
                                          (SEQ ID NO: 26676)
SKEERLREVAEKHKKDLEDIVKRVDEAAKETARRLEEILKRLEEVLKKILDDLEKGPD >3plus1_GFP11_Key_Nterm_76
                                          (SEQ ID NO: 26677)
SLEEITKRLLELVEENLARHEEILRELLELAKRLAKEDRDILEEVLKLIEELLKLLED >3plus1_GFP11_Key_Nterm_77
                                          (SEQ ID NO: 26678)
SKEETLKRLLDELEKRNRETVERLERLLKELEDRNRASLEELEAVLEELERKIEESGL >3plus1_GFP11_Key_Nterm_78
                                          (SEQ ID NO: 26679)
SKEETLKRLLDELEKRNRETVERLERLLKELEDRNRASLEELEAVLEELERKIEESGL
```

-continued

>3plus1_GFP11_Key_Nterm_79
(SEQ ID NO: 26680)
SKEETLKRLLDELEKRNRETVERLERLLKELEDRNRASLEELEAVLEELERKIEESGL >3plus1_GFP11_Key_Nterm_80
(SEQ ID NO: 26681)
STREKAKKVLDTLRADNEDMKRVVEKILRALKRTNERAEKLAREITEEIKRILKEVGV >3plus1_GFP11_Key_Nterm_81
(SEQ ID NO: 26682)
DAEEVVKRLADVLRENDETIRKVVEDLVRIAEENDRLWKKLVEDIAEILRRIVELLRR >3plus1_GFP11_Key_Nterm_82
(SEQ ID NO: 26683)
SKEETLKRLLDELEKRNRETVERLERLLKELEDRNRASLEELEAVLEELERKIEESGL >3plus1_GFP11_Key_Nterm_83
(SEQ ID NO: 26684)
STREKAKKVLDTLRADNEDMKRVVEKILRALKRTNERAEKLAREITEEIKRILKEVGV >3plus1_GFP11_Key_Nterm_84
(SEQ ID NO: 26685)
SKEEEVEKVLRKWEEILRRLIEENKRANDKIRREYEELVKEIRRVLEEIKEVAERLGV >3plus1_GFP11_Key_Nterm_85
(SEQ ID NO: 26686)
DREKSVRDIEEDLKRVLDKLRRRVETSKEELKKVLKADKENADELEKTLRDVVRELDR >3plus1_GFP11_Key_Nterm_86
(SEQ ID NO: 26687)
SDKEEIKRRVEKTARDLETEHDKIKKRLEDTVRDIKRELDELLEKYERVLRKIEKTLR >3plus1_GFP11_Key_Nterm_87
(SEQ ID NO: 26688)
STREKAKKVLDTLRADNEDMKRVVEKILRALKRTNERAEKLAREITEEIKRILKEVGV >3plus1_GFP11_Key_Nterm_88
(SEQ ID NO: 26689)
SKDEELARLLEELVERWRKIVEDLERDHRRLVKEIRELVERIRKKLEELVDRIRKNGI >3plus1_GFP11_Key_Nterm_89
(SEQ ID NO: 26690)
SEAERLADEVRKAVKKSEEDNETLVREVEKAVRELKKNNKTWVDEVRKLMKRLVDLLR >3plus1_GFP11_Key_Nterm_90
(SEQ ID NO: 26691)
SKDEELARLLEELVERWRKIVEDLERDHRRLVKEIRELVERIRKKLEELVDRIRKNGI >3plus1_GFP11_Key_Nterm_91
(SEQ ID NO: 26692)
KEIEETLKELEDLNREMVETNRRVLEETRRLNKETVDRVKATLDELAKMLKKLVDDVR >3plus1_GFP11_Key_Nterm_92
(SEQ ID NO: 26693)
SEAERLADEVRKAVKKSEEDNETLVREVEKAVRELKKNNKTWVDEVRKLMKRLVDLLR >3plus1_GFP11_Key_Nterm_93
(SEQ ID NO: 26694)
SKEETLKRLLDELEKRNRETVERLERLLKELEDRNRASLEELEAVLEELERKIEESGL >3plus1_GFP11_Key_Nterm_94
(SEQ ID NO: 26695)
DKAEVLREALKLLKDLLEELIKIHEESLKRILDLIDTLVKVHEDALRALKELLERSGL >3plus1_GFP11_Key_Nterm_95
(SEQ ID NO: 26696)
SKEEEVEKVLRKWEEILRRLIEENKRANDKIRREYEELVKEIRRVLEEIKEVAERLGV >3plus1_GFP11_Key_Nterm_96
(SEQ ID NO: 26697)
SKEETLKRLLDELEKRNRETVERLERLLKELEDRNRASLEELEAVLEELERKIEESGL >3plus1_GFP11_Key_Cterm_97
(SEQ ID NO: 26698)
SERVKEILERILRVVEEAVRLNEESLRRILDVVRKAVKLDRESLKKILDVVEEAVR >3plus1_GFP11_Key_Cterm_98
(SEQ ID NO: 26699)
SERVKEILERILRVVEEAVRLNEESLRRILDVVRKAVKLDRESLKKILDVVEEAVR -continued >3plus1_GFP11_Key_Cterm_99
(SEQ ID NO: 26700)
DERRIAERIRELLRESKKLVRDVVEEAKRLLKENRDSTRKIIEDIRRLLRKIEDSTR >3plus1_GFP11_Key_Cterm_100
(SEQ ID NO: 26701)
DALSRLLEELLRVVDDLIRVLKELIDKSRKVIEELLELLKRINEENLKVLAEIIK >3plus1_GFP11_Key_Cterm_101
(SEQ ID NO: 26702)
DERRIAERIRELLRESKKLVRDVVEEAKRLLKENRDSTRKIIEDIRRLLRKIEDSTR >3plus1_GFP11_Key_Cterm_102
(SEQ ID NO: 26703)
EALRKLVELLVEVLRRLIRVNRELVKLLREVLERLLRILRESVKKLKRLIEKVIKDAT >3plus1_GFP11_Key_Cterm_103
(SEQ ID NO: 26704)
EALRKLVELLVEVLRRLIRVNRELVKLLREVLERLLRILRESVKKLKRLIEKVIKDAT >3plus1_GFP11_Key_Cterm_104
(SEQ ID NO: 26705)
AAKRLVEELLKAVTDLSRKNKRILEELLKAIETLSDENKKILTEILDALRRLVEKIEK >3plus1_GFP11_Key_Cterm_105
(SEQ ID NO: 26706)
EALRKLVELLVEVLRRLIRVNRELVKLLREVLERLLRILRESVKKLKRLIEKVIKDAT >3plus1_GFP11_Key_Cterm_106
(SEQ ID NO: 26707)
EALRKLVELLVEVLRRLIRVNRELVKLLREVLERLLRILRESVKKLKRLIEKVIKDAT >3plus1_GFP11_Key_Cterm_107
(SEQ ID NO: 26708)
DALSRLLEELLRVVDDLIRVLKELIDKSRKVIEELLELLKRINEENLKVLAEIIK >3plus1_GFP11_Key_Cterm_108
(SEQ ID NO: 26709)
DALSRLLEELLRVVDDLIRVLKELIDKSRKVIEELLELLKRINEENLKVLAEIIK >3plus1_GFP11_Key_Cterm_109
(SEQ ID NO: 26710)
RAVKKLDEIVKEVAKKLEDVVRANEELWRALVELNKESVRRLREIVERVARDLEETAR >3plus1_GFP11_Key_Cterm_110
(SEQ ID NO: 26711)
DRLDKVEELVKKLLEDTKRTVDRVRELVRKILKKSRETLEELERLIEKILRELEKDAR >3plus1_GFP11_Key_Cterm_111
(SEQ ID NO: 26712)
DALSRLLEELLRVVDDLIRVLKELIDKSRKVIEELLELLKRINEENLKVLAEIIK >3plus1_GFP11_Key_Cterm_112
(SEQ ID NO: 26713)
RAVKKLDEIVKEVAKKLEDVVRANEELWRALVELNKESVRRLREIVERVARDLEETAR >3plus1_GFP11_Key_Cterm_113
(SEQ ID NO: 26714)
RAVKKLDEIVKEVAKKLEDVVRANEELWRALVELNKESVRRLREIVERVARDLEETAR >3plus1_GFP11_Key_Cterm_114
(SEQ ID NO: 26715)
SEDDLKRVVDEVEKKLRELKRRYAEALERIKEKIKELKDRYERAVREVVAELRKTTK >3plus1_GFP11_Key_Cterm_115
(SEQ ID NO: 26716)
RAVKKLDEIVKEVAKKLEDVVRANEELWRALVELNKESVRRLREIVERVARDLEETAR >3plus1_GFP11_Key_Cterm_116
(SEQ ID NO: 26717)
DEVEREIRRVKEDLDRILEEYRRLLEEIKRKLEEILRRVEELHRRLRRKLEEIDR >3plus1_GFP11_Key_Cterm_117
(SEQ ID NO: 26718)
SEDDLKRVVDEVEKKLRELKRRYAEALERIKEKIKELKDRYERAVREVVAELRKTTK >3plus1_GFP11_Key_Nterm_118
(SEQ ID NO: 26719)
DEAKELLDEIRKAVKESEDRLEKLLRDYEKELRRLEKELRDLKRRIEEKLEELRRGSL -continued >3plus1_GFP11_Key_Nterm_119
(SEQ ID NO: 26720)
SEKEDAARKLRKLVEELTREYEELVKKLERLIEEIEKVSEESVRKLEKLLAEISEEVR >3plus1_GFP11_Key_Nterm_120
(SEQ ID NO: 26721)
SEDEIIKKIIEDLRRVLKEVEEIHKEVEERLDKVLKEAEEMHKEVLKELDRVLDEVKR >3plus1_GFP11_Key_Nterm_121
(SEQ ID NO: 26722)
SKAEEIAEKLDRLLEENRRALEEITTRLDDLLRRNKDALRKVMEKLKRLLDDLRRGGI >3plus1_GFP11_Key_Nterm_122
(SEQ ID NO: 26723)
SEKEKLLKESEEEVRRLRRTLEELLRKYREVLERLRKELREIEERVRDVVRRLKEVLD >3plus1_GFP11_Key_Nterm_123
(SEQ ID NO: 26724)
SEKEDAARKLRKLVEELTREYEELVKKLERLIEEIEKVSEESVRKLEKLLAEISEEVR >3plus1_GFP11_Key_Nterm_124
(SEQ ID NO: 26725)
SKEETLRKEAEDLLRRLEELTRRLEKKARELLERAKKLSRDLAEELKRLLKELREKGV >3plus1_GFP11_Key_Nterm_125
(SEQ ID NO: 26726)
SEKEDAARKLRKLVEELTREYEELVKKLERLIEEIEKVSEESVRKLEKLLAEISEEVR >3plus1_GFP11_Key_Nterm_126
(SEQ ID NO: 26727)
SKAEEIAEKLDRLLEENRRALEEITTRLDDLLRRNKDALRKVMEKLKRLLDDLRRGGI >3plus1_GFP11_Key_Nterm_127
(SEQ ID NO: 26728)
SEKEDAARKLRKLVEELTREYEELVKKLERLIEEIEKVSEESVRKLEKLLAEISEEVR >3plus1_GFP11_Key_Nterm_128
(SEQ ID NO: 26729)
SKAEEIAEKLDRLLEENRRALEEITTRLDDLLRRNKDALRKVMEKLKRLLDDLRRGGI >3plus1_GFP11_Key_Nterm_129
(SEQ ID NO: 26730)
SKEETLRKEAEDLLRRLEELTRRLEKKARELLERAKKLSRDLAEELKRLLKELREKGV >3plus1_GFP11_Key_Nterm_130
(SEQ ID NO: 26731)
SRVEELKKLIEDILRISREVVERIKRVAEDIHRINRRVLDDLRKLIEDILRTVEEILA >3plus1_GFP11_Key_Nterm_131
(SEQ ID NO: 26732)
SKEETLRKEAEDLLRRLEELTRRLEKKARELLERAKKLSRDLAEELKRLLKELREKGV >3plus1_GFP11_Key_Nterm_132
(SEQ ID NO: 26733)
SKAEEIAEKLDRLLEENRRALEEITTRLDDLLRRNKDALRKVMEKLKRLLDDLRRGGI >3plus1_GFP11_Key_Nterm_133
(SEQ ID NO: 26734)
SKEETLRKEAEDLLRRLEELTRRLEKKARELLERAKKLSRDLAEELKRLLKELREKGV >3plus1_GFP11_Key_Nterm_134
(SEQ ID NO: 26735)
SEKEDAARKLRKLVEELTREYEELVKKLERLIEEIEKVSEESVRKLEKLLAEISEEVR >3plus1_GFP11_Key_Nterm_135
(SEQ ID NO: 26736)
SKEETLRKEAEDLLRRLEELTRRLEKKARELLERAKKLSRDLAEELKRLLKELREKGV >3plus1_GFP11_Key_Nterm_136
(SEQ ID NO: 26737)
SERETVKRRLEELLKEVKRTLDKLKEEHDRLLEDVRRVVEELKREHDKLLKEVKDSGV >3plus1_GFP11_Key_Nterm_137
(SEQ ID NO: 26738)
SEKEDAARKLRKLVEELTREYEELVKKLERLIEEIEKVSEESVRKLEKLLAEISEEVR >3plus1_GFP11_Key_Nterm_138
(SEQ ID NO: 26739)
SKEETLRKEAEDLLRRLEELTRRLEKKARELLERAKKLSRDLAEELKRLLKELREKGV

```
>3plus1_GFP11_Key_Nterm_139
                                          (SEQ ID NO: 26740)
KEREEVKEKLDRLLEEVEKTVRELKREHDELLKEVEKLVRDLKKEHDELLKKVKDDGV >3plus1_GFP11_Key_Nterm_140
                                          (SEQ ID NO: 26741)
SREEVLRELEEVIEDNRRLLEELIEKSKKVLDESLKLIDELLRRLEEVLERVLRLLEE >2plus1_GFP11_Key_Cterm_1
                                          (SEQ ID NO: 26742)
DEVVKRVRDLLDTVRRRNEKVNEDVKRMNDKLRRDNEDVIRRVEKLLRELEEKRRT >2plus1_GFP11_Key_Cterm_2
                                          (SEQ ID NO: 26743)
SEDSVERIARELERNLDDLARVLKESEDDLAEILRRLKEVLEESERDLERVEREVRK >2plus1_GFP11_Key_Cterm_3
                                          (SEQ ID NO: 26744)
SKELLEKAKAVVDEIKRLAEESLKRLEDLSRDHKRRAKELNDEIAKVVDELAKRAT >2plus1_GFP11_Key_Cterm_4
                                          (SEQ ID NO: 26745)
SKEKIDRIIRELERILEEAKKKHEDVLRRLEDSLRRVAELLKAALDRLREIVDRLRR >2plus1_GFP11_Key_Cterm_5
                                          (SEQ ID NO: 26746)
DEVVKRVRDLLDTVRRRNEKVNEDVKRMNDKLRRDNEDVIRRVEKLLRELEEKRRT >2plus1_GFP11_Key_Cterm_6
                                          (SEQ ID NO: 26747)
DIKTLLDRVRKLAEEDAERLDRLRRESEELNERVRRVDKKLLEEIRRKAKKVEDDTR >2plus1_GFP11_Key_Cterm_7
                                          (SEQ ID NO: 26748)
DAETLLRELEKLSRDNKELLKKIEKEIRDLIKEDKERNIELSERLRKLVEELKKKAT >2plus1_GFP11_Key_Cterm_8
                                          (SEQ ID NO: 26749)
DEVVKRVRDLLDTVRRRNEKVNEDVKRMNDKLRRDNEDVIRRVEKLLRELEEKRRT >2plus1_GFP11_Key_Cterm_9
                                          (SEQ ID NO: 26750)
DIKTLLDRVRKLAEEDAERLDRLRRESEELNERVRRVDKKLLEEIRRKAKKVEDDTR >2plus1_GFP11_Key_Cterm_10
                                          (SEQ ID NO: 26751)
SEELSAEVKKLLDEVRKALARHKDENDKLLKEIEDSLRRHKEENDRLLEKLKESTR >2plus1_GFP11_Key_Cterm_11
                                          (SEQ ID NO: 26752)
DADDVLARVEELAKRAHDENERLIREVEELVRAHNKRNKELVDEVKRLVEKVIEEER >2plus1_GFP11_Key_Cterm_12
                                          (SEQ ID NO: 26753)
SKEKIDRIIRELERILEEAKKKHEDVLRRLEDSLRRVAELLKAALDRLREIVDRLRR >2plus1_GFP11_Key_Cterm_13
                                          (SEQ ID NO: 26754)
DEVVKRVRDLLDTVRRRNEKVNEDVKRMNDKLRRDNEDVIRRVEKLLRELEEKRRT >2plus1_GFP11_Key_Cterm_14
                                          (SEQ ID NO: 26755)
SEELSAEVKKLLDEVRKALARHKDENDKLLKEIEDSLRRHKEENDRLLEKLKESTR >2plus1_GFP11_Key_Cterm_15
                                          (SEQ ID NO: 26756)
DAETVLRSAEDIVAKNRKLAEEVLRRVKKIVEENRKIASEVLDDVRKLVEDVLARAS >2plus1_GFP11_Key_Cterm_16
                                          (SEQ ID NO: 26757)
DADDVLARVEELAKRAHDENERLIREVEELVRAHNKRNKELVDEVKRLVEKVIEEER >2plus1_GFP11_Key_Cterm_17
                                          (SEQ ID NO: 26758)
SKEKIDRIIRELERILEEAKKKHEDVLRRLEDSLRRVAELLKAALDRLREIVDRLRR >2plus1_GFP11_Key_Cterm_18
                                          (SEQ ID NO: 26759)
DEEKLKDLIRKLRDILRRAAEAHKKLIDDARESLERAKREHEKLIDRLKKILEELER
```

-continued

```
>2plus1_GFP11_Key_Cterm_19
                                         (SEQ ID NO: 26760)
DIKTLLDRVRKLAEEDAERLDRLRRESEELNERVRRVDKKLLEEIRRKAKKVEDDTR >2plus1_GFP11_Key_Cterm_20
                                         (SEQ ID NO: 26761)
DATRVIEEAKRILDEARKLNEETIRRSEELVRRIERVIEEIIKRSEKLLEDVARESK >2plus1_GFP11_Key_Cterm_21
                                         (SEQ ID NO: 26762)
SEELSAEVKKLLDEVRKALARHKDENDKLLKEIEDSLRRHKEENDRLLEKLKESTR >2plus1_GFP11_Key_Cterm_22
                                         (SEQ ID NO: 26763)
DAETVLRSAEDIVAKNRKLAEEVLRRVKKIVEENRKIASEVLDDVRKLVEDVLARAS >2plus1_GFP11_Key_Cterm_23
                                         (SEQ ID NO: 26764)
DADDVLARVEELAKRAHDENERLIREVEELVRAHNKRNKELVDEVKRLVEKVIEEER >2plus1_GFP11_Key_Cterm_24
                                         (SEQ ID NO: 26765)
SKELLEKAKAVVDEIKRLAEESLKRLEDLSRDHKRRAKELNDEIAKVVDELAKRAT >2plus1_GFP11_Key_Cterm_25
                                         (SEQ ID NO: 26766)
DEEVLKKLAEIVRRVKEENRKVNEEVEKRLRELEEENKKVIEDLKSTVEELVERLR >2plus1_GFP11_Key_Cterm_26
                                         (SEQ ID NO: 26767)
DEEVLKKLAEIVRRVKEENRKVNEEVEKRLRELEEENKKVIEDLKSTVEELVERLR >2plus1_GFP11_Key_Cterm_27
                                         (SEQ ID NO: 26768)
DKLLKEARDLIREIEKRLEELLKRVEKLTEDAKRDLERSNREHKELADRIKETAR >2plus1_GFP11_Key_Cterm_28
                                         (SEQ ID NO: 26769)
DKDSARELERIVKENAELAERVFREVEKIVRENTKLAEDSVRELKRLVEELKKRAK >2plus1_GFP11_Key_Cterm_29
                                         (SEQ ID NO: 26770)
SKEKIDRIIRELERILEEAKKKHEDVLRRLEDSLRRVAELLKAALDRLREIVDRLRR >2plus1_GFP11_Key_Cterm_30
                                         (SEQ ID NO: 26771)
DEEKLKDLIRKLRDILRRAAEAHKKLIDDARESLERAKREHEKLIDRLKKILEELER >2plus1_GFP11_Key_Cterm_31
                                         (SEQ ID NO: 26772)
DEVVKRVRDLLDTVRRRNEKVNEDVKRMNDKLRRDNEDVIRRVEKLLRELEEKRRT >2plus1_GFP11_Key_Cterm_32
                                         (SEQ ID NO: 26773)
DEEVLRTLEEIIRRLTKELEDVLREYERELRRLEEENKRVIDKTEEEIRRLADRLRR >2plus1_GFP11_Key_Cterm_33
                                         (SEQ ID NO: 26774)
DERILRELEERVKELEKEAREILKRSEDETDKLREKAERILEDLERANRRTMDEARR >2plus1_GFP11_Key_Cterm_34
                                         (SEQ ID NO: 26775)
SEELSAEVKKLLDEVRKALARHKDENDKLLKEIEDSLRRHKEENDRLLEKLKESTR >2plus1_GFP11_Key_Cterm_35
                                         (SEQ ID NO: 26776)
LPEEVLRELEELLKESEERIKRIEEEIKKIIDKSREDIKRVLEEIERLNAKAADDLRK >2plus1_GFP11_Key_Cterm_36
                                         (SEQ ID NO: 26777)
DADDVLARVEELAKRAHDENERLIREVEELVRAHNKRNKELVDEVKRLVEKVIEEER >2plus1_GFP11_Key_Cterm_37
                                         (SEQ ID NO: 26778)
DEEVLKKLAEIVRRVKEENRKVNEEVEKRLRELEEENKKVIEDLKSTVEELVERLR >2plus1_GFP11_Key_Cterm_38
                                         (SEQ ID NO: 26779)
DKLLKEARDLIREIEKRLEELLKRVEKLTEDAKRDLERSNREHKELADRIKETAR
```

```
>2plus1_GFP11_Key_Cterm_39
                                                 (SEQ ID NO: 26780)
DEEVLRTLEEIIRRLTKELEDVLREYERELRRLEEENKRVIDKTEEEIRRLADRLRR >2plus1_GFP11_Key_Cterm_40
                                                 (SEQ ID NO: 26781)
DRRIEKVLKEIEEKIREVIKEWERVHREVEELLKRLIDENRKVLDEIRKLLEEKSK >2plus1_GFP11_Key_Cterm_41
                                                 (SEQ ID NO: 26782)
DERILRELEERVKELEKEAREILKRSEDETDKLREKAERILEDLERANRRTMDEARR >2plus1_GFP11_Key_Cterm_42
                                                 (SEQ ID NO: 26783)
SEELSAEVKKLLDEVRKALARHKDENDKLLKEIEDSLRRHKEENDRLLEKLKESTR >2plus1_GFP11_Key_Cterm_43
                                                 (SEQ ID NO: 26784)
DEEVLKKLAEIVRRVKEENRKVNEEVEKRLRELEEENKKVIEDLKSTVEELVERLR >2plus1_GFP11_Key_Cterm_44
                                                 (SEQ ID NO: 26785)
SKEKIDRIIRELERILEEAKKKHEDVLRRLEDSLRRVAELLKAALDRLREIVDRLRR >2plus1_GFP11_Key_Cterm_45
                                                 (SEQ ID NO: 26786)
DRRIEKVLKEIEEKIREVIKEWERVHREVEELLKRLIDENRKVLDEIRKLLEEKSK >2plus1_GFP11_Key_Cterm_46
                                                 (SEQ ID NO: 26787)
TLRELARSIRKLSAENKERLKELLRELKKLSDENKERIKKLLSDAEKIIEDVARRAK >2plus1_GFP11_Key_Cterm_47
                                                 (SEQ ID NO: 26788)
DERILRELEERVKELEKEAREILKRSEDETDKLREKAERILEDLERANRRTMDEARR >2plus1_GFP11_Key_Cterm_48
                                                 (SEQ ID NO: 26789)
EKLKELRDVIAEVAKRIDELDEYTRESIRRAKKEIERLNRETKKVIEEVVKRIEEERK >2plus1_GFP11_Key_Cterm_49
                                                 (SEQ ID NO: 26790)
DERVREELKKLLTRVEEEHRKVLETDKKILKEAHKESKEVNDRDRELLERLEESVR >2plus1_GFP11_Key_Cterm_50
                                                 (SEQ ID NO: 26791)
DADDVLARVEELAKRAHDENERLIREVEELVRAHNKRNKELVDEVKRLVEKVIEEER >2plus1_GFP11_Key_Cterm_51
                                                 (SEQ ID NO: 26792)
TVKRLLDELRELLERLKRTIEELLKRNRDLLADAEEKARRLLEENRKLLKAARDTAT >2plus1_GFP11_Key_Cterm_52
                                                 (SEQ ID NO: 26793)
DEEVLKKLAEIVRRVKEENRKVNEEVEKRLRELEEENKKVIEDLKSTVEELVERLR >2plus1_GFP11_Key_Cterm_53
                                                 (SEQ ID NO: 26794)
SKEKIDRIIRELERILEEAKKKHEDVLRRLEDSLRRVAELLKAALDRLREIVDRLRR >2plus1_GFP11_Key_Cterm_54
                                                 (SEQ ID NO: 26795)
DERILRELEERVKELEKEAREILKRSEDETDKLREKAERILEDLERANRRTMDEARR >2plus1_GFP11_Key_Cterm_55
                                                 (SEQ ID NO: 26796)
DATRVIEEAKRILDEARKLNEETIRRSEELVRRIERVIEEIIKRSEKLLEDVARESK >2plus1_GFP11_Key_Cterm_56
                                                 (SEQ ID NO: 26797)
EAAREIIKRLREVNKRTKEKLDELIKHSEEVLERVKRLIDELRKHSEEVLEDLRRRAK >2plus1_GFP11_Key_Cterm_57
                                                 (SEQ ID NO: 26798)
EKLKELRDVIAEVAKRIDELDEYTRESIRRAKKEIERLNRETKKVIEEVVKRIEEERK >2plus1_GFP11_Key_Cterm_58
                                                 (SEQ ID NO: 26799)
ELLRRIKKLLDEIKKAIEDSSREIKRLLEESERVMKRSSEDIKRTLDDTRRVVEEVRR
```

-continued

```
>2plus1_GFP11_Key_Cterm_59
                                    (SEQ ID NO: 26800)
SKAIKDVRDIVKKVKDELKEWRDRNKELVDRLSEELKEWLKDVERVLKELTDKDR >2plus1_GFP11_Key_Cterm_60
                                    (SEQ ID NO: 26801)
DERVREELKKLLTRVEEEHRKVLETDKKILKEAHKESKEVNDRDRELLERLEESVR >2plus1_GFP11_Key_Cterm_61
                                    (SEQ ID NO: 26802)
DIDKLLKELRDLVEKIKKDLKELLERYEEIVRRIKELLKDLNREAEEVVRRLKEELR >2plus1_GFP11_Key_Cterm_62
                                    (SEQ ID NO: 26803)
DADDVLARVEELAKRAHDENERLIREVEELVRAHNKRNKELVDEVKRLVEKVIEEER >2plus1_GFP11_Key_Cterm_63
                                    (SEQ ID NO: 26804)
DEEVLKKLAEIVRRVKEENRKVNEEVEKRLRELEEENKKVIEDLKSTVEELVERLR >2plus1_GFP11_Key_Cterm_64
                                    (SEQ ID NO: 26805)
EREEELKEVADRVKEKLDRLNRENEKSSEELKRELDKINDENRETSERLKREIDETTR >2plus1_GFP11_Key_Cterm_65
                                    (SEQ ID NO: 26806)
SKEKIDRIIRELERILEEAKKKHEDVLRRLEDSLRRVAELLKAALDRLREIVDRLRR >2plus1_GFP11_Key_Cterm_66
                                    (SEQ ID NO: 26807)
SKEKIDRIIRELERILEEAKKKHEDVLRRLEDSLRRVAELLKAALDRLREIVDRLRR >2plus1_GFP11_Key_Cterm_67
                                    (SEQ ID NO: 26808)
TKDLLDENSKRSNEISREVKKDLERTVRENKKIVDEVAKALEDTVDKNRRIVEEVTT >2plus1_GFP11_Key_Cterm_68
                                    (SEQ ID NO: 26809)
DEVVKRVRDLLDTVRRRNEKVNEDVKRMNDKLRRDNEDVIRRVEKLLRELEEKRRT >2plus1_GFP11_Key_Cterm_69
                                    (SEQ ID NO: 26810)
DRRIEKVLKEIEEKIREVIKEWERVHREVEELLKRLIDENRKVLDEIRKLLEEKSK >2plus1_GFP11_Key_Cterm_70
                                    (SEQ ID NO: 26811)
ELLRRIKKLLDEIKKAIEDSSREIKRLLEESERVMKRSSEDIKRTLDDTRRVVEEVRR >2plus1_GFP11_Key_Cterm_71
                                    (SEQ ID NO: 26812)
SEELSAEVKKLLDEVRKALARHKDENDKLLKEIEDSLRRHKEENDRLLEKLKESTR >2plus1_GFP11_Key_Cterm_72
                                    (SEQ ID NO: 26813)
DIDKLLKELRDLVEKIKKDLKELLERYEEIVRRIKELLKDLNREAEEVVRRLKEELR >2plus1_GFP11_Key_Cterm_73
                                    (SEQ ID NO: 26814)
DADDVLARVEELAKRAHDENERLIREVEELVRAHNKRNKELVDEVKRLVEKVIEEER >2plus1_GFP11_Key_Cterm_74
                                    (SEQ ID NO: 26815)
DEEVLKKLAEIVRRVKEENRKVNEEVEKRLRELEEENKKVIEDLKSTVEELVERLR >2plus1_GFP11_Key_Cterm_75
                                    (SEQ ID NO: 26816)
DEEVLKKLAEIVRRVKEENRKVNEEVEKRLRELEEENKKVIEDLKSTVEELVERLR >2plus1_GFP11_Key_Cterm_76
                                    (SEQ ID NO: 26817)
SKEKIDRIIRELERILEEAKKKHEDVLRRLEDSLRRVAELLKAALDRLREIVDRLRR >2plus1_GFP11_Key_Cterm_77
                                    (SEQ ID NO: 26818)
SEELREELKKLERKIEKVAKEIHDHDKEVTERLEDLLRRITEHARKSDREIEETAR >2plus1_GFP11_Key_Cterm_78
                                    (SEQ ID NO: 26819)
DRRIEKVLKEIEEKIREVIKEWERVHREVEELLKRLIDENRKVLDEIRKLLEEKSK
```

-continued

```
>2plus1_GFP11_Key_Cterm_79
                                        (SEQ ID NO: 26820)
DATRVIEEAKRILDEARKLNEETIRRSEELVRRIERVIEEIIKRSEKLLEDVARESK >2plus1_GFP11_Key_Cterm_80
                                        (SEQ ID NO: 26821)
EKLKELRDVIAEVAKRIDELDEYTRESIRRAKKEIERLNRETKKVIEEVVKRIEEERK >2plus1_GFP11_Key_Cterm_81
                                        (SEQ ID NO: 26822)
ELLRRIKKLLDEIKKAIEDSSREIKRLLEESERVMKRSSEDIKRTLDDTRRVVEEVRR >2plus1_GFP11_Key_Cterm_82
                                        (SEQ ID NO: 26823)
DIDKLLKELRDLVEKIKKDLKELLERYEEIVRRIKELLKDLNREAEEVVRRLKEELR >2plus1_GFP11_Key_Cterm_83
                                        (SEQ ID NO: 26824)
EAKKKLDEVLERAKRTIDRLLETSDRSLEKVEADLRRLNEELDRSLERAERTIRELAK >2plus1_GFP11_Key_Cterm_84
                                        (SEQ ID NO: 26825)
DEEVLKKLAEIVRRVKEENRKVNEEVEKRLRELEEENKKVIEDLKSTVEELVERLR >2plus1_GFP11_Key_Cterm_85
                                        (SEQ ID NO: 26826)
DEEVLKKLAEIVRRVKEENRKVNEEVEKRLRELEEENKKVIEDLKSTVEELVERLR >2plus1_GFP11_Key_Cterm_86
                                        (SEQ ID NO: 26827)
DRRIEKVLKEIEEKIREVIKEWERVHREVEELLKRLIDENRKVLDEIRKLLEEKSK >2plus1_GFP11_Key_Cterm_87
                                        (SEQ ID NO: 26828)
DERILRELEERVKELEKEAREILKRSEDETDKLREKAERILEDLERANRRTMDEARR >2plus1_GFP11_Key_Cterm_88
                                        (SEQ ID NO: 26829)
DLKRVEERAREVSRRNEESMRRVKEDADRVSEANKEVLDRVREEVKRLIEEVRETLR >2plus1_GFP11_Key_Cterm_89
                                        (SEQ ID NO: 26830)
EKLKELRDVIAEVAKRIDELDEYTRESIRRAKKEIERLNRETKKVIEEVVKRIEEERK >2plus1_GFP11_Key_Cterm_90
                                        (SEQ ID NO: 26831)
ELLRRIKKLLDEIKKAIEDSSREIKRLLEESERVMKRSSEDIKRTLDDTRRVVEEVRR >2plus1_GFP11_Key_Cterm_91
                                        (SEQ ID NO: 26832)
ELLRRIKKLLDEIKKAIEDSSREIKRLLEESERVMKRSSEDIKRTLDDTRRVVEEVRR >2plus1_GFP11_Key_Cterm_92
                                        (SEQ ID NO: 26833)
LPEEVLRELEELLKESEERIKRIEEEIKKIIDKSREDIKRVLEEIERLNAKAADDLRK >2plus1_GFP11_Key_Cterm_93
                                        (SEQ ID NO: 26834)
EAKKKLDEVLERAKRTIDRLLETSDRSLEKVEADLRRLNEELDRSLERAERTIRELAK >2plus1_GFP11_Key_Cterm_94
                                        (SEQ ID NO: 26835)
DEEVLKKLAEIVRRVKEENRKVNEEVEKRLRELEEENKKVIEDLKSTVEELVERLR >2plus1_GFP11_Key_Cterm_95
                                        (SEQ ID NO: 26836)
DKLLKEARDLIREIEKRLEELLKRVEKLTEDAKRDLERSNREHKELADRIKETAR >2plus1_GFP11_Key_Cterm_96
                                        (SEQ ID NO: 26837)
DKLLKEARDLIREIEKRLEELLKRVEKLTEDAKRDLERSNREHKELADRIKETAR >2plus1_GFP11_Key_Cterm_97
                                        (SEQ ID NO: 26838)
DIVRKIERIVETIEREVRESVKKVEEIARDIRRKVDESVKNVEKLLRDVDKKARDRKK >2plus1_GFP11_Key_Cterm_98
                                        (SEQ ID NO: 26839)
DEIKRIVDEVRERLKRIVDENAKIVEDARRALEKIVKENEEILRRLKKELRELRK
```

-continued

>2plus1_GFP11_Key_Cterm_99
(SEQ ID NO: 26840)
DRRIEKVLKEIEEKIREVIKEWERVHREVEELLKRLIDENRKVLDEIRKLLEEKSK >2plus1_GFP11_Key_Cterm_100
(SEQ ID NO: 26841)
DLKRVEERAREVSRRNEESMRRVKEDADRVSEANKEVLDRVREEVKRLIEEVRETLR >2plus1_GFP11_Key_Cterm_101
(SEQ ID NO: 26842)
DATRVIEEAKRILDEARKLNEETIRRSEELVRRIERVIEEIIKRSEKLLEDVARESK >2plus1_GFP11_Key_Cterm_102
(SEQ ID NO: 26843)
DAETIERVVRELLEENKEVLRKTEEAVKRSTETNKRLLEASKEVADRLRERIKEAAK >2plus1_GFP11_Key_Cterm_103
(SEQ ID NO: 26844)
EKLKELRDVIAEVAKRIDELDEYTRESIRRAKKEIERLNRETKKVIEEVVKRIEEERK >2plus1_GFP11_Key_Cterm_104
(SEQ ID NO: 26845)
ELLRRIKKLLDEIKKAIEDSSREIKRLLEESERVMKRSSEDIKRTLDDTRRVVEEVRR >2plus1_GFP11_Key_Cterm_105
(SEQ ID NO: 26846)
DEVVERAERISEENKRRVEDVARKSKELVEDVRRHSEEVVRRVEELVKEVEERVR >2plus1_GFP11_Key_Cterm_106
(SEQ ID NO: 26847)
EAKKKLDEVLERAKRTIDRLLETSDRSLEKVEADLRRLNEELDRSLERAERTIRELAK >2plus1_GFP11_Key_Cterm_107
(SEQ ID NO: 26848)
TAERARETLKRLLDENRDRSKKVKEEIRRILEDLTRTTERVKREIAKLLKELEDTAR >2plus1_GFP11_Key_Cterm_108
(SEQ ID NO: 26849)
EAVRRLKEILERLKEEVRRSLEELRKEVERLKKEVEDSLRELKKSLEEWVKSLEEATR >2plus1_GFP11_Key_Cterm_109
(SEQ ID NO: 26850)
DERILRELEERVKELEKEAREILKRSEDETDKLREKAERILEDLERANRRTMDEARR >2plus1_GFP11_Key_Cterm_110
(SEQ ID NO: 26851)
DATRVIEEAKRILDEARKLNEETIRRSEELVRRIERVIEEIIKRSEKLLEDVARESK >2plus1_GFP11_Key_Cterm_111
(SEQ ID NO: 26852)
DKARKVAEVAEKVLRDIDKLDRESKEAFRATNEEIAKLDEDTARVAERVKKAIEDLAK >2plus1_GFP11_Key_Cterm_112
(SEQ ID NO: 26853)
EKLKELRDVIAEVAKRIDELDEYTRESIRRAKKEIERLNRETKKVIEEVVKRIEEERK >2plus1_GFP11_Key_Cterm_113
(SEQ ID NO: 26854)
ELLRRIKKLLDEIKKAIEDSSREIKRLLEESERVMKRSSEDIKRTLDDTRRVVEEVRR >2plus1_GFP11_Key_Cterm_114
(SEQ ID NO: 26855)
DKVERVVREVEKLHEEDRKRLEESTRSVRKLLEELKRELEKSTRSVKALVDELRERVR >2plus1_GFP11_Key_Cterm_115
(SEQ ID NO: 26856)
DEVVERAERISEENKRRVEDVARKSKELVEDVRRHSEEVVRRVEELVKEVEERVR >2plus1_GFP11_Key_Cterm_116
(SEQ ID NO: 26857)
EAKKKLDEVLERAKRTIDRLLETSDRSLEKVEADLRRLNEELDRSLERAERTIRELAK >2plus1_GFP11_Key_Cterm_117
(SEQ ID NO: 26858)
TAERARETLKRLLDENRDRSKKVKEEIRRILEDLTRTTERVKREIAKLLKELEDTAR >2plus1_GFP11_Key_Cterm_118
(SEQ ID NO: 26859)
DERILRELEERVKELEKEAREILKRSEDETDKLREKAERILEDLERANRRTMDEARR -continued >2plus1_GFP11_Key_Cterm_119
(SEQ ID NO: 26860)
DERILRELEERVKELEKEAREILKRSEDETDKLREKAERILEDLERANRRTMDEARR >2plus1_GFP11_Key_Cterm_120
(SEQ ID NO: 26861)
DLKRVEERAREVSRRNEESMRRVKEDADRVSEANKEVLDRVREEVKRLIEEVRETLR >2plus1_GFP11_Key_Cterm_121
(SEQ ID NO: 26862)
DKARKVAEVAEKVLRDIDKLDRESKEAFRATNEEIAKLDEDTARVAERVKKAIEDLAK >2plus1_GFP11_Key_Cterm_122
(SEQ ID NO: 26863)
ELLRRIKKLLDEIKKAIEDSSREIKRLLEESERVMKRSSEDIKRTLDDTRRVVEEVRR >2plus1_GFP11_Key_Cterm_123
(SEQ ID NO: 26864)
SKAIKDVRDIVKKVKDELKEWRDRNKELVDRLSEELKEWLKDVERVLKELTDKDR >2plus1_GFP11_Key_Cterm_124
(SEQ ID NO: 26865)
DKVERVVREVEKLHEEDRKRLEESTRSVRKLLEELKRELEKSTRSVKALVDELRERVR >2plus1_GFP11_Key_Cterm_125
(SEQ ID NO: 26866)
DIDKLLKELRDLVEKIKKDLKELLERYEEIVRRIKELLKDLNREAEEVVRRLKEELR >2plus1_GFP11_Key_Cterm_126
(SEQ ID NO: 26867)
EAKKKLDEVLERAKRTIDRLLETSDRSLEKVEADLRRLNEELDRSLERAERTIRELAK >2plus1_GFP11_Key_Cterm_127
(SEQ ID NO: 26868)
DKLLKEARDLIREIEKRLEELLKRVEKLTEDAKRDLERSNREHKELADRIKETAR >2plus1_GFP11_Key_Cterm_128
(SEQ ID NO: 26869)
TAERARETLKRLLDENRDRSKKVKEEIRRILEDLTRTTERVKREIAKLLKELEDTAR >2plus1_GFP11_Key_Cterm_129
(SEQ ID NO: 26870)
DEIKRIVDEVRERLKRIVDENAKIVEDARRALEKIVKENEEILRRLKKELRELRK >2plus1_GFP11_Key_Cterm_130
(SEQ ID NO: 26871)
DRIEEELKRLIDTLREKNREVEKRARDSNRDLKRTNDEIAKEVRELIKKLREDLK >2plus1_GFP11_Key_Cterm_131
(SEQ ID NO: 26872)
DERILRELEERVKELEKEAREILKRSEDETDKLREKAERILEDLERANRRTMDEARR >2plus1_GFP11_Key_Cterm_132
(SEQ ID NO: 26873)
DAETIERVVRELLEENKEVLRKTEEAVKRSTETNKRLLEASKEVADRLRERIKEAAK >2plus1_GFP11_Key_Cterm_133
(SEQ ID NO: 26874)
DKARKVAEVAEKVLRDIDKLDRESKEAFRATNEEIAKLDEDTARVAERVKKAIEDLAK >2plus1_GFP11_Key_Cterm_134
(SEQ ID NO: 26875)
DKVERVVREVEKLHEEDRKRLEESTRSVRKLLEELKRELEKSTRSVKALVDELRERVR >2plus1_GFP11_Key_Cterm_135
(SEQ ID NO: 26876)
DIERILRELEAVLKKLTDESERLNREVERVSRDTKKKSKELNEELKAVLDEVKRKAD >2plus1_GFP11_Key_Cterm_136
(SEQ ID NO: 26877)
DEVVERAERISEENKRRVEDVARKSKELVEDVRRHSEEVVRRVEELVKEVEERVR >2plus1_GFP11_Key_Cterm_137
(SEQ ID NO: 26878)
EAKKKLDEVLERAKRTIDRLLETSDRSLEKVEADLRRLNEELDRSLERAERTIRELAK >2plus1_GFP11_Key_Cterm_138
(SEQ ID NO: 26879)
TAERARETLKRLLDENRDRSKKVKEEIRRILEDLTRTTERVKREIAKLLKELEDTAR -continued >2plus1_GFP11_Key_Cterm_139
(SEQ ID NO: 26880)
DEIKRIVDEVRERLKRIVDENAKIVEDARRALEKIVKENEEILRRLKKELRELRK >2plus1_GFP11_Key_Cterm_140
(SEQ ID NO: 26881)
DRRIEKVLKEIEEKIREVIKEWERVHREVEELLKRLIDENRKVLDEIRKLLEEKSK >2plus1_GFP11_Key_Cterm_141
(SEQ ID NO: 26882)
DLKRVEERAREVSRRNEESMRRVKEDADRVSEANKEVLDRVREEVKRLIEEVRETLR >2plus1_GFP11_Key_Cterm_142
(SEQ ID NO: 26883)
DAETIERVVRELLEENKEVLRKTEEAVKRSTETNKRLLEASKEVADRLRERIKEAAK >2plus1_GFP11_Key_Cterm_143
(SEQ ID NO: 26884)
DKARKVAEVAEKVLRDIDKLDRESKEAFRATNEEIAKLDEDTARVAERVKKAIEDLAK >2plus1_GFP11_Key_Cterm_144
(SEQ ID NO: 26885)
ELLRRIKKLLDEIKKAIEDSSREIKRLLEESERVMKRSSEDIKRTLDDTRRVVEEVRR >2plus1_GFP11_Key_Cterm_145
(SEQ ID NO: 26886)
DKVERVVREVEKLHEEDRKRLEESTRSVRKLLEELKRELEKSTRSVKALVDELRERVR >2plus1_GFP11_Key_Cterm_146
(SEQ ID NO: 26887)
EAKKKLDEVLERAKRTIDRLLETSDRSLEKVEADLRRLNEELDRSLERAERTIRELAK >2plus1_GFP11_Key_Cterm_147
(SEQ ID NO: 26888)
TAERARETLKRLLDENRDRSKKVKEEIRRILEDLTRTTERVKREIAKLLKELEDTAR >2plus1_GFP11_Key_Cterm_148
(SEQ ID NO: 26889)
DEIKRIVDEVRERLKRIVDENAKIVEDARRALEKIVKENEEILRRLKKELRELRK >2plus1_GFP11_Key_Cterm_149
(SEQ ID NO: 26890)
DKARKVAEVAEKVLRDIDKLDRESKEAFRATNEEIAKLDEDTARVAERVKKAIEDLAK >2plus1_GFP11_Key_Cterm_150
(SEQ ID NO: 26891)
DEVTKVKKVADDVLAEIKKLDDETRRVIEDTNKKIADLDKATRDVVRKVLEEVKKLEK >2plus1_GFP11_Key_Cterm_151
(SEQ ID NO: 26892)
DIDKLLKELRDLVEKIKKDLKELLERYEEIVRRIKELLKDLNREAEEVVRRLKEELR >2plus1_GFP11_Key_Cterm_152
(SEQ ID NO: 26893)
TAERARETLKRLLDENRDRSKKVKEEIRRILEDLTRTTERVKREIAKLLKELEDTAR >2plus1_GFP11_Key_Cterm_153
(SEQ ID NO: 26894)
DEIKRIVDEVRERLKRIVDENAKIVEDARRALEKIVKENEEILRRLKKELRELRK >2plus1_GFP11_Key_Cterm_154
(SEQ ID NO: 26895)
RLVREVEDLVRRLVRRSEKSNEEVKRTVEELVRRMEESNDRVRDLVRRLVEELKRAVD >2plus1_GFP11_Key_Cterm_155
(SEQ ID NO: 26896)
DKARKVAEVAEKVLRDIDKLDRESKEAFRATNEEIAKLDEDTARVAERVKKAIEDLAK >2plus1_GFP11_Key_Cterm_156
(SEQ ID NO: 26897)
EAKKKLDEVLERAKRTIDRLLETSDRSLEKVEADLRRLNEELDRSLERAERTIRELAK >2plus1_GFP11_Key_Cterm_157
(SEQ ID NO: 26898)
RLVREVEDLVRRLVRRSEKSNEEVKRTVEELVRRMEESNDRVRDLVRRLVEELKRAVD >2plus1_GFP11_Key_Cterm_158
(SEQ ID NO: 26899)
DKARKVAEVAEKVLRDIDKLDRESKEAFRATNEEIAKLDEDTARVAERVKKAIEDLAK

```
>2plus1_GFP11_Key_Cterm_159
                                               (SEQ ID NO: 26900)
DEVTKVKKVADDVLAEIKKLDDETRRVIEDTNKKIADLDKATRDVVRKVLEEVKKLEK >2plus1_GFP11_Key_Cterm_160
                                               (SEQ ID NO: 26901)
TAERARETLKRLLDENRDRSKKVKEEIRRILEDLTRTTERVKREIAKLLKELEDTAR >2plus1_GFP11_Key_Cterm_161
                                               (SEQ ID NO: 26902)
DLKRVEERAREVSRRNEESMRRVKEDADRVSEANKEVLDRVREEVKRLIEEVRETLR >2plus1_GFP11_Key_Cterm_162
                                               (SEQ ID NO: 26903)
DKARKVAEVAEKVLRDIDKLDRESKEAFRATNEEIAKLDEDTARVAERVKKAIEDLAK >2plus1_GFP11_Key_Cterm_163
                                               (SEQ ID NO: 26904)
DEVTKVKKVADDVLAEIKKLDDETRRVIEDTNKKIADLDKATRDVVRKVLEEVKKLEK >2plus1_GFP11_Key_Cterm_164
                                               (SEQ ID NO: 26905)
DKVERVVREVEKLHEEDRKRLEESTRSVRKLLEELKRELEKSTRSVKALVDELRERVR >2plus1_GFP11_Key_Cterm_165
                                               (SEQ ID NO: 26906)
EAKKKLDEVLERAKRTIDRLLETSDRSLEKVEADLRRLNEELDRSLERAERTIRELAK >2plus1_GFP11_Key_Cterm_166
                                               (SEQ ID NO: 26907)
TAERARETLKRLLDENRDRSKKVKEEIRRILEDLTRTTERVKREIAKLLKELEDTAR >2plus1_GFP11_Key_Cterm_167
                                               (SEQ ID NO: 26908)
TAERARETLKRLLDENRDRSKKVKEEIRRILEDLTRTTERVKREIAKLLKELEDTAR >2plus1_GFP11_Key_Cterm_168
                                               (SEQ ID NO: 26909)
DKARKVAEVAEKVLRDIDKLDRESKEAFRATNEEIAKLDEDTARVAERVKKAIEDLAK >2plus1_GFP11_Key_Cterm_169
                                               (SEQ ID NO: 26910)
DEVTKVKKVADDVLAEIKKLDDETRRVIEDTNKKIADLDKATRDVVRKVLEEVKKLEK >2plus1_GFP11_Key_Cterm_170
                                               (SEQ ID NO: 26911)
DKVERVVREVEKLHEEDRKRLEESTRSVRKLLEELKRELEKSTRSVKALVDELRERVR >2plus1_GFP11_Key_Cterm_171
                                               (SEQ ID NO: 26912)
TAERARETLKRLLDENRDRSKKVKEEIRRILEDLTRTTERVKREIAKLLKELEDTAR >2plus1_GFP11_Key_Cterm_172
                                               (SEQ ID NO: 26913)
DKARKVAEVAEKVLRDIDKLDRESKEAFRATNEEIAKLDEDTARVAERVKKAIEDLAK >2plus1_GFP11_Key_Cterm_173
                                               (SEQ ID NO: 26914)
RLVREVEDLVRRLVRRSEKSNEEVKRTVEELVRRMEESNDRVRDLVRRLVEELKRAVD >2plus1_GFP11_Key_Nterm_174
                                               (SEQ ID NO: 26915)
SESDEVIRDLARLLDELARHVDDSVRRMDEVVKRSTREADELAKRLDELVKEVEKKPG >2plus1_GFP11_Key_Nterm_175
                                               (SEQ ID NO: 26916)
SRAETVLKEVTDKIKKLADSSDELLRRNKENIDELKKSSEELLRRLTKAIEEIEKGSV >2plus1_GFP11_Key_Nterm_176
                                               (SEQ ID NO: 26917)
SVDEVLKEIEDALRRLKEEVERVLKENEDELRRLEEEVRRVLKEDEELLESLKRGVGE >2plus1_GFP11_Key_Nterm_177
                                               (SEQ ID NO: 26918)
SEVDEIIKELERLLAEIARENERIIRESRKLADEVRKRNEDAIRKLEELVARLADAVR >2plus1_GFP11_Key_Nterm_178
                                               (SEQ ID NO: 26919)
SEVDDVLRRLEELIKTLEDINAKSLEDIKKLIDDLAKILEDALRKHEKLIRELREAKK
```

-continued

```
>2plus1_GFP11_Key_Nterm_179
                                           (SEQ ID NO: 26920)
SEVDDVLRRLEELIKTLEDINAKSLEDIKKLIDDLAKILEDALRKHEKLIRELREAKK >2plus1_GFP11_Key_Nterm_180
                                           (SEQ ID NO: 26921)
SRAETVLKEVTDKIKKLADSSDELLRRNKENIDELKKSSEELLRRLTKAIEEIEKGSV >2plus1_GFP11_Key_Nterm_181
                                           (SEQ ID NO: 26922)
KEVEDAVKELEDLLRANEDKTRSIVEDMRASNKDLEDHSRASEEEVRKLLDDLRRAGV >2plus1_GFP11_Key_Nterm_182
                                           (SEQ ID NO: 26923)
SEVDDVLRRLEELIKTLEDINAKSLEDIKKLIDDLAKILEDALRKHEKLIRELREAKK >2plus1_GFP11_Key_Nterm_183
                                           (SEQ ID NO: 26924)
SESDEVIRDLARLLDELARHVDDSVRRMDEVVKRSTREADELAKRLDELVKEVEKKPG >2plus1_GFP11_Key_Nterm_184
                                           (SEQ ID NO: 26925)
SESDDVIRKLRELLEELRTHVEKSIRDLRKILEDSTRHAKRSIEELERLLEEVRKKPG >2plus1_GFP11_Key_Nterm_185
                                           (SEQ ID NO: 26926)
SRAETVLKEVTDKIKKLADSSDELLRRNKENIDELKKSSEELLRRLTKAIEEIEKGSV >2plus1_GFP11_Key_Nterm_186
                                           (SEQ ID NO: 26927)
SEAEKAKETIDRLADRVRKLLEEIKRSLDDSRRKSKETVEENEKTLDRMRKEVDAAKR >2plus1_GFP11_Key_Nterm_187
                                           (SEQ ID NO: 26928)
SEAEKAKETIDRLADRVRKLLEEIKRSLDDSRRKSKETVEENEKTLDRMRKEVDAAKR >2plus1_GFP11_Key_Nterm_188
                                           (SEQ ID NO: 26929)
SEVEELIKRLAKVLKELVDKVRKVIEDTKELLERLKRRSEDHIRKLREVLKEAKDQPI >2plus1_GFP11_Key_Nterm_189
                                           (SEQ ID NO: 26930)
SELEEIEKKVRELTKRHRELVERVRKTVKELIETNRRLLETLTERIKRVLEEVRDLER >2plus1_GFP11_Key_Nterm_190
                                           (SEQ ID NO: 26931)
SSEERLRAVIEDLKRLAEESRKRHKELIDELAKAVERIERRHKKLLDEIKAVVDDIRR >2plus1_GFP11_Key_Nterm_191
                                           (SEQ ID NO: 26932)
DEIRKVVKEITDLLKASNDKNRKVVEEIRDLLRKSKKLADELVERLRALVEDLRRRID >2plus1_GFP11_Key_Nterm_192
                                           (SEQ ID NO: 26933)
STAETVAEEVERVLKHSDDLIKEVEDVNRRVEEEIKRVIRELEEENERLVAEVRKGVK >2plus1_GFP11_Key_Nterm_193
                                           (SEQ ID NO: 26934)
SEVDEIIKELERLLAEIARENERIIRESRKLADEVRKRNEDAIRKLEELVARLADAVR >2plus1_GFP11_Key_Nterm_194
                                           (SEQ ID NO: 26935)
SEIDEVLTRLRKISKDLNETSDRVNERARKIIDDIKKESKRVNDEAREIVERLKREID >2plus1_GFP11_Key_Nterm_195
                                           (SEQ ID NO: 26936)
SEDEDLDRVAEKLAREHKKSVEEIKRVLKSADEESKKLVRDTERVIEEIKREVEEARR >2plus1_GFP11_Key_Nterm_196
                                           (SEQ ID NO: 26937)
SSVEELLERLRRISEENKRRIEKLLREVEKVLRELKDRHRKLLKRVEEIIRKVKEEIK >2plus1_GFP11_Key_Nterm_197
                                           (SEQ ID NO: 26938)
SAADEVVERMKELVATVKRENDEVVKELKKLVKELEDDNRRVVEESKKSVEDLARRVG >2plus1_GFP11_Key_Nterm_198
                                           (SEQ ID NO: 26939)
SESDEVIRDLARLLDELARHVDDSVRRMDEVVKRSTREADELAKRLDELVKEVEKKPG
```

```
>2plus1_GFP11_Key_Nterm_199
                                          (SEQ ID NO: 26940)
KEVEDAVKELEDLLRANEDKTRSIVEDMRASNKDLEDHSRASEEEVRKLLDDLRRAGV >2plus1_GFP11_Key_Nterm_200
                                          (SEQ ID NO: 26941)
DEIRKVVKEITDLLKASNDKNRKVVEEIRDLLRKSKKLADELVERLRALVEDLRRRID >2plus1_GFP11_Key_Nterm_201
                                          (SEQ ID NO: 26942)
SRVEEIIEDLRRLLEEIRKENEDSIRRSKELLDRVKEINDTIIAELERLLKDIEKEVR >2plus1_GFP11_Key_Nterm_202
                                          (SEQ ID NO: 26943)
SRVEEIIEDLRRLLEEIRKENEDSIRRSKELLDRVKEINDTIIAELERLLKDIEKEVR >2plus1_GFP11_Key_Nterm_203
                                          (SEQ ID NO: 26944)
SEVDDVLRRLEELIKTLEDINAKSLEDIKKLIDDLAKILEDALRKHEKLIRELREAKK >2plus1_GFP11_Key_Nterm_204
                                          (SEQ ID NO: 26945)
SKLEEVEKAVRKVIEDSRRVNEEVNRRSEEVVRELEKVHREVNDASRRVVEKARRVLK >2plus1_GFP11_Key_Nterm_205
                                          (SEQ ID NO: 26946)
SESDEVIRDLARLLDELARHVDDSVRRMDEVVKRSTREADELAKRLDELVKEVEKKPG >2plus1_GFP11_Key_Nterm_206
                                          (SEQ ID NO: 26947)
SESDEVIRDLARLLDELARHVDDSVRRMDEVVKRSTREADELAKRLDELVKEVEKKPG >2plus1_GFP11_Key_Nterm_207
                                          (SEQ ID NO: 26948)
SESDDVIRKLRELLEELRTHVEKSIRDLRKILEDSTRHAKRSIEELERLLEEVRKKPG >2plus1_GFP11_Key_Nterm_208
                                          (SEQ ID NO: 26949)
DEVRELLERNRRLLEEIKKTVKDLIRANEELLKRIEDDAKRLIDRNEELLDELEKGLS >2plus1_GFP11_Key_Nterm_209
                                          (SEQ ID NO: 26950)
DEIRKVVKEITDLLKASNDKNRKVVEEIRDLLRKSKKLADELVERLRALVEDLRRRID >2plus1_GFP11_Key_Nterm_210
                                          (SEQ ID NO: 26951)
SRAETVLKEVTDKIKKLADSSDELLRRNKENIDELKKSSEELLRRLTKAIEEIEKGSV >2plus1_GFP11_Key_Nterm_211
                                          (SEQ ID NO: 26952)
DEEEDLERAIKKLLDENRELLKRIAEELRRLLEELRRLTEESADRLRRLLKELKDRGV >2plus1_GFP11_Key_Nterm_212
                                          (SEQ ID NO: 26953)
DEIRKVVKEITDLLKASNDKNRKVVEEIRDLLRKSKKLADELVERLRALVEDLRRRID >2plus1_GFP11_Key_Nterm_213
                                          (SEQ ID NO: 26954)
SKEDRLREELKKLLARLAEEIERLKRALEESNKDLKRTIDASEKHLRDVNEDVKRGGV >2plus1_GFP11_Key_Nterm_214
                                          (SEQ ID NO: 26955)
SESDEVIRDLARLLDELARHVDDSVRRMDEVVKRSTREADELAKRLDELVKEVEKKPG >2plus1_GFP11_Key_Nterm_215
                                          (SEQ ID NO: 26956)
SESDEVIRDLARLLDELARHVDDSVRRMDEVVKRSTREADELAKRLDELVKEVEKKPG >2plus1_GFP11_Key_Nterm_216
                                          (SEQ ID NO: 26957)
SESDDVIRKLRELLEELRTHVEKSIRDLRKILEDSTRHAKRSIEELERLLEEVRKKPG >2plus1_GFP11_Key_Nterm_217
                                          (SEQ ID NO: 26958)
SRVEEIIEDLRRLLEEIRKENEDSIRRSKELLDRVKEINDTIIAELERLLKDIEKEVR >2plus1_GFP11_Key_Nterm_218
                                          (SEQ ID NO: 26959)
SEVDEIIKELERLLAEIARENERIIRESRKLADEVRKRNEDAIRKLEELVARLADAVR
```

-continued

>2plus1_GFP11_Key_Nterm_219
(SEQ ID NO: 26960)
SSVEELLERLRRISEENKRRIEKLLREVEKVLRELKDRHRKLLKRVEEIIRKVKEEIK >2plus1_GFP11_Key_Nterm_220
(SEQ ID NO: 26961)
SELEEVLRRIEALVRKAHKENEDVLREIERLVRTAHRLNKKVDDDSAKIAEDLKRGGR >2plus1_GFP11_Key_Nterm_221
(SEQ ID NO: 26962)
SESDEVIRDLARLLDELARHVDDSVRRMDEVVKRSTREADELAKRLDELVKEVEKKPG >2plus1_GFP11_Key_Nterm_222
(SEQ ID NO: 26963)
SESDDVIRKLRELLEELRTHVEKSIRDLRKILEDSTRHAKRSIEELERLLEEVRKKPG >2plus1_GFP11_Key_Nterm_223
(SEQ ID NO: 26964)
SRAETVLKEVTDKIKKLADSSDELLRRNKENIDELKKSSEELLRRLTKAIEEIEKGSV >2plus1_GFP11_Key_Nterm_224
(SEQ ID NO: 26965)
DEVRELLERNRRLLEEIKKTVKDLIRANEELLKRIEDDAKRLIDRNEELLDELEKGLS >2plus1_GFP11_Key_Nterm_225
(SEQ ID NO: 26966)
STEEVLDEIRKLHKTLTEDIKRVLREIEELHRRTIEENKEVLDKIAEDYKRVIDDVRT >2plus1_GFP11_Key_Nterm_226
(SEQ ID NO: 26967)
SEIEKILKEIEDLARRDEEVSKKIVEDIRRLAKEVEDTSRDIVRKIEELAKRVLDRLR >2plus1_GFP11_Key_Nterm_227
(SEQ ID NO: 26968)
SEAERLEARARELLRANEELMDDLRAKAEELLKRNDRLVKEIEKKVREVLAAIEELKR >2plus1_GFP11_Key_Nterm_228
(SEQ ID NO: 26969)
DDLERAREEVADLIRKHEEKTRRILEESRRLNERHRELSARILDEIRKLAERIEELIK >2plus1_GFP11_Key_Nterm_229
(SEQ ID NO: 26970)
DEEEDLERAIKKLLDENRELLKRIAEELRRLLEELRRLTEESADRLRRLLKELKDRGV >2plus1_GFP11_Key_Nterm_230
(SEQ ID NO: 26971)
DEIRKVVKEITDLLKASNDKNRKVVEEIRDLLRKSKKLADELVERLRALVEDLRRRID >2plus1_GFP11_Key_Nterm_231
(SEQ ID NO: 26972)
DEIRKVVKEITDLLKASNDKNRKVVEEIRDLLRKSKKLADELVERLRALVEDLRRRID >2plus1_GFP11_Key_Nterm_232
(SEQ ID NO: 26973)
STAETVEKKVEEVIRENEKSMRESEEKVDRSTKRIEDVLRRLEETIRKTSDDIAKGVK >2plus1_GFP11_Key_Nterm_233
(SEQ ID NO: 26974)
SRVEEIIEDLRRLLEEIRKENEDSIRRSKELLDRVKEINDTIIAELERLLKDIEKEVR >2plus1_GFP11_Key_Nterm_234
(SEQ ID NO: 26975)
SRVEEIIEDLRRLLEEIRKENEDSIRRSKELLDRVKEINDTIIAELERLLKDIEKEVR >2plus1_GFP11_Key_Nterm_235
(SEQ ID NO: 26976)
REVEEMIKELEELLKDLKEKNERASKRNRELVRRLEEENKRVIEELKKLVKELEDLVR >2plus1_GFP11_Key_Nterm_236
(SEQ ID NO: 26977)
SEVDDVLRRLEELIKTLEDINAKSLEDIKKLIDDLAKILEDALRKHEKLIRELREAKK >2plus1_GFP11_Key_Nterm_237
(SEQ ID NO: 26978)
SKLEEVEKAVRKVIEDSRRVNEEVNRRSEEVVRELEKVHREVNDASRRVVEKARRVLK >2plus1_GFP11_Key_Nterm_238
(SEQ ID NO: 26979)
DEVEDVLRKIEKILDDHRKRIEKNSRDMARIIDEHRRKVEENSREMKKLVDDLKKAVD -continued >2plus1_GFP11_Key_Nterm_239
(SEQ ID NO: 26980)
SSVEELLERLRRISEENKRRIEKLLREVEKVLRELKDRHRKLLKRVEEIIRKVKEEIK >2plus1_GFP11_Key_Nterm_240
(SEQ ID NO: 26981)
DEVEKVLEEIKRALDDLRKKVEESKREIKEALKAVEKHTRDSDTANKRTLAEIERGVK >2plus1_GFP11_Key_Nterm_241
(SEQ ID NO: 26982)
SESDEVIRDLARLLDELARHVDDSVRRMDEVVKRSTREADELAKRLDELVKEVEKKPG >2plus1_GFP11_Key_Nterm_242
(SEQ ID NO: 26983)
KEVEDAVKELEDLLRANEDKTRSIVEDMRASNKDLEDHSRASEEEVRKLLDDLRRAGV >2plus1_GFP11_Key_Nterm_243
(SEQ ID NO: 26984)
DEIRKVVKEITDLLKASNDKNRKVVEEIRDLLRKSKKLADELVERLRALVEDLRRRID >2plus1_GFP11_Key_Nterm_244
(SEQ ID NO: 26985)
STAETVAEEVERVLKHSDDLIKEVEDVNRRVEEEIKRVIRELEEENERLVAEVRKGVK >2plus1_GFP11_Key_Nterm_245
(SEQ ID NO: 26986)
SRVEEIIEDLRRLLEEIRKENEDSIRRSKELLDRVKEINDTIIAELERLLKDIEKEVR >2plus1_GFP11_Key_Nterm_246
(SEQ ID NO: 26987)
SEVDEIIKELERLLAEIARENERIIRESRKLADEVRKRNEDAIRKLEELVARLADAVR >2plus1_GFP11_Key_Nterm_247
(SEQ ID NO: 26988)
SEVDDVLRRLEELIKTLEDINAKSLEDIKKLIDDLAKILEDALRKHEKLIRELREAKK >2plus1_GFP11_Key_Nterm_248
(SEQ ID NO: 26989)
SKLEEVEKAVRKVIEDSRRVNEEVNRRSEEVVRELEKVHREVNDASRRVVEKARRVLK >2plus1_GFP11_Key_Nterm_249
(SEQ ID NO: 26990)
SAEEVKEELKRIATKLKEEIKENIRRLEESVEKIAKELAENIKRLEDILRDVKRGLRD >2plus1_GFP11_Key_Nterm_250
(SEQ ID NO: 26991)
SDVDRVLEEIRKLLEDLKRHSEKVSEENEDLLRANTELNKRVSEDNERLLEELKRLRE >2plus1_GFP11_Key_Nterm_251
(SEQ ID NO: 26992)
DEVEDVLRKIEKILDDHRKRIEKNSRDMARIIDEHRRKVEENSREMKKLVDDLKKAVD >2plus1_GFP11_Key_Nterm_252
(SEQ ID NO: 26993)
SSVEELLERLRRISEENKRRIEKLLREVEKVLRELKDRHRKLLKRVEEIIRKVKEEIK >2plus1_GFP11_Key_Nterm_253
(SEQ ID NO: 26994)
DREREVKKRLDEVRERIERLLRRVEEESRRVAEEIRRLIEEVRRRNKKVTEEIRELLK >2plus1_GFP11_Key_Nterm_254
(SEQ ID NO: 26995)
SRAETVLKEVTDKIKKLADSSDELLRRNKENIDELKKSSEELLRRLTKAIEEIEKGSV >2plus1_GFP11_Key_Nterm_255
(SEQ ID NO: 26996)
SEIEKILKEIEDLARRDEEVSKKIVEDIRRLAKEVEDTSRDIVRKIEELAKRVLDRLR >2plus1_GFP11_Key_Nterm_256
(SEQ ID NO: 26997)
SEAEKAKETIDRLADRVRKLLEEIKRSLDDSRRKSKETVEENEKTLDRMRKEVDAAKR >2plus1_GFP11_Key_Nterm_257
(SEQ ID NO: 26998)
SEVEELIKRLAKVLKELVDKVRKVIEDTKELLERLKRRSEDHIRKLREVLKEAKDQPI >2plus1_GFP11_Key_Nterm_258
(SEQ ID NO: 26999)
DEIRKVVKEITDLLKASNDKNRKVVEEIRDLLRKSKKLADELVERLRALVEDLRRRID -continued >2plus1_GFP11_Key_Nterm_259
(SEQ ID NO: 27000)
DEIRKVVKEITDLLKASNDKNRKVVEEIRDLLRKSKKLADELVERLRALVEDLRRRID >2plus1_GFP11_Key_Nterm_260
(SEQ ID NO: 27001)
STAETVEKKVEEVIRENEKSMRESEEKVDRSTKRIEDVLRRLEETIRKTSDDIAKGVK >2plus1_GFP11_Key_Nterm_261
(SEQ ID NO: 27002)
SRVEEIIEDLRRLLEEIRKENEDSIRRSKELLDRVKEINDTIIAELERLLKDIEKEVR >2plus1_GFP11_Key_Nterm_262
(SEQ ID NO: 27003)
REVEEMIKELEELLKDLKEKNERASKRNRELVRRLEEENKRVIEELKKLVKELEDLVR >2plus1_GFP11_Key_Nterm_263
(SEQ ID NO: 27004)
DAVEEAEKLIRKVIADSEKLLRDLADLNAKSIRRSEKLVEDDRRANEDVIRKLEELRR >2plus1_GFP11_Key_Nterm_264
(SEQ ID NO: 27004)
SEVDDVLRRLEELIKTLEDINAKSLEDIKKLIDDLAKILEDALRKHEKLIRELREAKK >2plus1_GFP11_Key_Nterm_265
(SEQ ID NO: 27006)
SEIERVKKRLEELLAEVEESTRRLEERLKRLLEEAKRSSEEVEKELRRLLEAVRRGLS >2plus1_GFP11_Key_Nterm_266
(SEQ ID NO: 27007)
SDVDRVLEEIRKLLEDLKRHSEKVSEENEDLLRANTELNKRVSEDNERLLEELKRLRE >2plus1_GFP11_Key_Nterm_267
(SEQ ID NO: 27008)
DEVEDVLRKIEKILDDHRKRIEKNSRDMARIIDEHRRKVEENSREMKKLVDDLKKAVD >2plus1_GFP11_Key_Nterm_268
(SEQ ID NO: 27009)
SESDEVIRDLARLLDELARHVDDSVRRMDEVVKRSTREADELAKRLDELVKEVEKKPG >2plus1_GFP11_Key_Nterm_269
(SEQ ID NO: 27010)
SRAETVLKEVTDKIKKLADSSDELLRRNKENIDELKKSSEELLRRLTKAIEEIEKGSV >2plus1_GFP11_Key_Nterm_270
(SEQ ID NO: 27011)
DEEEDLERAIKKLLDENRELLKRIAEELRRLLEELRRLTEESADRLRRLLKELKDRGV >2plus1_GFP11_Key_Nterm_271
(SEQ ID NO: 27012)
DEIRKVVKEITDLLKASNDKNRKVVEEIRDLLRKSKKLADELVERLRALVEDLRRRID >2plus1_GFP11_Key_Nterm_272
(SEQ ID NO: 27013)
DAVEEAEKLIRKVIADSEKLLRDLADLNAKSIRRSEKLVEDDRRANEDVIRKLEELRR >2plus1_GFP11_Key_Nterm_273
(SEQ ID NO: 27014)
SEDEDLDRVAEKLAREHKKSVEEIKRVLKSADEESKKLVRDTERVIEEIKREVEEARR >2plus1_GFP11_Key_Nterm_274
(SEQ ID NO: 27015)
SKEDRLREELKKLLARLAEEIERLKRALEESNKDLKRTIDASEKHLRDVNEDVKRGGV >3plus1_Key_668_Nterm
(SEQ ID NO: 27,322)
DEAKELLDEIRKAVKESEDRLEKLLRDYEKELRRLEKELRDLKRRIEEKLEELRRGSL >3plus1_Key_668_Cterm
(SEQ ID NO: 27,323)
RGADALSRLLEELLRVVDDLIRVLKELIDKSRKVIEELLELLKRINEENLKVLAEIIK >3plus1_Key_668_Cterm
(SEQ ID NO: 27,324)
SEKEKLLKESEEEVRRLRRTLEELLRKYREVLERLRKELREIEERVRDVVRRLKEVLD >3plus1_Key_668_Cterm
(SEQ ID NO: 27,325)
SEKEDAARKLRKLVEELTREYEELVKKLERLIEEIEKVSEESVRKLEKLLAEISEEVR -continued >3plus1_Key_668_Cterm
                                                (SEQ ID NO: 27,326)
EALRKLVELLVEVLRRLIRVNRELVKLLREVLERLLRILRESVKKLKRLIEKVIKDAT >3plus1_Key_669_Nterm
                                                (SEQ ID NO: 27,327)
RAVKKLDEIVKEVAKKLEDVVRANEELWRALVELNKESVRRLREIVERVARDLEETAR >3plus1_Key_670_Nterm
                                                (SEQ ID NO: 27,328)
SDERRIAERIRELLRESKKLVRDVVEEAKRLLKENRDSTRKIIEDIRRLRKIEDSTR >3plus1_Key_670_Cterm
                                                (SEQ ID NO: 27,329)
SKEETLRKEAEDLLRRLEELTRRLEKKARELLERAKKLSRDLAEELKRLLKELREKGV >3plus1_Key_670_Cterm
                                                (SEQ ID NO: 27,330)
AAKRLVEELLKAVTDLSRKNKRILEELLKAIETLSDENKKILTEILDALRRLVEKIEK >3plus1_Key_670_Cterm
                                                (SEQ ID NO: 27,331)
KEREEVKEKLDRLLEEVEKTVRELKREHDELLKEVEKLVRDLKKEHDELLKKVKDDGV >3plus1_Key_670_Nterm
                                                (SEQ ID NO: 27,332)
DRLDKVEELVKKLLEDTKRTVDRVRELVRKILKKSRETLEELERLIEKILRELEKDAR >3plus1_Key_670_Cterm
                                                (SEQ ID NO: 27,333)
SERETVKRRLEELLKEVKRTLDKLKEEHDRLLEDVRRVVEELKREHDKLLKEVKDSGV >3plus1_Key_670_Nterm
                                                (SEQ ID NO: 27,334)
SEDEIIKKIIEDLRRVLKEVEEIHKEVEERLDKVLKEAEEMHKEVLKELDRVLDEVKR >3plus1_Key_670_Nterm
                                                (SEQ ID NO: 27,335)
SREEVLRELEEVIEDNRRLLEELIEKSKKVLDESLKLIDELLRRLEEVLERVLRLLEE >3plus1_Key_670_Nterm
                                                (SEQ ID NO: 27,336)
ISEDDLKRVVDEVEKKLRELKRRYAEALERIKEKIKELKDRYERAVREVVAELRKTTK >3plus1_Key_670_Nterm
                                                (SEQ ID NO: 27,337)
SKAEEIAEKLDRLLEENRRALEEITTRLDDLLRRNKDALRKVMEKLKRLLDDLRRGGI >3plus1_Key_671_Cterm
                                                (SEQ ID NO: 27,338)
VDSERVKEILERILRVVEEAVRLNEESLRRILDVVRKAVKLDRESLKKILDVVEEAVR >3plus1_Key_671_Cterm
                                                (SEQ ID NO: 27,339)
VKDDEVEREIRRVKEDLDRILEEYRRLLEEIKRKLEEILRRVEELHRRLRRKLEEIDR >3plus1_Key_671_Cterm
                                                (SEQ ID NO: 27,340)
SRVEELKKLIEDILRISREVVERIKRVAEDIHRINRRVLDDLRKLIEDILRTVEEILA >3plus1_Key_671_Cterm
                                                (SEQ ID NO: 27,341)
RGADALSRLLEELLRVVDDLIRVLKELIDKSRKVIEELLELLKRINEENLKVLAEIIK >3plus1_Key_672_Cterm
                                                (SEQ ID NO: 27,342)
RGADALSRLLEELLRVVDDLIRVLKELIDKSRKVIEELLELLKRINEENLKVLAEIIK >3plus1_Key_67>3_Nterm
                                                (SEQ ID NO: 27,343)
EALRKLVELLVEVLRRLIRVNRELVKLLREVLERLLRILRESVKKLKRLIEKVIKDAT >3plus1_Key_67>3_Cterm
                                                (SEQ ID NO: 27,344)
SEKEDAARKLRKLVEELTREYEELVKKLERLIEEIEKVSEESVRKLEKLLAEISEEVR >3plus1_Key_67>3_Nterm
                                                (SEQ ID NO: 27,345)
SEKEDAARKLRKLVEELTREYEELVKKLERLIEEIEKVSEESVRKLEKLLAEISEEVR

```
-continued
>3plus1_Key_674_Nterm
                                                 (SEQ ID NO: 27,346)
SEKEDAARKLRKLVEELTREYEELVKKLERLIEEIEKVSEESVRKLEKLLAEISEEVR >3plus1_Key_674_Cterm
                                                 (SEQ ID NO: 27,347)
RAVKKLDEIVKEVAKKLEDVVRANEELWRALVELNKESVRRLREIVERVARDLEETAR >3plus1_Key_675_Nterm
                                                 (SEQ ID NO: 27,348)
RAVKKLDEIVKEVAKKLEDVVRANEELWRALVELNKESVRRLREIVERVARDLEETAR >3plus1_Key_676_Nterm
                                                 (SEQ ID NO: 27,349)
RAVKKLDEIVKEVAKKLEDVVRANEELWRALVELNKESVRRLREIVERVARDLEETAR >3plus1_Key_677_Nterm
                                                 (SEQ ID NO: 27,350)
SDERRIAERIRELLRESKKLVRDVVEEAKRLLKENRDSTRKIIEDIRRLLRKIEDSTR >3plus1_Key_677_Cterm
                                                 (SEQ ID NO: 27,351)
SKEETLRKEAEDLLRRLEELTRRLEKKARELLERAKKLSRDLAEELKRLLKELREKGV >3plus1_Key_678_Nterm
                                                 (SEQ ID NO: 27,352)
SKEETLRKEAEDLLRRLEELTRRLEKKARELLERAKKLSRDLAEELKRLLKELREKGV >3plus1_Key_678_Cterm
                                                 (SEQ ID NO: 27,353)
SKEETLRKEAEDLLRRLEELTRRLEKKARELLERAKKLSRDLAEELKRLLKELREKGV >3plus1_Key_678_Cterm
                                                 (SEQ ID NO: 27,354)
ISEDDLKRVVDEVEKKLRELKRRYAEALERIKEKIKELKDRYERAVREVVAELRKTTK >3plus1_Key_678_Nterm
                                                 (SEQ ID NO: 27,355)
SKAEEIAEKLDRLLEENRRALEEITTRLDDLLRRNKDALRKVMEKLKRLLDDLRRGGI >3plus1_Key_678_Nterm
                                                 (SEQ ID NO: 27,356)
VDSERVKEILERILRVVEEAVRLNEESLRRILDVVRKAVKLDRESLKKILDVVEEAVR >3plus1_Key_679_Cterm
                                                 (SEQ ID NO: 27,357)
SKAEEIAEKLDRLLEENRRALEEITTRLDDLLRRNKDALRKVMEKLKRLLDDLRRGGI >3plus1_Key_679_Nterm
                                                 (SEQ ID NO: 27,358)
SKAEEIAEKLDRLLEENRRALEEITTRLDDLLRRNKDALRKVMEKLKRLLDDLRRGGI
```

In a specific embodiment, the key polypeptides share 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along their length to the amino acid sequence of a key polypeptide in Table 2 (polypeptides with an odd-numbered SEQ ID NO between SEQ ID NOS: 27127 and 27277), Table 3, and/or Table 4. In another specific embodiment, the key polypeptides share 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along their length to the amino acid sequence of a key polypeptide in Table 3. In another specific embodiment, the key polypeptides share 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along their length to the amino acid sequence of a key polypeptide in Table 4. In one embodiment of each of the above, the percent identify may be determined without the optional N- and C-terminal 60 amino acids; in another embodiment, the percent identify may be determined with the optional N- and C-terminal 60 amino acids.

The polypeptides of the disclosure (i.e.: cage polypeptides and key polypeptides) may include additional residues at the N-terminus, C-terminus, internal to the polypeptide, or a combination thereof; these additional residues are not included in determining the percent identity of the polypeptides of the invention relative to the reference polypeptide. Such residues may be any residues suitable for an intended use, including but not limited to tags. As used herein, "tags" include general detectable moieties (i.e.: fluorescent proteins, antibody epitope tags, etc.), therapeutic agents, purification tags (His tags, etc.), linkers, ligands suitable for purposes of purification, ligands to drive localization of the polypeptide, peptide domains that add functionality to the polypeptides, etc. Examples are provided herein.

In one embodiment, the polypeptides are fusion proteins that comprise a cage polypeptide disclosed herein fused to a key polypeptide disclosed herein. In one embodiment, the fusion protein comprises a cage polypeptide fused to a key polypeptide, wherein the cage polypeptide is not activated by the key polypeptide. As noted herein, orthogonal LOCKR designs (see FIG. 3) are denoted by lowercase letter subscripts: LOCKR$_a$ consists of Cage$_a$ and Key$_a$, and LOCKR$_b$ consists of Cage$_b$ and Key$_b$, etc. such that Cage$_a$ is only activated by Key$_a$, and Cage$_b$ is only activated by Key$_b$, etc. Thus, for example, the fusion protein may comprise a cage, polypeptide fused to a key$_b$ polypeptide. Such embodiments may be used, for example, in combinations to improve control of orthogonal LOCKR designs (ex: LOCKR 1 comprises a cage$_a$-key$_b$ fusion polypeptide, and LOCKR 2 comprises a cage$_b$-key, fusion polypeptide, which can then be expressed in the same cell)

In one embodiment of the fusion proteins disclosed herein, the cage polypeptide and the key polypeptide components of the fusion protein comprise at least one cage polypeptide and at least one key polypeptide having an amino acid sequence having at least 45%, 50%, 55%, 60%, 65%, 70%, 75%, 80%, 85%, 90%, 91%, 92%, 93%, 94%, 95%, 96%, 97%, 98%, 99%, or 100% sequence identity along its length to a cage polypeptide and a key polypeptide, respectively, in different rows of Table 1, Table 2, Table 3, and/or Table 4 (i.e.: each cage polypeptide in row 1 column 1 of the table can be fused with any key polypeptide in row 1 column 2, and so on).

TABLE 1

| Row number | Cage (column 1) | Key (column 2) |
|---|---|---|
| 1 | SB76L (SEQ ID NO: 1), SB76L_17 (SEQ ID NO: 2), SB76L_18 (SEQ ID NO: 3), LOCKR_extend5 (SEQ ID NO: 4), LOCKR_extend9 (SEQ ID NO: 5), LOCKR_extend18 (SEQ ID NO: 6), miniLOCKRa_1 (SEQ ID NO: 12), miniLOCKRa_2 (SEQ ID NO: 13), aBcl2LOCKR (SEQ ID NO: 18), pBimLOCKR (SEQ ID NO: 19), BimLOCKR_extend5 (SEQ ID NO: 20), BimLOCKR_extend9 (SEQ ID NO: 21), BimLOCKR_extend18 (SEQ ID NO: 22), strepLOCKRa (all variants; SEQ ID NOs: 26-34), SB13_LOCKR (SEQ ID NO: 35), SB13_LOCKR_extend18 (SEQ ID NO: 37), ZCX12_LOCKR (SEQ ID NO: 36), ZCX12_LOCKR_extend18 (SEQ ID NO: 38), fretLOCKRa (SEQ ID NO: 39), 1fix-latch_Mad1SID_t0_1 (SEQ ID NO: 61), 1fix-latch_Mad1SID_T0_2 (SEQ ID NO: 65), 1fix-long-Bim-t0 (SEQ ID NO: 54), 1fix-long-GFP-t0 (SEQ ID NO: 55), 1fix-short-BIM-t0 (SEQ ID NO: 56), 1fix-short-GFP-t0 (SEQ ID NO: 57), 1fix-short-noBim-t0 (SEQ ID NO: 16), 1fix-short-noBim(AYYA)-t0 (SEQ ID NO: 17), 1fix-short-Bim-t0-relooped (SEQ ID NO: 67), 1fix-short-spytag-t0_2 (SEQ ID NO: 68), 1fix-short-spytag-t0_8 (SEQ ID NO: 69), 1fix-short-TEV-t0_1 (SEQ ID NO: 70), 1fix-short-TEV-t0_6 (SEQ ID NO: 71), 1fix-short-nanoBit-t0_1 (SEQ ID NO: 72), 1fix-short-nanoBit-t0_3 (SEQ ID NO: 73), 1fix-short-RHIM-t0_8 (SEQ ID NO: 74), 1fix-short-RHIM-t0_19 (SEQ ID NO: 75), 1fix-short-RHIM-t0_22 (SEQ ID NO: 76), 1fix-short-gcn4-t0_4 (SEQ ID NO: 77), 1fix-short-ccDi-t0_6 (SEQ ID NO: 78), 1fix-short-cc-a-t0_6 (SEQ ID NO: 79), 1fix-short-cc-b-t0_6 (SEQ ID NO: 80) | sB76_C-helix (SEQ ID NO: 27016), sB76_C-helix-biotin (SEQ ID NO: 27017), p5_MBP (SEQ ID NO: 27018), p9_MBP (SEQ ID NO: 27019), p18_MBP (SEQ ID NO: 27020), p76-long (SEQ ID NO: 27027), p76-short (SEQ ID NO: 27028), k76-long (SEQ ID NO: 27029), k76-short (SEQ ID NO: 27030), p76_GLISE (SEQ ID NO: 27031), p76_GSSEKIS (SEQ ID NO: 27032), p76_R26G (SEQ ID NO: 27033), p76-short_E19G (SEQ ID NO: 27034), p76-short_GLISE_E01_EGFR (SEQ ID NO: 27035), p76-short_AE_EGFR (SEQ ID NO: 27036), p76-short_AAE_EGFR (SEQ ID NO: 27037), p76-short_EE_EGFR (SEQ ID NO: 27038) |
| 2 | LOCKRb (SEQ ID NO: 7), BimLOCKRb (SEQ ID NO: 23), fretLOCKRb (SEQ ID NO: 40) | key_b (SEQ ID NO: 27022) |
| 3 | LOCKRc (SEQ ID NO: 8), miniLOCKRc_1 (SEQ ID NO: 14), miniLOCKRc_2 (SEQ ID NO: 15), BimLOCKRc (SEQ ID NO: 24), fretLOCKRc (SEQ ID NO: 41) | key_c (SEQ ID NO: 27023) |
| 4 | LOCKRd (SEQ ID NO: 9), BimLOCKRd (SEQ ID NO: 25), fretLOCKRd (SEQ ID NO: 42) | key_d (SEQ ID NO: 27024) |
| 5 | LOCKRe (SEQ ID NO: 10) | key_e (SEQ ID NO: 27025) |
| 6 | LOCKRf (SEQ ID NO: 11) | key_f (SEQ ID NO: 27026) |
| 7 | 1fix_VMAc_C_BIMlatcht9 (SEQ ID 51) sfGFP_VMAn_1fix_BIM_t0_latch (SEQ ID NO: 52) sfGFP_VMAn_1fix_BIM_t0_latch (SEQ ID NO: 53) | sfGFP_VMAn_p18 (SEQ ID NO: 27041) p18_VMAc_mCherry (SEQ ID NO: 27042) |
| 8 | Spycatcher-1fix-long-GFP-t0 (SEQ ID NO: 58) Spycatcher-1fix-short-GFP-t0 (SEQ ID NO: 59) | p76-spytag (SEQ ID NO: 27039), p76-short-spytag (SEQ ID NO: 27040) |

TABLE 1-continued

| Row number | Cage (column 1) | Key (column 2) |
|---|---|---|
| 9 | STREPII-2plus1_LOCK 1 (SEQ ID NO: 81) | 2plus1_Key_1 (SEQ ID NO: 27043) |
| 10 | STREPII-2plus1_LOCK 2 (SEQ ID NO: 82) | 2plus1_Key_2 (SEQ ID NO: 27044) |
| 11 | STREPII-2plus1_LOCK_3, (SEQ ID NO: 83) STREPII-2plus1_LOCK_3-relooped (SEQ ID NO: 91) | 2plus1_Key_3 (SEQ ID NO: 27045) |
| 12 | STREPII-2plus1_LOCK_4C (SEQ ID NO: 84) | 2plus1_Key_4C (SEQ ID NO: 27046) |
| 13 | STREPII-3plus1_LOCK_1 (SEQ ID NO: 86) | 3plus1_Key_1 (SEQ ID NO: 27047) |
| 14 | STREPII-3plus1_LOCK_2 (SEQ ID NO: 87) | 3plus1_Key_2 (SEQ ID NO: 27048) |
| 15 | STREPII-3plus1_LOCK_3 (SEQ ID NO: 88), STREPII-3plus1_LOCK_3-relooped (SEQ ID NO: 90) | 3plus1_Key_3 SEQ ID NO: 27049) |
| 16 | STREPII-3plus1_LOCK_4 (SEQ ID NO: 89) | 3plus1_Key_4 (SEQ ID NO: 27050) |

TABLE 2

| Cage Name | Cage Sequence | Key Name | Key Sequence |
|---|---|---|---|
| 2plus1_Cage_Cterm_2406 | SEVDEVVKEVEDLVRRNEELVEEVVRRVEKVVTDDRRLVEEVVREI RKIVKDVEDLARKLDKEELKRVLDEMRERIERLLEKLRRHSKKLDD ELKRLLEELREHSRRVEKRLEDLLKELRERGVDEKVLRKLEKVIRE VRERSTRALRKVEEVIRRVREESERALRDLERVVKEVEKRMREAAR (SEQ ID NO: 27126) | 2plus1_Key_Cterm_2406 | EKVLRKLEKVIREVRERSTRALRKVE EVIRRVREESERALRDLERVVKEVEK RMREAAR (SEQ ID NO: 27127) |
| 2plus1_Cage_Cterm_5398 | SVEELLRKLEEVLRKIREENERSLKELRDRAREIVKRNRETNRELE EVIKELEKRLSGADKEKVEELVRRIRRIVERVVEEDRRTVEEIEKI AREVVKRDRDSADRVRRTVEDVLRKATGSEDIVRKIERIVETIERE VRESVKKVEEIARDIRRKVDESVKNVEKLLRDVDKKARDRKK (SEQ ID NO: 27128) | 2plus1_Key_Cterm_5398 | EDIVRKIERIVETIEREVRESVKKVE EIARDIRRKVDESVKNVEKLLRDVDK KARDRKK (SEQ ID NO: 27129) |
| 2plus1_Cage_Cterm_5405 | SESDDVIRKLRELLEELRTHVEKSIRDLRKILEDSTRHAKRSIEEL ERLLEEVRKKPGDEEVRKTVEEISRRVAENVKRLEDLYRRMEEEVK KNLDRLRKRVEDIIREVEEARKKGVDEEKLKDLIRKLRDILRRAAE AHKKLIDDARESLERAKREHEKLIDRLKKILEELER (SEQ ID NO: 27130) | 2plus1_Key_Cterm_5405 | EEKLKDLIRKLRDILRRAAEAHKKLI DDARESLERAKREHEKLIDRLKKILE ELER (SEQ ID NO: 27131) |
| 2plus1_Cage_Cterm_5406 | DREREVKKRLDEVRERIERLLRRVEEESRRVAEEIRRLIEEVRRRN KKVTEEIRELLKGLKDKEEVRRVLERLRKLNAESDELLERILERLR RLVEATNRLVKAIIEELRRLVEKIVREVPDSEELREELKKLERKIE KVAKEIHDHDKEVTERLEDLLRRITEHARKSDREIEETAR (SEQ ID NO: 27132) | 2plus1_Key_Cterm_5406 | EELREELKKLERKIEKVAKEIHDHDK EVTERLEDLLRRITEHARKSDREIEE TAR (SEQ ID NO: 27133) |
| 2plus1_Cage_Cterm_5409 | SEAEELLRKRLEDRAEEILRRLEEILRTSRKLAEDVLRELEKLLRES ERRIREVLEELRGIKDKKELEDVIREVEKELDESLERSRELLKDVL KKLDDNLKESERLVEDIDRELAKILEDLKKAGVPKEVVDEIKRIVD EVRERLKRIVDENAKIVEDARRALEKIVKENEEILRRLKKELRELR K (SEQ ID NO: 27134) | 2plus1_Key_Cterm_5409 | KEVVDEIKRIVDEVRERLKRIVDENA KIVEDARRALEKIVKENEEILRRLKK ELRELRK (SEQ ID NO: 27135) |
| 2plus1_Cage_Cterm_5410 | SRAETVLKEVTDKIKKLADSSDELLRRNKENIDELKKSSEELLRRL TKAIEEIEKGSVDEETLEELIRRVEAELEAHHRELEKNSREDEKRN RDHHAKLEEEMRRVEERLEREGIDDEVVKRVRDLLDTVRRRNEKVN EDVKRMNDKLRRDNEDVIRRVEKLLRELEEKRRT (SEQ ID NO: 27136) | 2plus1_Key_Cterm_5410 | DEVVKRVRDLLDTVRRRNEKVNEDVK RMNDKLRRDNEDVIRRVEKLLRELEE KRRT (SEQ ID NO: 27137) |
| 2plus1_Cage_Cterm_5413 | STEEVLDEIRKLHKTLTEDIKRVLREIEELHRRTIEENKEVLDKIA EDYKRVIDDVRTKDTPNVEKLLKDLEKSAKENIEHNERTLREDDRV LKEIRRRATELLKANEEMLRRIEEVARKGGVDAEELLRESKEAIKE VKRVLEELRKESKRVVDETRKLSEENLEHSERVLRKVEEDLR (SEQ ID NO: 27138) | 2plus1_Key_Cterm_5413 | AEELLRESKEAIKEVKRVLEELRKES KRVVDETRKLSEENLEHSERVLRKVE EDLR (SEQ ID NO: 27139) |
| 2plus1_Cage_5414_GFP11_Cterm | SEIEKILKEIEDLARRDEEVSKKIVEDIRRLAKEVEDTSRDIVRKI EELAKRVLDRLRKDGSKEELEKEVREVVKTLEELVKDNHRLIRRAV EEMKRLVEENHRHSREVVKELEDLVRELRKGSGSEDSERDHMVLHE YVNAAGITSEKSNEEVKRTVEELVRRMEESNDRVRDLVRRLVEELK RAVD (SEQ ID NO: 27140) | 2plus1_Key_5414_Cterm | EDSERLVREVEDLVRRLVRRSEKSNE EVKRTVEELVRRMEESNDRVRDLVRR LVEELKRAVD (SEQ ID NO: 27141) |

TABLE 2-continued

| Cage Name | Cage Sequence | Key Name | Key Sequence |
|---|---|---|---|
| 2plus1_Cage_5414_GFP11_Cterm | SEIEKILKEIEDLARRDEEVSKKIVEDIRRLAKEVEDTSRDIVRKI EELAKRVLDRLRKDGSKEELEKEVREVVKTLEELVKDNHRLIRRAV EEMKRLVEENHRHSREVVKELEDLVRELRKGSGSEDSERRDHMVLH EYVNAAGITEKSNEEVKRTVEELVRRMEESNDRVRDLVRRLVEELK RAVD(SEQ ID NO: 27142) | 2plus1_Key_Cterm_5414 | EDSERLVREVEDLVRRLVRRSEKSNE EVKRTVEELVRRMEESNDRVRDLVRR LVEELKRAVD(SEQ ID NO: 27143) |
| 2plus1_Cage_5414_GFP11_Cterm | SEIEKILKEIEDLARRDEEVSKKIVEDIRRLAKEVEDTSRDIVRKI EELAKRVLDRLRKDGSKEELEKEVREVVKTLEELVKDNHRLIRRAV EEMKRLVEENHRHSREVVKELEDLVRELRKGSGSEDSERLVREVRD HMVLHEYVNAAGITEVKRTVEELVRRMEESNDRVRDLVRRLVEELK RAVD(SEQ ID NO: 27144) | 2plus1_Key_Cterm_5414 | EDSERLVREVEDLVRRLVRRSEKSNE EVKRTVEELVRRMEESNDRVRDLVRR LVEELKRAVD(SEQ ID NO: 27145) |
| 2plus1_Cage_Cterm_5421 | SVDEVLKEIEDALRRLKEEVERVLKENEDELRRLEEEVRRVLKEDE ELLESLKRGVGESDEVDRVVDEIAKLSAEILEKVKKVVKEIRDSLE TVKRRVDDVVRRLKELLDEIKRGSDEKAIRDVAKEIRDRLKELEEE IEEVTRRNLKLLADVEEEIRRVHEKTRRLLETVLRRAT(SEQID NO: 27146) | 2plus1_Key_Cterm_5421 | EKAIRDVAKEIRDRLKELEEEIEEVT RRNLKLLADVEEEIRRVHEKTRRLLE TVLRRAT(SEQ ID NO: 27147) |
| 2plus1_Cage_Cterm_5432 | DEIRKVVKEITDLLKASNDKNRKVVEEIRDLLRKSKKLADELVERL RALVEDLRRRIDKSGDKETAEDIVRRIIEELKRILKEIEDLARRIN REIERLVEEVERDNRDVNRAIEELLKDIARRGGSEDLKRVEERARE VSRRNEESMRRVKEDADRVSEANKEVLDRVREEVKRLIEEVRETLR (SEQ ID NO: 27148) | 2plus1_Key_Cterm_5432 | SEDLKRVEERAREVSRRNEESMRRVK EDADRVSEANKEVLDRVREEVKRLIE EVRETLR(SEQ ID NO: 27149) |
| 2plus1_Cage_Cterm_5435 | STAETVAEEVERVLKHSDDLIKEVEDVNRRVEEEIKRVIRELEEEN ERLVAEVRKGVKGEILAEIEKRLADNSEKVREVAERAKKLLEENTA RVKDILRESRKLVKDLLDEVRGTGSEEAAREIIKRLREVNKRTKEK LDELIKHSEEVLERVKRLIDELRKHSEEVLEDLRRRAK(SEQ ID NO: 27150) | 2plus1_Key_Cterm_5435 | EEAAREIIKRLREVNKRTKEKLDELI KHSEEVLERVKRLIDELRKHSEEVLE DLRRRAK(SEQ ID NO: 27151) |
| 2plus1_Cage_Cterm_5437 | DEVREVAERLRRLVDESRKRNEEVIKESEALVDRVRKTNEEVMKRL RELIDKLEKDIRRSGDKETVEKIIREVLSAIDELLKRVERTNAEIS KENARLLDEVRKTNEEISRRLAKLLEDIRRGSGDAETIERVVRELL EENKEVLRKTEEAVKRSTETNKRLLEASKEVADRLRERIKKAAK (SEQ ID NO: 27152) | 2plus1_Key_Cterm_5437 | AETIERVVRELLEENKEVLRKTEEAV KRSTETNKRLLEASKEVADRLRERIK EAAK(SEQ ID NO: 27153) |
| 2plus1_Cage_Cterm_5439 | SRVEEIIEDLRRLLEEIRKENEDSIRRSKELLDRVKEINDTIIAEL ERLLKDIEKEVREKGSESEEVKKALRAVLEELEKLLRRVAEINEEV LRRNSKLVEEDERRNREVLKELARLVEELIREIGDEDKARKVAEVA EKVLRDIDKLDRESKEAFRATNEEIAKLDEDTARVAERVKKAIEDL AK(SEQ ID NO: 27154) | 2plus1_Key_Cterm_5439 | EDKARKVAEVAEKVLRDIDKLDRESK EAFRATNEEIAKLDEDTARVAERVKK AIEDLAK(SEQ ID NO: 27155) |
| 2plus1_Cage_Cterm_5447 | SEADDVLKKLAETVKRIIERLKKLTDDSRRLVEEVHRRNDKLSKES AEAVRKAEERGIDEKDVRLLEDLKKKSEEVAERNKRILDTLREIS KRAEDEVRKVLKELEKTLKELEDRRPDSEELSAEVKKLLDEVRKAL ARHKDENDKLLKEIEDSLRRHKEENDRLLEKLKESTR(SEQ ID NO: 27156) | 2plus1_Key_Cterm_5447 | EELSAEVKKLLDEVRKALARHKDEND KLLKEIEDSLRRHKEENDRLLEKLKE STR(SEQ ID NO: 27157) |
| 2plus1_Cage_Cterm_5456 | SAEELLREVAELVKRVDEDLRRLEEVRASNEEVIRRLEEILKRIE EENRKVVEELRRGGVSEDLVRESKRLVDESRRVIEKLVKESADSVE RTRETVDRLREELKRLVEEIAKMVKGGSSEETVKRLLDELRELLER LKRTIEELLKRNRDLLADAEEKARRLLEENRKLLKAARDTAT(SEQ ID NO: 27158) | 2plus1_Key_Cterm_5465 | EETVKRLLDELRELLERLKRTIEELL KRNRDLLADAEEKARRLLEENRKLLK AARDTAT(SEQ ID NO: 27159) |
| 2plus1_Cage_Cterm_5470 | SKEDRLREELKKLLARLAEEIERLKRALEESNKDLKRTIDASEKHL RDVNEDVKRGGVSEELLRELERSTAENKERAKELLKRHEDLVRKVE KELADLLRRLEEIVARVDEALKRGISEEELDKLLKEARDLI-REIEK) RLEEELLKRVEKLTEDAKRDLERSNREHKELADRIKETAR(SEQ ID NO: 27160) | 2plus1_Cterm_5470 | EEELDKLLKEARDLIREIEKRLEELL KRVEKLTEDAKRDLERSNREHKELAD RIKETAR(SEQ ID NO: 27161) |
| 2plus1_Cage_Nterm_2406 | SEVDEVVKEVEDLVRRNEELVEEVRRVEKVVTDDRRLVEEVVREI RKIVKDVEDLARKLDKEELVKRVLDEMRERIERLLEKLRRHSKKLDD ELKRLLEELREHSRRVEKRLEDLLKELRERGVDEKVLRKLEKVIRE VRERSTRALRKVEEVIRRVREESERALRDLERVVKEVEKRMREAAR (SEQ ID NO: 27162) | 2plus1_Key_Nterm_2406 | SEVDEVVKEVEDLVRRNEELVEEVVR RVEKVVTDDRRLVEEVVREIRKIVKD VEDLARK(SEQ ID NO: 27163) |
| 2plus1_Cage_Nterm_5406 | DREREVKKRLDEVRERIERLLRRVEEESRRVAEEIRRLIEEVRRRN KKVTEEIRELLKGLKDKEEVRRVLERLRKLNAESDELLERILERLR RLVEATNRLVKAIIEELRRLVEKIVREVPDSEELREELKKLERKIE KVAKEIHDHDKEVTERLEDLLRRITEHARKSDREIEETAR(SEQ ID NO: 27164) | 2plus1_Key_Nterm_5406 | DREREVKKRLDEVRERIERLLRRVEE ESRRVAEEIRRLIEEVRRRNKKVTEE IRELLKGL(SEQ ID NO: 27165) |

TABLE 2-continued

| Cage Name | Cage Sequence | Key Name | Key Sequence |
|---|---|---|---|
| 2plus1_Cage_Nterm_5409 | SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDENAKIVEDARRALEKIVKENEEILRRLKKELRELRK (SEQ ID NO: 27166) | 2plus1_Key_Nterm_5409 | SEAEELLKRLEDRAEEILRRLEEILRTSRKLAEDVLRELEKLLRESERRIREVLEELRGI (SEQ ID NO: 27167) |
| 2plus1_Cage_Nterm_5410 | SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLREREGIDDEVVKRVRDLLDTVRRRNEKVNEDVKRMNDKLRRDNEDVIRRVEKLLRELEEKRRT (SEQ ID NO: 27168) | 2plus1_Key_Nterm_5410 | SRAETVLKEVTDKIKKLADSSDELLRRNKENIDELKKSSEELLRRLTKAIEEIEKGS (SEQ ID NO: 27169) |
| 2plus1_Cage_Nterm_5413 | STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRVLEELRKESKRVVDETRKLSEENLEHSERVLRKVEEDLR (SEQ ID NO: 27170) | 2plus1_Key_Nterm_5413 | STEEVLDEIRKLHKTLTEDIKRVLREIEELHRRTIEENKEVLDKIAEDYKRVIDDVRTKD (SEQ ID NO: 27171) |
| 2plus1_Cage_5414_GFP11_Nterm | SEIEKILKEIEDLARRDEEVSKKIVEDIRRLAKEVEDTSRRDHMVLHEYVNAAGITLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD (SEQ ID NO: 27172) | 2plus1_Key_Nterm_5414 | SEIEKILKEIEDLARRDEEVSKKIVEDIRRLAKEVEDTSRDIVRKIEELAKRVLDRLRKD (SEQ ID NO: 27173) |
| 2plus1_Cage_5414_GFP11_Nterm | SEIEKILKEIEDLARRDEEVSKKIVEDIRRLAKEVEDTSRDIRDHMVLHEYVNAAGITKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD (SEQ ID NO: 27174) | 2plus1_Key_Nterm_5414 | SEIEKILKEIEDLARRDEEVSKKIVEDIRRLAKEVEDTSRDIVRKIEELAKRVLDRLRKD (SEQ ID NO: 27175) |
| 2plus1_Cage_Nterm_5439 | SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK (SEQ ID NO: 27176) | 2plus1_Key_Nterm_5439 | SRVEEIIEDLRRLLEEIRKENEDSIRRSKELLDRVKEINDTIIAELERLLKDIEKEVREKG (SEQ ID NO: 27177) |
| 3plus1_Cage_529_GFP11_Cterm | SEAEDLEELIKELAELLKDVIRKLEKINRRLVKILEDIIRRLKEISKEAEEELRKGTVEDKDILRLDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRRIERILREVGKDKDEAERRDHMVLHEYVNAAGITEEVKRRLEEEELTRLRETHKKIEKELREALKRVRDRST (SEQ ID NO: 27178) | 3plus1_Key_Cterm_529 | KDEAERRRELKDKLDRLREEHEEVKRRLEEEELTRLRETHKKIEKELREALKRVRDRST (SEQ ID NO: 27179) |
| 3plus1_Cage_Cterm_263 | SLVDELRKSLERNVRVSEEVARRLKEALKRWVDVVRKVVEDLIRLNEDVVRVVEKVTVDESAIERVRRIIEELNRKLDAVLKKNEDLVRRLTELLLDKLLEENRRLVEELDEDLKRRGGTEEVIDTILELIERSIERLKRLLDELLRIVREALKDNKRVADENLKKLKEILDELRKDGVEDEELKRVLEKAADLHRRLKDRHRKLLEDLERIIRELKKKLDEVVEENKRSVDELKR (SEQ ID NO: 27180) | 3plus1_Key_Cterm_263 | DEELKRVLEKAADLHRRLKDRHRKLLEDLERIIRELKKKLDEVVEENKRSVDELKR (SEQ ID NO: 27181) |
| 3plus1_Cage_Cterm_494 | SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEEERARKILRDDERDLRALEKRIRDIIREDREELERLKERARK (SEQ ID NO: 27182) | 3plus1_Key_Cterm_494 | EDLVRDIRRELKELEEERARKILRDDERDLRALEKRIRDIIREDREELERLKERARK (SEQ ID NO: 27183) |
| 3plus1_Cage_Cterm_500 | SEKEELKRLLDKLLKELKRLSDELKATIDKILKILKEVSEEVKRTADELLDAIRRGGVDEEVLREIKREIEEIEKKLRKVNKEIEDEIREIKKKLLDEVDDKITKEVEKIKEALDKGGVDAKEVIKALKEILKEHLADEVFEDVLRRLKEIIKRHRDVVKEVLEELRKILEKVAEVLKRQGRSEDELRKVEEDLKRLEDKLKKLLEDYEKKVRELEETLDDLLRKYEETLRRLEKELEEEAER (SEQ ID NO: 27184) | 3plus1_Key_Cterm_500 | EDELRKVEEDLKRLEDKLKKLLEDYEKKVRELEETLDDLLRKYEETLRRLEKELEEEAER (SEQ ID NO: 27185) |
| 3plus1_Cage_506_GFP11_Cterm | SAEETLRRITEESKRVLEEITKKYEDLERESREVLRKLREDLDRIKRLEDEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDERDHMVLHEYVNAAGITIRVLEEILKINEELNRKIIKFARENLERNRRVNKKVIEVLREAAR (SEQ ID NO: 27186) | 3plus1_Key_Cterm_506 | RERLARLLKALADKLIRVLEEILKINEELNRKIIKFARENLERNRRVNKKVIEVLREAAR (SEQ ID NO: 27187) |
| 3plus1_Cage_508_GFP11_Cterm | STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKIEELRRSGDRISEKDVLRKLEEVLRKALEILERLLKKIRESARELLKIIEEVLDANIKVMEEALKTIKELLKDGRDHMVLHEYVNAAGITTRYEELRRLRKRVKDYEDKLREIEKKVRRDAERIEEELERAKK (SEQ ID NO: 27188) | 3plus1_Key_Cterm_508 | DEVKRRLEEKERRIRTRYEELRRRLRKRVKDYEDKLREIEKKVRRDAERIEEELERAKK (SEQ ID NO: 27189) |

TABLE 2-continued

| Cage Name | Cage Sequence | Key Name | Key Sequence |
|---|---|---|---|
| 3plus1_Cage_Cterm_510 | SEKEELLKLIKRVIELLKRVLEEHLRLVEDVIRRLKELLDSNEKIV REVIEDLKRLLDEVRGDKEELDRIKEKLEEVLERYKRRLEEIKRDL ERMLEDYKRELKRIEEDLRRVLEEVERIATRGEGPAEAIDKLRKI LERALRELDKLSKKLDELLKKVLEELEKSNREIDKLLKDVLRRVEE GGASEDLLRKAKKVITEVREKLKRNLEDVRRVIEDVKRKSARILEE ARRLIEEVERELEKIRK(SEQID NO: 27190) | 3plus1_Key_Cterm_510 | EDLLRKAKKVITEVREKLKRNLEDVR RVIEDVKRKSARILEEARRLIEEVER ELEKIRK(SEQ ID NO: 27191) |
| 3plus1_Cage_528_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGRDHMVLHEYVNAAGITLDRLREEHEEVKRRLEEELTRLRETHKK IEKELREALKRVRDRST(SEQID NO: 27192) | 3plus1_Key_528 | KDEAERRRRELKDKLDRLREEHEEVK RRLEEELTRLRETHKKIEKELREALK RVRDRST(SEQ ID NO: 27193) |
| 3plus1_Cage_528_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDKRDHMVLHEYVNAAGITLREEHEEVKRRLEEELTRLRETHKK IEKELREALKRVRDRST(SEQID NO: 27194) | 3plus1_Key_Cterm_528 | KDEAERRRRELKDKLDRLREEHEEVK RRLEEELTRLRETHKKIEKELREALK RVRDRST(SEQ ID NO: 27195) |
| 3plus1_Cage_529_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDKDEAERDHMVLHEYVNAAGITHEEVKRRLEEELTRLRETHKK IEKELREALKRVRDRST(SEQID NO: 27196) | 3plus1_Key_Cterm_528 | KDEAERRRRELKDKLDRLREEHEEVK RRLEEELTRLRETHKKIEKELREALK RVRDRST(SEQ ID NO: 27197) |
| 3plus1_Cage_529_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKRDHMVLHEYVNAAGITDRLREEHEEVKRRLEEELTRLRETHKK IEKELREALKRVRDRST(SEQID NO: 27198) | 3plus1_Key_Cterm_529 | KDEAERRRRELKDKLDRLREEHEEVK RRLEEELTRLRETHKKIEKELREALK RVRDRST(SEQ ID NO: 27199) |
| 3plus1_Cage_529_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDRDHMVLHEYVNAAGITRLREEHEEVKRRLEEELTRLRETHKK IEKELREALKRVRDRST(SEQ ID NO: 27200) | 3plus1_Key_Cterm_529 | KDEAERRRRELKDKLDRLREEHEEVK RRLEEELTRLRETHKKIEKELREALK RVRDRST(SEQ ID NO: 27201) |
| 3plus1_Cage_529_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDKDRDHMVLHEYVNAAGITREEHEEVKRRLEEELTRLRETHKK IEKELREALKRVRDRST(SEQ ID NO: 27202) | 3plus1_Key_Cterm_529 | KDEAERRRRELKDKLDRLREEHEEVK RRLEEELTRLRETHKKIEKELREALK RVRDRST(SEQ ID NO: 27203) |
| 3plus1_Cage_Cterm_530 | SDKEEIKRRVEKTARDLETEHDKIKKRLEDTVRDIKRELDELLEKY ERVLRKIEKTLREGDGDATDLVDKLLETVKRLNEEVLRTVKKIADE LRRLVEEVLRVLRESNETLARLLEEGNVGDEVRERLEEVLRRTEEI IKTLEEIVKRLLDELRRLVEELRRISKKLKDELDKIKEKGKDEKRL IEEVVRLLRENLDVVRRILEALAKLIKELLEALEEVLRRNKELIRE LLRVLDEALK(SEQID NO: 27204) | 3plus1_Key_Cterm_530 | EKRLIEEVVRLLRENLDVVRRILEAL AKLIKELLEALEEVLRRNKELIRELL RVLDEALK(SEQ ID NO: 27205) |
| 3plus1_Cage_534_GFP11_Cterm | DEDRIIEEIARLLEELLRELLELIKKLIETNRRLNEEHERAVRELA RLLEELLDRLVKKGISDEKLKRIRERLKRALDDLERLHREINKRLE DLVRELEKLVREILKELKDALEELRRASARAGGEEVLRRLEEIVKK LLDLVRRILERLKEIHKDNVRLLRELNERLTRIVEDLVRLIREILR EAGVDERDHMVLHEYVNAAGITIKRLHEDLERKLKESEDELREIEA RLEEKIRRLEEKLERKRR(SEQ ID NO: 27206) | 3plus1_Key_Cterm_534 | EKIAEEIERELEELRRMIKRLHEDLE RKLKESEDELREIEARLEEKIRRLEE KLERKRR(SEQ ID NO: 27207) |
| 3plus1_Cage_534_GFP11_Cterm | DEDRIIEEIARLLEELLRELLELIKKLIETNRRLNEEHERAVRELA RLLEELLDRLVKKGISDEKLKRIRERLKRALDDLERLHREINKRLE DLVRELEKLVREILKELKDALEELRRASARAGGEEVLRRLEEIVKK LLDLVRRILERLKEIHKDNVRLLRELNERLTRIVEDLVRLIREILR EAGVDEKIRDHMVLHEYVNAAGITRLHEDLERKLKESEDELREIEA RLEEKIRRLEEKLERKRR(SEQID NO: 27208) | 3plus1_Key_Cterm_534 | EKIAEEIERELEELRRMIKRLHEDLE RKLKESEDELREIEARLEEKIRRLEE KLERKRR(SEQ ID NO: 27209) |
| 3plus1_Cage_534_GFP11_Cterm | DEDRIIEEIARLLEELLRELLELIKKLIETNRRLNEEHERAVRELA RLLEELLDRLVKKGISDEKLKRIRERLKRALDDLERLHREINKRLE DLVRELEKLVREILKELKDALEELRRASARAGGEEVLRRLEEIVKK LLDLVRRILERLKEIHKDNVRLLRELNERLTRIVEDLVRLIREILR EAGVDEKIAEEIERDHMVLHEYVNAAGITLERKLKESEDELREIEA RLEEKIRRLEEKLERKRR(SEQID NO: 27210) | 3plus1_Key_Cterm_534 | EKIAEEIERELEELRRMIKRLHEDLE RKLKESEDELREIEARLEEKIRRLEE KLERKRR(SEQ ID NO: 27211) |

TABLE 2-continued

| Cage Name | Cage Sequence | Key Name | Key Sequence |
|---|---|---|---|
| 3plus1_Cage_Cterm_539 | SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAEDNERVLERIIRELTDNLERHLKIVREIVK(SEQID NO: 27212) | 3plus1_Key_Cterm_539 | ERLVKTLIEDVEAVIKRILELITRVAEDNERVLERIIRELTDNLERHLKIVREIVK(SEQ ID NO: 27213) |
| 3plus1_Cage_Cterm_548 | DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK(SEQ ID NO: 27214) | 3plus1_Key_Cterm_548 | EEIDRELKRVVEELRRLHEEIKERLDDVARRSEEELRRIIKKLKEVVKEIRKKLK(SEQ ID NO: 27215) |
| 3plus1_Cage_Cterm_556 | SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLLDRVRRGERTDDERRTLTELLKRMEDILEKVERTLKKLLDDSARMAEEVKKTLKELLERSEKVAEDVRK(SEQ ID NO: 27216) | 3plus1_Key_Cterm_556 | DDERRTLTELLKRMEDILEKVERTLKKLLDDSARMAEEVKKTLKELLERSEKVAEDVRK(SEQ ID NO: 27217) |
| 3plus1_Cage_Cterm_560 | SKKELLEEVVRRAIELLKRHLEKLKRILEEIVRLLEEHLEKVERVLRAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELRRLDKAIKDRLRELKKDLDEANRRIKETLKKLLREVEK(SEQ ID NO: 27218) | 3plus1_Key_Cterm_560 | EDKLKEIEDELRRLLEELRRLDKAIKDRLRELKKDLDEANRRIKETLKKLLREVEK(SEQ ID NO: 27219) |
| 3plus1_568_GFP11_Cterm | KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTRDHMVLHEYVNAAGITKRRLKEVIDRYEDELRKLRKEYKEKIDKYERKLEEIERRERT(SEQ ID NO: 27220) | 3plus1_Key_Cterm_568 | KAVEELEKALEEIKRRLKEVIDRYEDELRKLRKEYKEKIDKYERKLEEIERRERT(SEQ ID NO: 27221) |
| 3plus1_568_GFP11_Cterm | KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDRDHMVLHEYVNAAGITLKEVIDRYEDELRKLRKEYKEKIDKYERKLEEIERRERT(SEQ ID NO: 27222) | 3plus1_Key_Cterm_568 | KAVEELEKALEEIKRRLKEVIDRYEDELRKLRKEYKEKIDKYERKLEEIERRERT(SEQ ID NO: 27223) |
| 3plus1_Cage_Cterm_572 | DEDELIRKLLEDLKDIVRKILELIERDLRDIERVVRRIVKVIRDDLKKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKNSKDILEEVRKLIDELRKRIKEVED(SEQ ID NO: 27224) | 3plus1_Key_Cterm_572 | SELADRIRKLIEDLERHTAKVLEDVKRAITELRKNSKDILEEVRKLIDELRKRIKEVED(SEQ ID NO: 27225) |
| 3plus1_Cage_Cterm_581 | SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVVRELEKVLKESLDTLEEIIRRLDEANAATVKRVADVIRELEDINRKVLEEIKRGSDDAEAVIKVIEKLIRANKRVWDALLKINEDLVRVNKTVWKELLRVNEKLARDLERVVK(SEQ ID NO: 27226) | 3plus1_Key_Cterm_581 | AEAVIKVIEKLIRANKRVWDALLKINEDLVRVNKTVWKELLRVNEKLARDLERVVK(SEQ ID NO: 27227) |
| 3plus1_Cage_Cterm_585 | SKEEKLLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHHVRVSTRIARLLLDVARKLAEVIKEAER(SEQ ID NO: 27228) | 3plus1_Key_Cterm_585 | SKAAEDILRVLEKLVKVSREAIKLILELSEHHVRVSTRIARLLLDVARKLAEVIKEAER(SEQ ID NO: 27229) |
| 3plus1_Cage_Cterm_587 | SEIEDVIRRLRKILEDLERVSEKLLREIKKILDEARRLNEEVIKEIKRVLEDAVRVFRDGSGSKEELAKLVEELIRELAKLAKEVDEIHKRIVERLRKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD(SEQ ID NO: 27230) | 3plus1_Key_Cterm_587 | IEDLVREVERLIKRIEDSLRELEKTVRELLKRIKEASDKVREDVDRLIKELKEAAD(SEQ ID NO: 27231) |
| 3plus1_Cage_Cterm_605 | SREELLDRILEAIAKILEDLKRLIDENLARLEEVVRELERIIDRNLKLIREILDELKKGSGSEEILEKIKKVDKELEDLIRRLLKKLEDLIRETERRLREIKRIRDLLKEVKDRDKDLERLLEVLEEVLRVIAEELAKELLDSLRKVLKVVEEVLRLLNEVNKEVLDVIRELAKDGGSDEIIRKLDELLKEVEKVHKEVKDRIRKLLEDHKRSLDEVKKKLERLLERAKEVVEREKK(SEQ ID NO: 27232) | 3plus1_Key_Cterm_605 | DEIIRKLDELLKEVEKVHKEVKDRIRKLLEDHKRSLDEVKKKLERLLERAKEVVEREKK(SEQ ID NO: 27233) |

TABLE 2-continued

| Cage Name | Cage Sequence | Key Name | Key Sequence |
|---|---|---|---|
| 3plus1_Cage_Cterm_607 | SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR(SEQ ID NO: 27234) | 3plus1_Key_Cterm_607 | SETAVRAIIRVLEKHLEAVRRVLEELLKVLAEHLETVRELIERLKRVLEEAIEVVERVAR(SEQ ID NO: 27235) |
| 3plus1_Cage_Cterm_610 | SLEEITKRLLELVEENLARHEEILRELLELAKRLAKEDRDILEEVLKLIEELLKLLEDNGSSEEDLKRLLKEVIEELRAVVKRVDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE(SEQ ID NO: 27236) | 3plus1_Key_Cterm_610 | ERTLREVVRKVLEEAKRLLDELEEVHKRVKKELEDIIEENRRVVKRVRDELREIKRELDE(SEQ ID NO: 27237) |
| 3plus1_Cage_611_GFP11_Cterm | SLEEITKRLLELVEENLARHEEILRELLELAKRLAKEDRDILEEVLKLIEELLKLLEDNGSSEEDLKRLLKEVIEELRAVVKRVDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERDHMVLHEYVNAAGITLLDELEEVHKRVKKELEDIIEENRRVVKRVRDELREIKRELDE(SEQ ID NO: 27238) | 3plus1_Key_Cterm_611 | ERTLREVVRKVLEEAKRLLDELEEVHKRVKKELEDIIEENRRVVKRVRDELREIKRELDE(SEQ ID NO: 27239) |
| 3plus1_Cage_Cterm_632 | SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRVLDLVDEVVKRVEDLVERVKEKIDT(SEQ ID NO: 27240) | 3plus1_Key_Cterm_632 | DSLVREVEELIKRLEKHIDDLLKTSRDLVKRVLDLVDEVVKRVEDLVERVKEKIDT(SEQ ID NO: 27241) |
| 3plus1_Cage_Cterm_641 | DEVEELLKRVRELLKASEELVRKILEDVKRLLERSIEEVEDLLRKVEELLRLLDLVERGGSLDEILRELVRLLKEIVRKVLELNRKLVRSKIRIAKRLLELNAESVKEWDRILKLLRDGTGDKEELLKDAEEEALEKYERAVREILKELEEIIKEYVRRVEELLKELKDAVDKAKDEVRKGSGDEDLIRDVDRVLKEIMDLLRDLVRRTKELLEEELLRLLEELVRAHKELVRSILDEIRK(SEQ ID NO: 27242) | 3plus1_Key_Cterm_641 | EDLIRDVDRVLKEIMDLLRDLVRRTKELLEELLRLLEELVRAHKELVRSILDEIRK(SEQ ID NO: 27243) |
| 3plus1_Cage_646_GFP11_Cterm | DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNRDHMVLHEYVNAAGITRKLLEDVKKASEDIVREVERIVRELAKRSDEILKKLEDIVEKLRE(SEQ ID NO: 27244) | 3plus1_Key_Cterm_646 | EDVKRALEELVSRLRKLLEDVKKASEDIVREVERIVRELAKRSDEILKKLEDIVEKLRE(SEQ ID NO: 27245) |
| 3plus1_Cage_646_GFP11_Cterm | DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDRDHMVLHEYVNAAGITEDVKKASEDIVREVERIVRELAKRSDEILKKLEDIVEKLRE(SEQ ID NO: 27246) | 3plus1_Key_Cterm_646 | EDVKRALEELVSRLRKLLEDVKKASEDIVREVERIVRELAKRSDEILKKLEDIVEKLRE(SEQ ID NO: 27247) |
| 3plus1_Cage_646_GFP11_Cterm | DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVRDHMVLHEYVNAAGITDVKKASEDIVREVERIVRELAKRSDEILKKLEDIVEKLRE(SEQ ID NO: 27248) | 3plus1_Key_Cterm_646 | EDVKRALEELVSRLRKLLEDVKKASEDIVREVERIVRELAKRSDEILKKLEDIVEKLRE(SEQ ID NO: 27249) |
| 3plus1_Cage_647_GFP11_Cterm | DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLRDHMVLHEYVNAAGITKLLEDVKKASEDIVREVERIVRELAKRSDEILKKLEDIVEKLRE(SEQ ID NO: 27250) | 3plus1_Key_Cterm_647 | EDVKRALEELVSRLRKLLEDVKKASEDIVREVERIVRELAKRSDEILKKLEDIVEKLRE(SEQ ID NO: 27251) |
| 3plus1_Cage_647_GFP11_Cterm | DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALERDHMVLHEYVNAAGITSEDIVREVERIVRELAKRSDEILKKLEDIVEKLRE(SEQ ID NO: 27252) | 3plus1_Key_Cterm_647 | EDVKRALEELVSRLRKLLEDVKKASEDIVREVERIVRELAKRSDEILKKLEDIVEKLRE(SEQ ID NO: 27253) |
| 3plus1_Cage_Cterm_647 | DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE(SEQ ID NO: 27254) | 3plus1_Key_Cterm_647 | EDVKRALEELVSRLRKLLEDVKKASEDIVREVERIVRELAKRSDEILKKLEDIVEKLRE(SEQ ID NO: 27255) |

TABLE 2-continued

| Cage Name | Cage Sequence | Key Name | Key Sequence |
|---|---|---|---|
| 3plus1_Cage_Cterm_653 | DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD(SEQ ID NO: 27256) | 3plus1_Key_Cterm_653 | SREALEEARRRLEELLRELNEITKDLEAKLEKLLRDLNELTKALEEEELKRLIDELKKRTD(SEQ ID NO: 27257) |
| 3plus1_Cage_Cterm_658 | DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLLEDYKRLIEEVKKELDKLLKEYEDALREIKKRIDE(SEQ ID NO: 27258) | 3plus1_Key_Cterm_658 | KDTLRTVEKLVEDVKRRLDKLLEDYKRLIEEVKKELDKLLKEYEDALREIKKRIDE(SEQ ID NO: 27259) |
| 3plus1_Cage_Cterm_660 | TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLEEYKAIIEELERELERLLLREHREVIRRIKEEIDKSSK(SEQ ID NO: 27260) | 3plus1_Key_Cterm_660 | REEVKRVLEEARDELRRLLEEYKAIIEELERELERLLLREHREVIRRIKEEIDKSSK(SEQ ID NO: 27261) |
| 3plus1_Cage_Nterm_263 | SLVDELRKSLERNVRVSEEVARRLKEALKRWVDVVRKVVEDLIRLNEDVVRVVEKVTVDESAIERVRRIIEELNRKLDAVLKKNEDLVRRLTELLDKLLEENRRLVEELDEDLKRRGGTEEVIDTILELIERSIERLKRLLDELLRIVREALKDNKRVADENLKKLKEILDELRKDGVEDEELKRVLEKAADLHRRLKDRHRKLLEDLERIIRELKKKLDEVVEENKRSVDELKR(SEQ ID NO: 27262) | 3plus1_Key_Nterm_263 | SLVDELRKSLERNVRVSEEVARRLKEALKRWVDVVRKVVEDLIRLNEDVVRVVEKV(SEQ ID NO: 27263) |
| 3plus1_Cage_Nterm_500 | SEKEELKRLLDKLLKELKRLSDELKATIDKILKILKEVSEEVKRTADELLDAIRRGGVDDEVLREIKREIEEIEKKLRKVNKEIEDEIREIKKKLDEVDDKTVKEVEKIKEALDKGGVDAKEVIKALKEILKEHADVFEDVLRRLKEIIKRHRDVVKEVLEELRKILEKVAEVLKRQGRSEDELRKVEEDLKRLEDKLKKLLEDYEKKVRELEETLDDLLRKYEETLRRLEKELEEAER(SEQ ID NO: 27264) | 3plus1_Key_Nterm_500 | SEKEELKRLLDKLLKELKRLSDELKATIDKILKILKEVSEEVKRTADELLDAIRRG(SEQ ID NO: 27265) |
| 3plus1_Cage_Nterm_510 | SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEE GGASEDLLRKAKKVITEVREKLKRNLEDVRRVIEDVKRKSARILEEARRLIEEVERELEKIRK(SEQ ID NO: 27266) | 3plus1_Key_Nterm_510 | SEKEELLKLIKRVIELLKRVLEEHLRLVEDVIRRLKELLDSNEKIVREVIEDLKRLLDEV(SEQ ID NO: 27267) |
| 3plus1_Cage_529_GFP11_Nterm | SEAEDLEELIKELAELLKDVIRKLEKINRRLVKILRDHMVLHEYVNAAGITELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST(SEQ ID NO: 27268) | 3plus1_Key_529_GFP11_Nterm | SEAEDLEELIKELAELLKDVIRKLEKINRRLVKILEDIIRRLKEISKRAEEELRKG(SEQ ID NO: 27269) |
| 3plus1_Cage_568_GFP11_Nterm | KEIEETLKELEDLNREMVETNRRVLEETRRLNKETVDRVKATRDHMVLHEYVNAAGITKGPTSEELKRLLAELEELLARVVRRVEELLKSTDLLERAVKDSADALRRSHEVLKEVASRVKRAKDEGLPREEVLRLLREEHERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT(SEQ ID NO: 27270) | 3plus1_Key_568_GFP11_Nterm | KEIEETLKELEDLNREMVETNRRVLEETRRLNKETVDRVKATLDELAKMLKKLVDDVRKG(SEQ ID NO: 27271) |
| 3plus1_Cage_Nterm_581 | SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVRELEKVLKESLDTLEEIIRRLDEANAATVKRVADVIRELEDINRKVLEEIKRGSDDAEAVIKVIEKLIRANKRVWDALLKINEDLVRVNKTVWKELLRVNEKLARDLERVVK(SEQ ID NO: 27272) | 3plus1_Key_Nterm_581 | SALETVKKLLEDSSEKIERIVEEDERVAKESSDRIRRLVEEDKRVADEILDLIEKI(SEQ ID NO: 27273) |
| 3plus1_Cage_610_GFP11_Nterm | SLEEITKRLLELVEENLARHEEILRELLELAKRLAKRDHMVLHEYVNAAGITLKLLEDNGSSEEDLKRLLKEVIEELRAVVKRVDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEARLLDELEEVHKRVKKELEDIIEENRRVVKRVRDELREIKRELDE(SEQ ID NO: 27274) | 3plus1_Key_610_GFP11_Nterm | SLEEITKRLLELVEENLARHEEILRELLELAKRLAKEDRDILEEVLKLIEELLKLLEDN(SEQ ID NO: 27275) |
| 3plus1_Cage_647_GFP11_Nterm | DAEEVVKRLADVLRENDETIRKVVEDLVRIAEENDRLWRDHMVLHEYVNAAGITLLRRGGVPEELLDRLAKVVKSIVEKAEKILERLNRVSKAIAEKLKTIVDELNEKVIKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE(SEQ ID NO: 27276) | 3plus1_Key_647_GFP11_Nterm | DAEEVVKRLADVLRENDETIRKVVEDLVRIAEENDRLWKKLVEDIAEILRRIVELLRRG(SEQ ID NO: 27277) |

TABLE 3

| Row number | Cage (column 1) | Key (column 2) |
|---|---|---|
| 1 | LOCKR_extend18 (SEQ ID NO: 6), BimLOCKR_extend18 (SEQ ID NO: 22), , 1fix-long-Bim-t0 (SEQ ID NO: 54), 1fix-long-GFP-t0 (SEQ ID NO: 55), | p18_MBP (SEQ ID NO: 27020), p76-long (SEQ ID NO: 27027), p76-short (SEQ ID NO: 27028), |
| | 1fix-short-BIM-t0 (SEQ ID NO: 56), 1fix-short-GFP-t0 (SEQ ID NO: 57), | |
| 2 | LOCKRb (SEQ ID NO: 7), | key_b (SEQ ID NO: 27022) |
| 3 | LOCKRc (SEQ ID NO: 8), | key_c (SEQ ID NO: 27023) |

TABLE 4

| Cage Name | Cage Sequence | Key Name | Key Sequence |
|---|---|---|---|
| 2plus1_Cage_Cterm_2406 | SEVDEVVKEVEDLVRRNEELVEEVVRRVEKVVTDDRRLVEEVVREIRKIVKDVEDLARKLDKEELKRVLDEMRERIERLLEKLRRHSKKLDDELKRLLEELREHSRRVEKRLEDLLKELRERGVDEKVLRKLEKVIREVRERSTRALRKVEEVIRRVREESERALRDLERVVKEVEKRMREAAR (SEQ ID NO: 27126) | 2plus1_Key_Cterm_2406 | EKVLRKLEKVIREVRERSTRALRKVEEVIRRVREESERALRDLERVVKEVEKRMREAAR(SEQ ID NO: 27127) |
| 2plus1_Cage_Cterm_5398 | SVEELLRKLEEVLRKIREENERSLKELRDRAREIVKRNRETNRELEEVIKELEKRLSGADKEKVEELVRRRIRRIVERVVEEDRRTVEEIEKIAREVVKRDRDSADRVRRTVEDVLRKATGSEDIVRKIERIVETIEREVRESVKKVEEIARDIRRKVDESVKNVEKLLRDVDKKARDRKK(SEQ ID NO: 27128) | 2plus1_Key_Cterm_5398 | EDIVRKIERIVETIEREVRESVKKVEEIARDIRRKVDESVKNVEKLLRDVDKKARDRKK(SEQ ID NO: 27129) |
| 2plus1_Cage_Cterm_5405 | SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER(SEQ ID NO: 27130) | 2plus1_Key_Cterm_5405 | EEKLKDLIRKLRDILRRAAEAHKKLIDDARESLERAKREHEKLIDRLKKILEELER(SEQ ID NO: 27131) |
| 2plus1_Cage_Cterm_5406 | DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDSEELREELKKLERKIEKVAKEIHDHDKEVTERLEDLLRRITEHARKSDREIEETAR(SEQ ID NO: 27132) | 2plus1_Key_Cterm_5406 | EELREELKKLERKIEKVAKEIHDHDKEVTERLEDLLRRITEHARKSDREIEETAR(SEQ ID NO: 27133) |
| 2plus1_Cage_Cterm_5409 | SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDENAKIVEDARRALEKIVKENEEILRRLKKELRELRK(SEQ ID NO: 27134) | 2plus1_Key_Cterm_5409 | KEVVDEIKRIVDEVRERLKRIVDENAKIVEDARRALEKIVKENEEILRRLKKELRELRK(SEQ ID NO: 27135) |
| 2plus1_Cage_5414_GFP11_Cterm | SEIEKILKEIEDLARRRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERDHMVLHEYVNAAGITSEKSNEEVKRTVEELVRRMEESNDRVRDLVRRLVEELKRAVD(SEQ ID NO: 27140) | 2plus1_Key_Cterm_5414 | EDSERLVREVEDLVRRLVRRSEKSNEEVKRTVEELVRRMEESNDRVRDLVRRLVEELKRAVD (SEQ ID NO: 27141) |
| 2plus1_Cage_Cterm_5421 | SVDEVLKEIEDALRRLKEEVERVLKENEDELRRLEEEVRRVLKEDEELLESLKRGVGESDVRRVDEIAKLSAEILEKVKKVVKEIRDSLETVKRRVDDVVRRLKELLDEIKRGSDEKAIRDVAKEIRDRLKELEEEIEEVTRRNLKLLADVEEEIRRVHEKTRRLLETVLRRAT(SEQ ID NO: 27146) | 2plus1_Key_Cterm_5421 | EKAIRDVAKEIRDRLKELEEEIEEVTRRNLKLLADVEEEIRRVHEKTRRLLETVLRRAT(SEQ ID NO: 27147) |
| 2plus1_Cage_Cterm_5432 | DEIRKVVKEITDLLKASNDKNRKVVEEIRDLLRRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR (SEQ ID NO: 27148) | 2plus1_Key_Cterm_5432 | SEDLKRVEERAREVSRRNEESMRRVKEDADRVSEANKEVLDRVREEVKRLIEEVRETLR(SEQ ID NO: 27149) |
| 2plus1_Cage_Cterm_5435 | STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIKHSEEVLERVKRLIDELRKHSEEVLEDLRRRAK(SEQ ID NO: 27150) | 2plus1_Key_Cterm_5435 | EEAAREIIKRLREVNKRTKEKLDELIKHSEEVLERVKRLIDELRKHSEEVLEDLRRRAK(SEQ ID NO: 27151) |
| 2plus1_Cage_Cterm_5439 | SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK(SEQ ID NO: 27154) | 2plus1_Key_Cterm_5439 | EDKARKVAEVAEKVLRDIDKLDRESKEAFRATNEEIAKLDEDTARVAERVKKAIEDLAK(SEQ ID NO: 27155) |

TABLE 4-continued

| Cage Name | Cage Sequence | Key Name | Key Sequence |
|---|---|---|---|
| 2plus1_Cage_Cterm_5447 | SEADDVLKKLAETVKRIIERLKKLTDDSRRLVEEVHRRNDKLSKES AEAVRKAEERGIDEKDVRKLLEDLKKKSEEVAERNKRILDTLREIS KRAEDEVRKVLKELEKTLKELEDRRPDSEELSAEVKKLLDEVRKAL ARHKDENDKLLKEIEDSLRRHKEENDRLLEKLKESTR(SEQ ID NO: 27156) | 2plus1_Key_Cterm_5447 | EELSAEVKKLLDEVRKALARHKDEND KLLKEIEDSLRRHKEENDRLLEKLKE STR(SEQ ID NO: 27157) |
| 2plus1_Cage_Cterm_5456 | SAEELLREVAELVKRVDEDLRRLLEEVRASNEEVIRRLEEILKRIE EENRKVVEELRRGGVSEDLVRESKRLVDESRRVIEKLVKESADSVE RTRETVDRLREELKRLVEEIAKMVKGGSSEETVKRLLDELRELLER LKRTIEELLKRNRDLLADAEEKARRLLEENRKLLKAARDTAT(SEQ ID NO: 27158) | 2plus1_Key_Cterm_5465 | EETVKRLLDELRELLERLKRTIEELL KRNRDLLADAEEKARRLLEENRKLLK AARDTAT(SEQ ID NO: 27159) |
| 2plus1_Cage_Nterm_2406 | SEVDEVVKEVEDLVRRNEELVEEVVRRVEKVVTDDRRLVEEVVREI RKIVKDVEDLARKLDKEELKRVDEMRERIERLLEKLRRHSKKLDD ELKRLLEELREHSRRVEKRLEDLLKELRERGVDEKVLRKLEKVIRE VRERSTRALRKVEEVIRRVREESERALRDLERVVKEVEKRMREAAR (SEQ ID NO: 27162) | 2plus1_Key_Nterm_2406 | SEVDEVVKEVEDLVRRNEELVEEVVR RVEKVVTDDRRLVEEVVREIRKIVKD VEDLARK(SEQ ID NO: 27163) |
| 2plus1_Cage_Nterm_5406 | DREREVKKRLDEVRERIERLLRRVEEESRRVAEEIRRLIEEVRRRN KKVTEEIRELLKGLKDKEEVRRVLERLRKLNAESDELLERILERLR RLVEATNRLVKAIIEELRRLVEKIVREVPDSEELREELKKLERKIE KVAKEIHDHDKEVTERLEDLLRRITEHARKSDREIEETAR(SEQ ID NO: 27164) | 2plus1_Key_Nterm_5406 | DREREVKKRLDEVRERIERLLRRVEE ESRRVAEEIRRLIEEVRRRNKKVTEE IRELLKGL(SEQ ID NO: 27165) |
| 2plus1_Cage_Nterm_5409 | SEAEELLKRLEDRAEEILRRLEEILRTSRKLAEDVLRELEKLLRES ERRIREVLEELRGIKDKKELEDVIREVEKELDESLERSRELLKDVL KKLDDNLKESERLVEDIDRELAKILEDLKKAGVPKEVVDEIKRIVD EVRERLKRIVDENAKIVEDARRALEKIVKENEEILRRLKKELRELR K(SEQ ID NO: 27166) | 2plus1_Key_Nterm_5409 | SEAEELLKRLEDRAEEILRRLEEILR TSRKLAEDVLRELEKLLRESERRIRE VLEELRGI(SEQ ID NO: 27167) |
| 3plus_Cage_529_GFP11 Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDKDEAERRDHMVLHEYVNAAGITEEVKRRLEEEELTRLRETHKK IEKELREALKRVRDRST(SEQ ID NO: 27178) | 3plus_Key_Cterm_529 | KDEAERRRRELKDKLDRLREEHEEVK RRLEEEELTRLRETHKKIEKELREALK RVRDRST(SEQ ID NO: 27179) |
| 3plus1_Cage_Cterm_500 | SEKEELKRLLDKLLKELKRLSDELKATIDKILKILKEVSEEVKRTA DELLDAIRRGGVDEEVLREIKREIEEIEKKLRKVNKELEEDEIREK KKLDEVDDKITKEVEKIKEALDKGGVDAKEVIKALKEILKEHADVF EDVLRRLKEIIKRHRDVVKEVLEELRKILEKVAEVLKRQGRSEDEL RKVEEDLKRLEDKLKKLLEDYEKKVRELEETLDDLLRKYEETLRRL EKELEEEAER(SEQ ID NO: 27184) | 3plus1_Key_Cterm_500 | EDELRKVEEDLKRLEDKLKKLLEDYE KKVRELEETLDDLLRKYEETLRRLEK ELEEEAER(SEQ ID NO: 27185) |
| 3plus1_Cage_Cterm_510 | SEKEELLKLIKRVIELLKRVLEEHLRLVEDVIRRLKELLDSNEKIV REVIEDLKRLLDEVRGDKEELDRIKEKLEEVLERYKRRLEEIKRDL ERMLEDYKRELKRIEEDLRRVLEEVERIATRGEGPAEALIDKLRKI LERALRELDKLSKKLDELLKKVLEELEKSNREIDKLLKDVLRRVEE GGASEDLLRKAKKVITEVREKLKRNLEDVRRVIEDVKRKSARILEE ARRLIEEVERELEKIRK(SEQ ID NO: 27190) | 3plus1_Key_Cterm_510 | EDLLRKAKKVITEVREKLKRNLEDVR RVIEDVKRKSARILEEARRLIEEVER ELEKIRK(SEQ ID NO: 27191) |
| 3plus1_Cage_528_GFP11 Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGRDHMVLHEYVNAAGITLDRLREEHEEVKRRLEEEELTRLRETHKK IEKELREALKRVRDRST(SEQ ID NO: 27192) | 3plus1_Key_Cterm_528 | KDEAERRRRELKDKLDRLREEHEEVK RRLEEEELTRLRETHKKIEKELREALK RVRDRST(SEQ ID NO: 27193) |
| 3plus1_Cage_528_GFP11 Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDKRDHMVLHEYVNAAGITLREEHEEVKRRLEEEELTRLRETHKK IEKELREALKRVRDRST(SEQ ID NO: 27194) | 3plus1_Key_Cterm_528 | KDEAERRRRELKDKLDRLREEHEEVK RRLEEEELTRLRETHKKIEKELREALK RVRDRST(SEQ ID NO: 27195) |
| 3plus1_Cage_528_GFP11 Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDKDEAERDHMVLHEYVNAAGITEEVKRRLEEEELTRLRETHKK IEKELREALKRVRDRST(SEQ ID NO: 27196) | 3plus1_Key_Cterm_528 | KDEAERRRRELKDKLDRLREEHEEVK RRLEEEELTRLRETHKKIEKELREALK RVRDRST(SEQ ID NO: 27197) |

TABLE 4-continued

| Cage Name | Cage Sequence | Key Name | Key Sequence |
|---|---|---|---|
| 3plus1_Cage_529_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKRDHMVLHEYVNAAGITDRLREEHEEVKRRLEEELTRLRETHKK IEKELREALKRVRDRST(SEQ ID NO: 27198) | 3plus1_Key_Cterm_529 | KDEAERRRELKDKLDRLREEHEEVK RRLEEELTRLRETHKKIEKELREALK RVRDRST(SEQ ID NO: 27199) |
| 3plus1_Cage_529_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKRDRDHMVLHEYVNAAGITRLREEHEEVKRRLEEELTRLRETHKK IEKELREALKRVRDRST(SEQ ID NO: 27200) | 3plus1_Key_Cterm_529 | KDEAERRRELKDKLDRLREEHEEVK RRLEEELTRLRETHKKIEKELREALK RVRDRST(SEQ ID NO: 27201) |
| 3plus1_Cage_529_GFP11_Cterm | SEAEDLEELIKELAELLKDVIRKLEKINRRLVKILEDIIRRLKEIS KEAEEELRKGTVEDKDILRDLERRLREILEESDRLLEELKRRLEEI LRKSKELLRRLEEVLREILKRAEEVKRSNLPKEELIKEIVKLLEEL LRVIEKILEDNIRLLEELVEVIKEILEKHLRLLEELVRVIERILRE VGKDKRDHMVLHEYVNAAGITREEHEEVKRRLEEELTRLRETHKK IEKELREALKRVRDRST(SEQ ID NO: 27202) | 3plus1_Key_Cterm_529 | KDEAERRRELKDKLDRLREEHEEVK RRLEEELTRLRETHKKIEKELREALK RVRDRST(SEQ ID NO: 27203) |
| 3plus1_Cage_534_GFP11_Cterm | DEDRIIEEIARLLEELLRELLELIKKLIETNRRLNEEHERAVRELA RLLEELLDRLVKKGISDEKLKRIRERLKRALDDLERLHREINKRLE DLVRELEKLVREILKELKDALEELRRASARAGGEEVLRRLEEIVKK LLDLVRRILERLKEIHKDNVRLLRELNERLTRIVEDLVRLIREILR EAGVDERDHMVLHEYVNAAGITIKRLHEDLERKLKESEDELREIEA RLEEKIRRLEEKLERKRR(SEQ ID NO: 27206) | 3plus1_Key_Cterm_534 | EKIAEEIERELEELRRMIKRLHEDLE RKLKESEDELREIEARLEEKIRRLEE KLERKRR(SEQ ID NO: 27207) |
| 3plus1_Cage_534_GFP11_Cterm | DEDRIIEEIARLLEELLRELLELIKKLIETNRRLNEEHERAVRELA RLLEELLDRLVKKGISDEKLKRIRERLKRALDDLERLHREINKRLE DLVRELEKLVREILKELKDALEELRRASARAGGEEVLRRLEEIVKK LLDLVRRILERLKEIHKDNVRLLRELNERLTRIVEDLVRLIREILR EAGVDEKIRDHMVLHEYVNAAGITRLHEDLERKLKESEDELREIEA RLEEKIRRLEEKLERKRR(SEQ ID NO: 27208) | 3plus1_Key_Cterm_534 | EKIAEEIERELEELRRMIKRLHEDLE RKLKESEDELREIEARLEEKIRRLEE KLERKRR(SEQ ID NO: 27209) |
| 3plus1_Cage_534_GFP11_Cterm | DEDRIIEEIARLLEELLRELLELIKKLIETNRRLNEEHERAVRELA RLLEELLDRLVKKGISDEKLKRIRERLKRALDDLERLHREINKRLE DLVRELEKLVREILKELKDALEELRRASARAGGEEVLRRLEEIVKK LLDLVRRILERLKEIHKDNVRLLRELNERLTRIVEDLVRLIREILR EAGVDEKIAEEIERDHMVLHEYVNAAGITLERKLKESEDELREIEA RLEEKIRRLEEKLERKRR(SEQ ID NO: 27210) | 3plus1_Key_Cterm_534 | EKIAEEIERELEELRRMIKRLHEDLE RKLKESEDELREIEARLEEKIRRLEE KLERKRR(SEQ ID NO: 27211) |
| 3plus1_Cage_Cterm_539 | SEKEKLLLKESEEEVRRLRRTLEELLRKYREVLERLRKELREIEERV RDVVRRLKEVLDRKGLDIDTIIKEVEDLLKTVLDRLRELLDKIRRL TKEAIEVVREIIERIVRHAERVKDELRKEGGDKEKLDRVDRLIKEN TRHLKEILDRIEDLVRRSEKKLRDIIREVRRLIEELRKKAEEIKKG PDERLVKTLIEDVEAVIKRILELITRVAEDNERVLERIIRELTDNL ERHLKIVREIVK(SEQ ID NO: 27212) | 3plus1_Key_Cterm_539 | ERLVKTLIEDVEAVIKRILELITRVA EDNERVLERIIRELTDNLERHLKIVR EIVK(SEQ ID NO: 27213) |
| 3plus1_Cage_Cterm_548 | DKAEVLREALKLLKDLLEELIKIHEESLKRILDLIDTLVKVHEDAL RALKELLERSGLDERELRKVERMATESLRTIAKLKEELRDLARRSL EKLREDLKRVDDTLRKVEEKVRRTGPSEELIEEELIRTIEKLLKEIV RINEEVLKAVRELLKTLLKLSEDVVRRIEEILRKGGVPEEIDRELK RVVEELRRLHEEIKERLDDVARRSEEELRRIIKKLKEVVKEIRKKL K(SEQ ID NO: 27214) | 3plus1_Key_Cterm_548 | EEIDRELKRVVEELRRLHEEIKERLD DVARRSEEELRRIIKKLKEVVKEIRK KLK(SEQ ID NO: 27215) |
| 3plus1_Cage_Cterm_556 | SERELIERWLELHKEILRLIRELVERLLKLHREILDTIKKLIRELL ELLEDIARKLGLDKEAKDELREIAKRVEDKLEKLERESRKVEEDLK RKLKELTDESDTVEKRVRDVVRRGTQSREEIAEEELLRLDRKLLKAV EELLKEILDLNKKLLDDVRAILEETRRVLEKLLDRVRRGERTDDER RTLTELLKRMEDILEKVERTLKKLLDDSARMAEEVKKTLKELLERS EKVAEDVRK(SEQ ID NO: 27216) | 3plus1_Key_Cterm_556 | DDERRTLTELLKRMEDILEKVERTLK KLLDDSARMAEEVKKTLKELLERSEK VAEDVRK(SEQ ID NO: 27217) |
| 3plus1_Cage_Cterm_560 | SKKELLEEVVRRAIELLKRHLEKLKRILEEIVRLLEEHLEKVERVL RAILSLLDDLLRRGGDERAIRTLEDVKRRLREILERLADENAKAIK RLADLLDKLEKRNKEAIERLEEILEELKRVRRDEELLRVLETLLKI IEDILRENTKVLEDLLRLVEEILEANLRVVEELLRLAREILTEIVG DEDKLKEIEDELRRLLEELRRLDKAIKDRLRELKKDLDEANRRIKE TLKKLLREVEK(SEQ ID NO: 27218) | 3plus1_Key_Cterm_560 | EDKLKEIEDELRRLLEELRRLDKAIK DRLRELKKDLDEANRRIKETLKKLLR EVEK(SEQ ID NO: 27219) |
| 3plus1_Cage_568_GFP11_Cterm | KEIEETLKELEDLNREMVETNRRVLEETRRLNKETVDRVKATLDEL AKMLKKLVDDVRKGPTSEELKRLLAELEELLARVVRRVEELLKKST DLLERAVKDSADALRRSHEVLKEVASRVKRAKDEGLPREEVLRLLR ELLERHAKVLKDIVRVSEKLLREHLKVLREIVEVLEELLERILKVI LDTTRDHMVLHEYVNAAGITKRRLKEVIDRYEDELRKLRKEYKEKI DKYERKLEEIERRERT(SEQ ID NO: 27220) | 3plus1_Key_Cterm_568 | KAVEELEKALEEIKRRLKEVIDRYED ELRKLRKEYKEKIDKYERKLEEIERR ERT(SEQ ID NO: 27221) |

TABLE 4-continued

| Cage Name | Cage Sequence | Key Name | Key Sequence |
|---|---|---|---|
| 3plus1_Cage_568_GFP11_Cterm | KEIEETLKELEDLNREMVETNRRVLEETRRLNKETVDRVKATLDEL AKMLKKLVDDVRKGPTSEELKRLLAELEELLARVVRRVEELLKKST DLLERAVKDSADALRRSHEVLKEVASRVKRAKDEGLPREEVLRLLR ELLERHAKVLKDIVRVSEKLLREHLKVLREIVEVLEELLERILKVI LDTTGGDRDHMVLHEYVNAAGITLKEVIDRYEDLRLRKEYKEKI DKYERKLEEIERRERT(SEQ ID NO: 27222) | 3plus1_Key_Cterm_568 | KAVEELEKALEEIKRRLKEVIDRYED ELRLRKEYKEKIDKYERKLEEIERR ERT(SEQ ID NO: 27223) |
| 3plus1_Cage_Cterm_581 | SALETVKKLLEDSSEKIERIVEEDERVAKESSDRIRRLVEEDKRVA DEILDLIEKIGDTDTLLKLVEEWSRTSKKLLDDVLKLHKDWSDDSR RLLEEILRVVHEELIRRVKEILDREGKPEEVVRELEKVLKESLDTLE EIIRRLDEANAATVKRVADVIRELEDINRKVLEEIKRGSDDAEAVI KVIEKLIRANKRVWDALLKINEDLVRVNKTVWKELLRVNEKLARDL ERVVK(SEQ ID NO: 27226) | 3plus1_Key_Cterm_581 | AEAVIKVIEKLIRANKRVWDALLKIN EDLVRVNKTVWKELLRVNEKLARDLE RVVK(SEQ ID NO: 27227) |
| 3plus1_Cage_Cterm_585 | SKEEKLKDDVRAVLEDLDRVLKELEKLSEDNLRELKRVLDRITDLH RRILDELRKGIGSEELLRRVEKVLKDNLDLLRKLVEEHKESSERDL KRVEDLVREIKEVLRKLLELEDRGTDIRKIEEEIERLLRKIRKAVE ESKDLNRRNSERIEEVARRSEELARRLLLKEIRERGDSKAAEDILRV LEKLVKVSREAIKLILELSEHHVRVSTRIARLLLDVARKLAEVIKE AER(SEQ ID NO: 27228) | 3plus1_Key_Cterm_585 | SKAAEDILRVLEKLVKVSREAIKLIL ELSEHHVRVSTRIARLLLDVARKLAE VIKEAER(SEQ ID NO: 27229) |
| 3plus1_Cage_Cterm_587 | SEIEDVIRRLRKILEDLERVSEKLLREIKKILDEARRLNEEVIKEI KRVLEDAVRVFRDGSGSKEELAKVVEELIRELAKLAKEVDEIHKRI VERLKALVEDAERIHRKIVETLEEIVRGVPSEELKRVVEAIVEVIK EHLKVLADVIRRIIKAIEENAETIKRVLEDIVRVLELVLRGEGSIE DLVREVERLIKRIEDSLRELEKTVRELLKRIKEASDKVREDVDRLI KELKEAAD(SEQ ID NO: 27230) | 3plus1_Key_Cterm_587 | IEDLVREVERLIKRIEDSLRELEKTV RELLKRIKEASDKVREDVDRLIKELK EAAD(SEQ ID NO: 27231) |
| 3plus1_Cage_Cterm_605 | SREELLDRILEAIAKILEDLKRLIDENLARLEEVVRELERIIDRNL KLIREILDELKKGSGSEEILEKIKKVDKELEDLIRRLLKKLEDLIR ETERRLREILKRIRDLLKEVKDRDKDLERLLEVLEEVLRVIAELAK ELLDSLRKVLKVVEEVLRLLNEVNKEVLDVIRELAKDGGSDEIIRK LDELLKEVEKVHKEVKDRIRKLLEDHKRSLDEVKKKLERLLERAKE VVEREKK(SEQ ID NO: 27232) | 3plus1_Key_Cterm_605 | DEIIRKLDELLKEVEKVHKEVKDRIR KLLEDHKRSLDEVKKKLERLLERAKE VVEREKK(SEQ ID NO: 27233) |
| 3plus1_Cage_Cterm_607 | SEREELLERIKEILKRVKDKLDEDLKRLKEILEKLKEKADRDLEEL RRRIEEVREKLERTGRTDELVKEVLDTVRRNLENLKRLVEDILRKL EENVKNLTDLVREILKLITELIKRLEDGGLPKEVLDALRRVLEKLE ELLREILERLKRSLEAVKRKIEELLKELERSLDELRRALERIRLE GDSETAVRAIIRVLEKHLEAVRRVLEELLKVLAEHLETVRELIERL KRVLEEAIEVVERVAR(SEQ ID NO: 27234) | 3plus1_Key_Cterm_607 | SETAVRAIIRVLEKHLEAVRRVLEEL LKVLAEHLETVRELIERLKRVLEEAI EVVERVAR(SEQ ID NO: 27235) |
| 3plus1_Cage_611_GFP11_Cterm | SLEEITKRLLELVEENLARHEEILRELLELAKRLAKEDRDILEEVL KLIEEELLKLLEDNGSSEEDLKRLLKEVIEELRAVVKRVKDKWDEVV KRIEDLVKKLKELHDDTLRKLRELVRKIVTDISESGGEAAKVKRVV EKILELVERLAKVVKESVEKLLEILRELAEVSKRVAEALLRLLEEL VRVIRIKDERDHMVLHEYVNAAGITLLDELEEVHKRVKKELEDIIE ENRRVVKRVRDELREIKRELDE(SEQ ID NO: 27238) | 3plus1_Key_Cterm_611 | ERTLREVVRKVLEEAKRLLDELEEVH KRVKKELEDIIEENRRVVKRVRDELR EIKRELDE(SEQ ID NO: 27239) |
| 3plus1_Cage_Cterm_632 | SEKELVDDIRRILEEILRLLRSLLEEVIRLLEENEKLVRRHLKTVI DILRRVAKLLDENGIRTDEADRVLERLEKAHRELLEDYKRALEKVL ETLERVLREAEEVVKKIDDALRKLGGSKEVLKRLLEELLRLVEKIA EEIKRLLSELVRVTEELVRTNKELLEEAVRVIRKEVGDDSLVREVE ELIKRLEKHIDDLLKTSRDLVKRVLDLVDEVVKRVEDLVERVKEKI DT(SEQ ID NO: 27240) | 3plus1_Key_Cterm_632 | DSLVREVEELIKRLEKHIDDLLKTSR DLVKRVLDLVDEVVKRVEDLVERVKE KIDT(SEQ ID NO: 27241) |
| 3plus1_Cage_646_GFP11_Cterm | DAEEVVKRLADVLRENDETIRKVVEDLVRIAEENDRLWKKLVEDIA EILRRIVELLRRGGVPEELLDRLAKVVKSIVEKAEKILERLNRVSK AIAEKLKTIVDELNEVSKEIVKRAEDILRKGKDKETVLRALRTLVK EYADLSKEVLERVERIVREYVKLSDEVVKSLAEIVEELIRIIEDLL RKGNRDHMVLHEYVNAAGITRKLLEDVKKASEDIVREVERIVRELA KRSDEILKKLEDIVEKLRE(SEQ ID NO: 27244) | 3plus1_Key_Cterm_646 | EDVKRALEELVSRLRKLLEDVKKASE DIVREVERIVRELAKRSDEILKKLED IVEKLRE(SEQ ID NO: 27245) |
| 3plus1_Cage_646_GFP11_Cterm | DAEEVVKRLADVLRENDETIRKVVEDLVRIAEENDRLWKKLVEDIA EILRRIVELLRRGGVPEELLDRLAKVVKSIVEKAEKILERLNRVSK AIAEKLKTIVDELNEVSKEIVKRAEDILRKGKDKETVLRALRTLVK EYADLSKEVLERVERIVREYVKLSDEVVKSLAEIVEELIRIIEDLL RKGNLDEDRDHMVLHEYVNAAGITDVKKASEDIVREVERIVRELA KRSDEILKKLEDIVEKLRE(SEQ ID NO: 27246) | 3plus1_Key_Cterm_646 | EDVKRALEELVSRLRKLLEDVKKASE DIVREVERIVRELAKRSDEILKKLED IVEKLRE(SEQ ID NO: 27247) |
| 3plus1_Cage_646_GFP11_Cterm | DAEEVVKRLADVLRENDETIRKVVEDLVRIAEENDRLWKKLVEDIA EILRRIVELLRRGGVPEELLDRLAKVVKSIVEKAEKILERLNRVSK AIAEKLKTIVDELNEVSKEIVKRAEDILRKGKDKETVLRALRTLVK EYADLSKEVLERVERIVREYVKLSDEVVKSLAEIVEELIRIIEDLL RKGNLDEDVRDHMVLHEYVNAAGITDVKKASEDIVREVERIVRELA KRSDEILKKLEDIVEKLRE(SEQ ID NO: 27248) | 3plus1_Key_Cterm_646 | EDVKRALEELVSRLRKLLEDVKKASE DIVREVERIVRELAKRSDEILKKLED IVEKLRE(SEQ ID NO: 27249) |

TABLE 4-continued

| Cage Name | Cage Sequence | Key Name | Key Sequence |
|---|---|---|---|
| 3plus1_Cage_647_GFP11_Cterm | DAEEVVKRLADVLRENDETIRKVVEDLVRIAEENDRLWKKLVEDIA EILRRIVELLRRGGVPEELLDRLAKVVKSIVEKAEKILERLNRVSK AIAEKLKTIVDELNEVSKEIVKRAEDILRKGKDKETVLRALRTLVK EYADLSKEVLERVERIVREYVKLSDEVVKSLAEIVEELIRIIEDLL RKGNLRDHMVLHEYVNAAGITKLLEDVKKASEDIVREVERIVRELA KRSDEILKKLEDIVEKLRE(SEQ ID NO: 27250) | 3plus1_Key_Cterm_647 | EDVKRALEELVSRLRKLLEDVKKASE DIVREVERIVRELAKRSDEILKKLED IVEKLRE(SEQ ID NO: 27251) |
| 3plus1_Cage_647_GFP11_Cterm | DAEEVVKRLADVLRENDETIRKVVEDLVRIAEENDRLWKKLVEDIA EILRRIVELLRRGGVPEELLDRLAKVVKSIVEKAEKILERLNRVSK AIAEKLKTIVDELNEVSKEIVKRAEDILRKGKDKETVLRALRTLVK EYADLSKEVLERVERIVREYVKLSDEVVKSLAEIVEELIRIIEDLL RKGNLDEDVKRALERDHMVLHEYVNAAGITSEDIVREVERIVRELA KRSDEILKKLEDIVEKLRE(SEQ ID NO: 27252) | 3plus1_Key_Cterm_647 | EDVKRALEELVSRLRKLLEDVKKASE DIVREVERIVRELAKRSDEILKKLED IVEKLRE(SEQ ID NO: 27253) |
| 3plus1_Cage_Cterm_647 | DAEEVVKRLADVLRENDETIRKVVEDLVRIAEENDRLWKKLVEDIA EILRRIVELLRRGGVPEELLDRLAKVVKSIVEKAEKILERLNRVSK AIAEKLKTIVDELNEVSKEIVKRAEDILRKGKDKETVLRALRTLVK EYADLSKEVLERVERIVREYVKLSDEVVKSLAEIVEELIRIIEDLL RKGNLDEDVKRALEELVSRLRKLLEDVKKASEDIVREVERIVRELA KRSDEILKKLEDIVEKLRE(SEQ ID NO: 27254) | 3plus1_Key_Cterm_647 | EDVKRALEELVSRLRKLLEDVKKASE DIVREVERIVRELAKRSDEILKKLED IVEKLRE(SEQ ID NO:27255) |
| 3plus1_Cage_Cterm_653 | DEEETLRRLLERKVELAKEYLDVSKEVIDRTTKLLDEYLKTSKRIV DATVELLERGDLGPDELIKRLAEELERSLRELEEEIKRLKRELEES LKKLKEIIDRLAEEAEKLLAVLKRGEGSEEEALRALASLVRELIEV LRENDERLRDVLRRLIEALRKNNEILERVLRKLVRAAEERGRDESS REALEEARRRLEELLRELNEITKDLEAKLEKLLRDLNELTKALEEE LKRLLDELKKRTD(SEQ ID NO: 27256) | 3plus1_Key_Cterm_653 | SREALEEARRRLEELLRELNEITKDL EAKLEKLLRDLNELTKALEEELKRLL DELKKRTD(SEQ ID NO: 27257) |
| 3plus1_Cage_Cterm_658 | DEERIIKTLEDINAKLVEDIKRILDKVAELNERLADAIRKILEETK RILEATTRKVRKDGEISEELLRRLEEKLRKLLEDLERVLAEHEDES RRILEEVERLLKRHADASKELLDRARSVARGVKSDKELVDRLKKLI DDSLESVRELIERLKELLDRLVKSVEDLIRTIKELLDRLVEVLREG VSDKDTLRTVEKLVEDVKRRLDKLLEDYKRLIEEVKKELDKLLKEY EDALREIKKRIDE(SEQ ID NO: 27258) | 3plus1_Key_Cterm_658 | KDTLRTVEKLVEDVKRRLDKLLEDYK RLIEEVKKELDKLLKEYEDALREIKK RIDE(SEQ ID NO: 27259) |
| 3plus1_Cage_Nterm_263 | SLVDELRKSLERNVRVSEEVARRLKEALKRWVDVVRKVVEDLIRLN EDVVRVVEKVTVDESAIERVRRIIEELNRKLDAVLKKNEDLVRRLT ELLDKLLEENRRLVEELDEDLKRRGGTEEVIDTILELIERSIERLK RLLDELLRIVREALKDNKRVADENLKKLKEILDELRKDGVEDEELK RVLEKAADLHRRLKDRHRKLLEDLERIIRELKKKLDEVVEENKRSV DELKR(SEQ ID NO: 27262) | 3plus1_Key_Nterm_263 | SLVDELRKSLERNVRVSEEVARRLKE ALKRWVDVVRKVVEDLIRLNEDVVRV VEKV(SEQ ID NO: 27263) |
| 3plus1_Cage_647_GFP11_Nterm | DAEEVVKRLADVLRENDETIRKVVEDLVRIAEENDRLWRDHMVLHE YVNAAGITLLRRGGVPEELLDRLAKVVKSIVEKAEKILERLNRVSK AIAEKLKTIVDELNEVSKEIVKRAEDILRKGKDKETVLRALRTLVK EYADLSKEVLERVERIVREYVKLSDEVVKSLAEIVEELIRIIEDLL RKGNLDEDVKRALEELVSRLRKLLEDVKKASEDIVREVERIVRELA KRSDEILKKLEDIVEKLRE(SEQ ID NO: 27276) | 3plus1_Key_Nterm_647 | DAEEVVKRLADVLRENDETIRKVVED LVRIAEENDRLWKKLVEDIAEILRRI VELLRRG(SEQ ID NO: 27277) |

As used throughout the present application, the term "polypeptide" is used in its broadest sense to refer to a sequence of subunit amino acids. The polypeptides of the invention may comprise L-amino acids+glycine, D-amino acids+glycine (which are resistant to L-amino acid-specific proteases in vivo), or a combination of D- and L-amino acids+glycine. The polypeptides described herein may be chemically synthesized or recombinantly expressed. The polypeptides may be linked to other compounds to promote an increased half-life in vivo, such as by PEGylation, HESylation, PASylation, glycosylation, or may be produced as an Fc-fusion or in deimmunized variants. Such linkage can be covalent or non-covalent as is understood by those of skill in the art.

In a fifth aspect the disclosure provides nucleic acids encoding the polypeptide of any embodiment or combination of embodiments of each aspect disclosed herein. The nucleic acid sequence may comprise single stranded or double stranded RNA or DNA in genomic or cDNA form, or DNA-RNA hybrids, each of which may include chemically or biochemically modified, non-natural, or derivatized nucleotide bases. Such nucleic acid sequences may comprise additional sequences useful for promoting expression and/or purification of the encoded polypeptide, including but not limited to polyA sequences, modified Kozak sequences, and sequences encoding epitope tags, export signals, and secretory signals, nuclear localization signals, and plasma membrane localization signals. It will be apparent to those of skill in the art, based on the teachings herein, what nucleic acid sequences will encode the polypeptides of the disclosure.

In a sixth aspect, the disclosure provides expression vectors comprising the nucleic acid of any aspect of the disclosure operatively linked to a suitable control sequence. "Expression vector" includes vectors that operatively link a nucleic acid coding region or gene to any control sequences capable of effecting expression of the gene product. "Control sequences" operably linked to the nucleic acid sequences of the disclosure are nucleic acid sequences capable of effecting the expression of the nucleic acid molecules. The control sequences need not be contiguous with the nucleic acid sequences, so long as they function to direct the expression thereof. Thus, for example, intervening untranslated yet transcribed sequences can be present between a promoter sequence and the nucleic acid sequences and the promoter sequence can still be considered "operably linked" to the coding sequence. Other such control sequences include, but are not limited to, polyadenylation signals, termination signals, and ribosome binding sites. Such expression vectors can be of any type, including but not limited plasmid and viral-based expression vectors. The control sequence used to drive expression of the disclosed nucleic acid sequences in a mammalian system may be constitutive (driven by any of a variety of promoters, including but not limited to, CMV, SV40, RSV, actin, EF) or inducible (driven by any of a number of inducible promoters including, but not limited to, tetracycline, ecdysone, steroid-responsive). The expression vector must be replicable in the host organisms either as an episome or by integration into host chromosomal DNA. In various embodiments, the expression vector may comprise a plasmid, viral-based vector, or any other suitable expression vector.

In a seventh aspect, the disclosure provides host cells that comprise the nucleic acids or expression vectors (i.e.: episomal or chromosomally integrated) disclosed herein, wherein the host cells can be either prokaryotic or eukaryotic. The cells can be transiently or stably engineered to incorporate the expression vector of the disclosure, using techniques including but not limited to bacterial transformations, calcium phosphate co-precipitation, electroporation, or liposome mediated-, DEAE dextran mediated-, polycationic mediated-, or viral mediated transfection. In one embodiment, the recombinant host cells comprise:

(a) a first nucleic acid encoding the polypeptide of any embodiment or combination of embodiments of the cage polypeptides of aspects 1-3 of the disclosure, operatively linked to a first promoter; and (b) a second nucleic acid encoding the polypeptide of any embodiment or combination of embodiments of the key polypeptide of aspect 4 of the disclosure, wherein the key polypeptide is capable of binding to a structural region of the cage polypeptide to induce a conformational change in the cage polypeptide, wherein the second nucleic acid is operatively linked to a second promoter.

The recombinant host cells may comprise a single cage polypeptide encoding nucleic acid and a single key polypeptide encoding nucleic acid, or may comprise a plurality (i.e.: 2, 3, 4, 5, 6, 7, 8, 9, 10, or more) first and second nucleic acidsin one such embodiment, each second nucleic acid may encode a key polypeptide capable of binding to a structural region and inducing a conformational change of a different cage polypeptide encoded by the plurality of first nucleic acids. In another embodiment, each second nucleic acid may encode a key polypeptide capable of binding to a structural region and inducing a conformational change of more than one of the cage polypeptides encoded by the plurality of first nucleic acids.

Thus, in one embodiment the first nucleic acid comprises a plurality of first nucleic acids encoding a plurality of different cage polypeptides. In one such embodiment, the second nucleic acid comprises a plurality of second nucleic acids encoding a plurality of different key polypeptides, wherein the plurality of different key polypeptides comprise one or more key polypeptides that are capable of binding to and inducing a conformational change in only a subset of the plurality of different cage polypeptides. In another such embodiment, the second nucleic acid encodes a single key polypeptide that is capable of binding to and inducing a conformational change in each different cage polypeptide.

In another embodiment, the host cells comprise nucleic acids encoding and/or expression vectors capable of expressing the fusion proteins disclosed herein, wherein the host cells comprise:

(a) a first nucleic acid encoding a first fusion protein (i.e.: cage polypeptide fused to key polypeptide) linked to a first promoter; and (b) a second nucleic acid encoding a second fusion protein operatively linked to a second promoter, wherein:

(i) the cage polypeptide encoded by the first nucleic acid is activated by the key polypeptide encoded by the second nucleic acid;

(ii) the cage polypeptide encoded by the first nucleic acid is not activated by the key polypeptide encoded by the first nucleic acid;

(iii) the cage polypeptide encoded by the second nucleic acid is activated by the key polypeptide encoded by the first nucleic acid; and (iv) the cage polypeptide encoded by the second nucleic acid is not activated by the key polypeptide encoded by the second nucleic acid.

In all these embodiments, the first and/or second nucleic acids may, for example, be in the form of an expression vector. In other embodiments, the first and/or second nucleic acids may be in the form of nucleic acid integrated into the host cell genome.

A method of producing a polypeptide according to the disclosure is an additional part of the disclosure. In one embodiment, the method comprises the steps of (a) culturing a host according to this aspect of the disclosure under conditions conducive to the expression of the polypeptide, and (b) optionally, recovering the expressed polypeptide. The expressed polypeptide can be recovered from the cell free extract or recovered from the culture medium. In another embodiment, the method comprises chemically synthesizing the polypeptides.

In an eight aspect, the disclosure provides kits. In one embodiment, the kits comprise:

(a) one or more polypeptides of any embodiment or combination of embodiments of aspects 1-3 of the disclosure (i.e.: the cage polypeptides);

(b) one or more polypeptides of any embodiment or combination of embodiments of aspect 4 of the disclosure (i.e.: the key polypeptides); and (c) optionally, one or more fusion proteins of any embodiment disclosed herein.

In another embodiment, the kits comprise:

(a) a first nucleic acid encoding the cage polypeptide of any embodiment or combination of embodiments of aspects 1-3 of the disclosure;

(b) a second nucleic acid encoding the key polypeptides of any embodiment or combination of embodiments of aspect 4 of the disclosure; and (c) optionally, a third nucleic acid encoding the fusion protein of any embodiment disclosed herein.

In another embodiment, the kit comprises:

(a) a first expression vector comprising a first nucleic acid encoding the cage polypeptide of any embodiment or combination of embodiments of aspects 1-3 of the disclosure, wherein the first nucleic acid is operatively linked to a first promoter; and (b) a second expression vector comprising a second nucleic acid encoding the key polypeptides of any embodiment or combination of embodiments of aspect 4 of the disclosure, wherein the second nucleic acid is operatively linked to a second promoter.

In each of the kit embodiments, the first nucleic acid, the second nucleic acid, the first expression vector, and/or the second expression vector may comprise a single nucleic acid encoding or expression vector capable of expressing the cage or key polypeptide, or may comprise a plurality (i.e.: 2, 3, 4, 5, 6, 7, 8, 9, 10, or more) of first nucleic acids, second nucleic acids, first expression vectors, and/or the second expression vectors. In various such embodiments, each second nucleic acid may encode, or each second expression vector may be capable of expressing, a key polypeptide capable of binding to a structural region and inducing a conformational change of a different cage polypeptide encoded by the plurality of first nucleic acids or capable of being expressed by the plurality of first expression vectors. In other embodiments, each second nucleic acid may encode, or each second expression vector may be capable of expressing, a key polypeptide capable of binding to a structural region and inducing a conformational change of more than one of the cage polypeptides encoded by the plurality of first nucleic acids or capable of being expressed by the plurality of first expression vectors.

In one embodiment, the promoters operatively linked to the cage polypeptide-encoding nucleic acids (first promoters) are different than the promoters operatively linked to the key polypeptide-encoding nucleic acids (second promoters), allowing tunable control of the cage polypeptides and any functional polypeptide domains by controlling expression of the key polypeptide. In other embodiments, the promoters operatively linked to the cage polypeptide-encoding nucleic acids (first promoters) are the same as the promoters operatively linked to the key polypeptide-encoding nucleic acids (second promoters). In other embodiments, the first promoters and/or second promoters may be inducible promoters.

In a ninth aspect, the disclosure provides a LOCKR switch comprising
(a) a cage polypeptide comprising a structural domain and a latch domain further comprising one or more bioactive peptides, wherein the structural domain interacts with the latch domain to prevent activity of the bioactive peptide(s);
(b) an optional key polypeptide that binds to the cage structural domain, thereby displacing the latch domain and activating the bioactive peptide(s); and
(c) optionally, an effector polypeptide(s) that binds to the bioactive peptide(s) when the bioactive peptide(s) is(are) activated.

The cage polypeptides and its structural and latch regions are discussed above, as are bioactive peptides, effector polypeptides, and key polypeptides. Any embodiment of the cage polypeptides, bioactive peptides, and key polypeptides disclosed herein may be used in the LOCKR switches and kits of the disclosure. For example, in one embodiment, the cage polypeptide comprises:
(a) a helical bundle comprising between 2 and 7 alpha-helices; and
(b) amino acid linkers connecting each alpha helix;

In one embodiment, the key polypeptide is present, and may comprise the key polypeptide of any embodiment or combination of embodiments disclosed herein.

In another embodiment, the effector polypeptide is present, and comprises a polypeptide that selectively binds to the bioactive peptide. Any suitable effector polypeptide can be used depending on the bioactive peptide of interest. In various non-limiting embodiments, the effector peptide may comprise Bcl2, GFP1-10, a protease, etc.

The present disclosure also provides a LOCKR switch comprising a cage polypeptide described herein and a key polypeptide. In some aspects, a LOCKR switch comprises (a) a cage polypeptide comprising a structural region and a latch region further comprising one or more bioactive peptides, and (b) a key polypeptide that binds to the cage structural region. In some aspects, a LOCKR switch comprises (a) a cage polypeptide comprising a structural region and a latch region further comprising one or more bioactive peptides, and (b) a key polypeptide that binds to the cage structural region, wherein the one or more bioactive peptides in the latch region bind to or interact with one or more effector polypeptide(s). In other aspects, a LOCKR switch comprises (a) a cage polypeptide comprising a structural region and a latch region further comprising one or more bioactive peptides, wherein the structural region interacts with the latch region to prevent activity of the one or more bioactive peptides; (b) a key polypeptide that binds to the cage structural region, thereby displacing the latch region and activating the one or more bioactive peptides. In some other aspects, the LOCKR further comprises one or more effector polypeptide(s) that bind to the one or more bioactive peptides when the one or more bioactive peptides are activated.

In some aspects, both a latch region and a key polypeptide can bind to or interact with a structural region in the corresponding cage polypeptide. The interaction between a latch region and a structural region in a cage polypeptide can be intramolecular interaction, and the interaction between a key polypeptide and a structural region of the corresponding cage polypeptide can be intermolecular interaction. However, in some aspects, the affinity of the latch region to the structural region of the cage polypeptide is higher than the affinity of the key polypeptide to the structural region of the cage polypeptide in the absence of an effector polypeptide.

In some aspects, the affinity of the latch region to the structural region of the cage polypeptide is at least about 1.5 fold, at least about 2 fold, at least about 3 fold, at least about 4 fold, at least about 5 fold, at least about 6 fold, at least about 7 fold, at least about 8 fold, at least about 9 fold, at least about 10 fold, at least about 11 fold, at least about 12 fold, at least about 13 fold, at least about 14 fold, at least about 15 fold, at least about 16 fold, at least about 17 fold, at least about 18 fold, at least about 19 fold, at least about 20 fold, at least about 21 fold, at least about 22 fold, at least about 23 fold, at least about 24 fold, at least about 25 fold, at least about 26 fold, at least about 27 fold, at least about 28 fold, at least about 29 fold, or at least about 30 fold higher than the affinity of the key polypeptide to the structural region of the cage polypeptide in the absence of an effector polypeptide. In some aspects, the affinity of the latch region to the structural region of the cage polypeptide is at least about 1.1 fold, at least about 1.2 fold, at least about 1.3 fold, at least about 1.4 fold, at least about 1.5 fold, at least about 1.6 fold, at least about 1.7 fold, at least about 1.8 fold, at least about 1.9 fold, at least about 2.0 fold, at least about 2.1 fold, at least about 2.2 fold, at least about 2.3 fold, at least about 2.4 fold, at least about 2.5 fold, at least about 2.6 fold, at least about 2.7 fold, at least about 2.8 fold, at least about 2.9 fold, or at least about 3.0 fold higher than the affinity of the key polypeptide to the structural region of the cage polypeptide in the absence of an effector polypeptide. In some aspects, the affinity of the latch region to the structural region of the cage polypeptide is at least about 30 fold, at least about 40 fold, at least about 50 fold, at least about 60 fold, at least about 70 fold, at least about 80 fold, at least about 90 fold, at least about 100 fold, at least about 110 fold, at least about 120 fold, at least about 130 fold, at least about 140 fold, at least about 150 fold, at least about 160 fold, at least about 170 fold, at least about 180 fold, at least about 190 fold, at least about 200 fold, at least about 210 fold, at least about 220 fold, at least about 230 fold, at least about 240 fold, at least about 250 fold, at least about 260 fold, at least about 270 fold, at least about 280 fold, at least about 290 fold, at least about 300 fold, e.g., about 30 fold to about 300 fold, e.g., about 100 fold to about 300 fold, about 50 fold to about 100 fold, higher than the affinity of the key polypeptide to the structural region of the cage polypeptide in the absence of an effector polypeptide.

In other embodiments, the intramolecular Latch-Cage affinity is higher than the intermolecular Key-Cage affinity, and in the presence of the Effector protein, the intermolecular Key-Cage affinity is higher than the intramolecular Latch-Cage affinity. As a result, the function of the bioactive peptide is dependent on the presence of Cage, Key, and Effector protein.

In certain embodiments, the intermolecular Key-Cage interaction may outcompete the Latch-Cage interaction in the absence of Effector protein. In the absence of Key, the Latch-Cage affinity is higher than the Latch-Effector protein affinity (via binding of the Bioactive peptide to the Effector protein), and in the presence of Key, the Latch-Effector protein affinity (via binding of the Bioactive peptide to the Effector protein) is higher than the Latch-Cage affinity. As a result, the function of the bioactive peptide is dependent on the presence of Cage, Key, and Effector protein.

Figure 8:
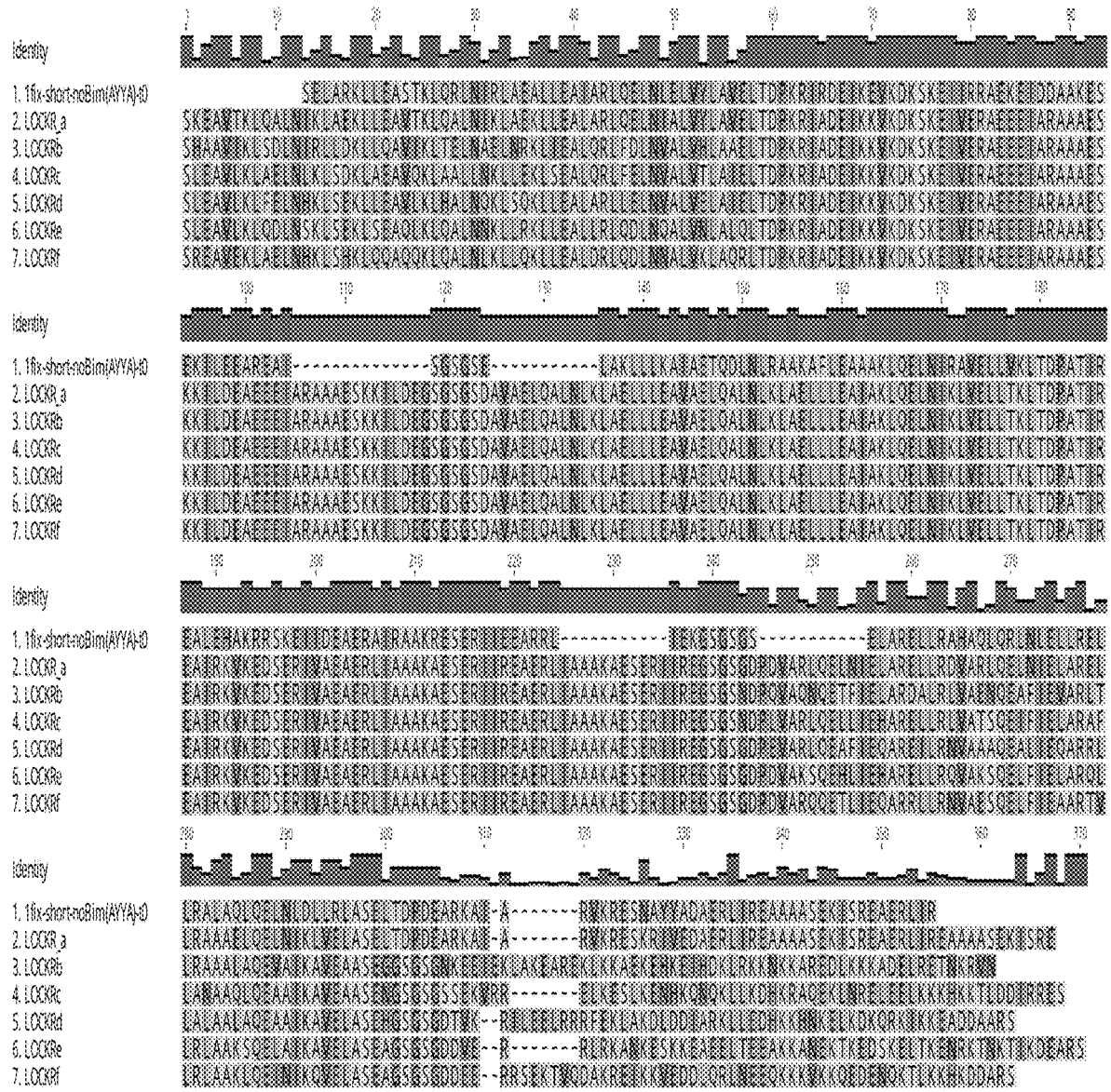
FIG. 8: Multiple sequence alignment (MSA) comparing the original LOCKR_a Cage scaffold design to its asymmetrized (1fix-short noBim(AYYA)-t0) and orthogonal (LOCKRb-f) design counterparts. Only 150 (40.8%) of the sites are identical across the MSA, with a pairwise % identity of 69.4%. The Latch regions (the C-terminal region starting at position labeled 311 in this MSA) have very little sequence identity/similarity. (from top to bottom SEQ ID NOs: 17, 39, 7, 8, 9, 10, 11)

As disclosed herein, the cage polypeptides can be used together with the key polypeptides by using the cage polypeptides to sequester a bioactive peptide in the latch region, where it remains inactive until the key polypeptide displaces the latch through competitive intermolecular binding that induces conformational change, exposing the encoded bioactive peptide or domain and activating the system (see FIG. 1). The combined use of the cage and key polypeptides is described in more detail herein in the examples that follow, and is referred to as a LOCKR switch. LOCKR stands for Latching Orthogonal Cage-Key pRotiens; each LOCKR design consists of a cage polypeptide and a key polypeptide, which are two separate polypeptide chains. Orthogonal LOCKR design (see FIG. 3) are denoted by lowercase letter subscripts: $LOCKR_a$ consists of $Cage_a$ and $Key_a$, and $LOCKR_b$ consists of $Cage_b$ and $Key_b$, etc. such that $Cage_a$ is only activated by $Key_a$, and $Cage_b$ is only activated by $Key_b$, etc. Prefixes in the polypeptide and LOCKR names denote the functional group that is encoded and controlled by the LOCKR switch. For example, BimLOCKR refers to designed switches that encode the Bim peptide, and GFP11-LOCKR refers to designed switches that encode GFP11 (the 11th strand of GFP). See FIG. 8 for a sequence alignment comparing the original LOCKR_a Cage scaffold design to its asymmetrized (1fix-short noBim(AYYA)-t0) and orthogonal (LOCKRb-f) design counterparts.

In another embodiment, the nomenclature for the cage is identified by 1fix-short and 1fix-latch, indicating similar, yet distinct, embodiments of $Cage_a$ as defined above. They are all activated by $Key_a$. The functional group encoded in the latch is identified by the third portion of the name while the suffix indicates the presence of a toehold. For example, 1fix-short-Bim-t0 encodes Bim on the 1fix-short scaffold with no toehold. In another example, 1fix-latch_Mad1SID_T0_2 indicates that the 1fix-latch scaffold was used to encode Mad1SID with no residues. The suffix 2 indicates that there are two versions where the functional sequence is encoded in different locations on the latch region.

In one embodiment of the eighth and ninth aspects of the disclosure, the one or more cage polypeptide and the one or more key polypeptide comprise at least one cage polypeptide and at least one key polypeptide in the same row of Tables 1, 2, 3, and/or 4. As will be understood by those of skill in the art based on the teachings herein, such kits may include multiple (i.e.: 2, 3, 4, 5, 6, 7, 8, 9, 10, 20, 50, 100, or more) cage and key polypeptide pairs that can be used together as a LOCKR switch.

In one embodiment of the kits or switches disclosed herein, the one or more cage polypeptide and the one or more key polypeptide comprise at least one cage polypeptide and at least one key polypeptide having an amino acid sequence having at least 45%, 50%, 55%, 60%, 65%, 70%, 75%, 80%, 85%, 90%, 91%, 92%, 93%, 94%, 95%, 96%, 97%, 98%, 99%, or 100% sequence identity along its length to a cage polypeptide and a key polypeptide, respectively, in the same row of Table 1, 2, 3 and/or 4.

In a tenth aspect, the disclosure provides use of the polypeptides, kits, and/or LOCKR switches disclosed herein to sequester bioactive peptide in the cage polypeptide, holding them in an inactive ("off") state, until combined with the key polypeptide to induce a conformational change that activates ("on") the bioactive peptide. Details of exemplary such uses and methods are disclosed throughout.

In one embodiment of the kits or switches disclosed herein, the one or more cage polypeptide and the one or more key polypeptide comprise at least one cage polypeptide and at least one key polypeptide having an amino acid sequence having at least 45%, 50%, 55%, 60%, 65%, 70%, 75%, 80%, 85%, 90%, 91%, 92%, 93%, 94%, 95%, 96%, 97%, 98%, 99%, or 100% sequence identity along its length to a cage polypeptide and a key polypeptide, respectively, in the same row of Table 1, 2, 3, and/or 4.

In another embodiment of the eighth and ninth aspects of the disclosure, the one or more cage polypeptide and the one or more key polypeptide comprise at least one cage polypeptide and at least one key polypeptide that are matched by identification numbers in the naming conventions used herein. As noted above, orthogonal LOCKR designs (see FIG. 3) are denoted by lowercase letter subscripts: $LOCKR_a$ consists of $Cage_a$ and $Key_a$, and $LOCKR_b$ consists of $Cage_b$ and $Key_b$, etc. such that $Cage_a$ is only activated by $Key_a$, and $Cage_b$ is only activated by $Key_b$, etc. Prefixes in the polypeptide and LOCKR names denote the functional group that is encoded and controlled by the LOCKR switch. In one embodiment, all 3plus1 (3+1) and 2plus1 (2+1) cage and key polypeptides disclosed herein are matched by identification numbers.

In some embodiments the cage and key polypeptide names include the prefix 2plus1 or 3plus1 defines the helix architecture with the first number defining the number of helices in the structural region, with the second number defining the number of helices in the latch region. The Nterm or Cterm suffix defines if the latch on the cage component of the kit encompasses the N or C terminus respectively, as is denoted by brackets [ ]. The Nterm versus Cterm and numerical suffix corresponds to the same suffix on the key with which it is activated from. For example, cage 2plus1_Cage_Cterm_2406 (SEQ ID NO:27126) is activated by 2plus2_Key_Cterm_2406 (SEQ ID NO:27127).

EXAMPLES

Summary:

We have developed a general approach to design novel protein switches that can sequester bioactive peptides and/or binding domains, holding them in an inactive ("off") state, until combined with a second designed polypeptide called the Key, which induces a conformational change that activates ("on") the bioactive peptide or binding domain.

Nomenclature and Structural Features that Define LOCKR Switches:

LOCKR stands for Latching Orthogonal Cage-Key pRoteins; each LOCKR design consists of a Cage protein and a Key protein, which are two separate polypeptide chains.

The Cage encodes the sequestered bioactive peptide or binding domain in a region of the Cage scaffold denoted as the Latch. The general strategy is to optimize the position of the encoded peptide or binding domain for maximum burial of the functional residues that need to be sequestered, simultaneously optimizing for burial of hydrophobic residues, and for solvent exposure/compensatory hydrogen bonds of polar residues.

The Key displaces the Latch through competitive intermolecular binding that induces conformational change, exposing the encoded bioactive peptide or domain and activating the system (FIG. 1).

Orthogonal LOCKR designs (FIG. 3) are denoted by lowercase letter subscripts: LOCKR$_a$ consists of Cage$_a$ and Key$_a$, and LOCKR$_b$ consists of Cage$_b$ and Key$_b$, etc. such that Cage$_a$ is only activated by Key$_a$, and Cage$_b$ is only activated by Key$_b$, etc.

Prefixes denote the functional group that is encoded and controlled by the LOCKR switch. For example, Bim-LOCKR refers to designed switches that encode the Bim peptide, and GFP11-LOCKR refers to designed switches that encode GFP11 (the 11$^{th}$ strand of GFP).

Toehold: The dynamic range of LOCKR activation by Key can be tuned by truncating the Latch length, simultaneously weakening the Cage-Latch interaction and opening an exposed region on the Cage that the Key can bind to as a "toehold" (FIG. 2. LOCKR can also be tuned in a similar manner by designing mutations into the Latch that weaken the Cage-Latch interaction (FIGS. 1-2, FIG. 10). The length of the toehold is included as a suffix to the design name: For example "-t0" means no toehold, and "-t9" means a toehold of 9 residues (i.e. Latch truncated by 9 residues).

If the term "Lock" is used in reference to a single polypeptide chain (not in reference to the LOCKR acronym), it is assumed to be synonymous with "Cage".

These designs comprise the first ever de novo designed proteins that can undergo conformational switching in response to protein binding. They are modular in that they can encode bioactive peptides of all three types of secondary structure in an inactive conformation: alpha helix, beta strand, loop, and are tunable in that their responsiveness can be tuned over a large dynamic range by varying length (length of Cage scaffold and/or Latch Toehold), and/or mutating residues in the Cage-Latch interface. Designed LOCKR switches can be used to control the activity of a wide range of functional peptides. The ability to harness these biological functions with tight, inducible control is useful, for example, in engineering cells (inducible activation of function, engineering complex logic behavior and circuits), developing sensors, developing inducible protein-based therapeutics, and creating new biomaterials.

Design of LOCKR Switches

We set out to design de novo switchable protein systems guided by the following general considerations. First, the free energy tuning required to achieve maximal dynamic range upon addition of the switch-triggering input is more straightforward in a system governed by competition between inter- and intra-molecular interactions at the same site rather than at distant sites (as is common in allosteric biological systems). Second, a stable protein framework with an extended binding surface available for the competing interactions has advantages over a framework that only becomes ordered upon binding, as the former is more programmable and less likely to engage in off-target interactions. These features are described by the abstract system depicted in FIG. 1a, which undergoes thermodynamically-driven switching between a binding incompetent and a binding competent state. A latch (blue) contains a peptide sequence (orange) that can bind a target (yellow) unless blocked by intramolecular interactions to a cage (cyan); a more tightly binding key (magenta) outcompetes the latch allowing the peptide to bind target. The behavior of such a system is governed by the binding equilibrium constants for the individual subreactions (FIG. 1a): $K_{open}$, the dissociation of latch from cage; $K_{LT}$, the binding of latch to target; and $K_{CK}$, the binding of key to cage. Solution of this set of equations shows that when the latch-cage interaction is too weak (red and orange curves), the system is leaky and the fold induction by key is low, while when the latch-cage interaction is too strong (purple curve), the system is only partially activated, even at high key concentrations. The latch-cage interaction affinity that gives optimal switching (FIG. 1b, blue curve left, green curve right) is a function of the latch-target binding affinity. We used this model to guide design of an optimally switchable protein system, as described in the following sections.

LOCKR Design Strategy

To design such a switchable system, we chose structural features amenable to tuning of the affinities of the cage-latch and cage-key interactions over a wide dynamic range. Alpha helices have advantages over beta strands because inter-helical interfaces are dominated by sidechain-sidechain interactions, which can be more readily tuned than the cooperative backbone hydrogen bonding necessary for beta sheets. To allow fine control over the relative affinities of the cage-latch and cage-key interactions, we chose to design interfaces containing buried hydrogen bond networks: as illustrated by Watson Crick base pairing, considerable specificity can be obtained with relatively minor changes in the positions of hydrogen bond donors and acceptors[4,5]. We selected as a starting point a designed homo-trimer of α-helical hairpins with hydrogen bond network-mediated subunit-subunit interaction specificity (5L6HC3_1)[5]. By designing short unstructured loops connecting the subunits, we generated monomeric protein frameworks with five or six helices and 40 residues per helix (FIG. 1c). In the five-helix framework, there is an open binding site for a sixth helix added in trans, whereas this site is filled by a sixth helix in cis in the six-helix framework.

Figure 1A:
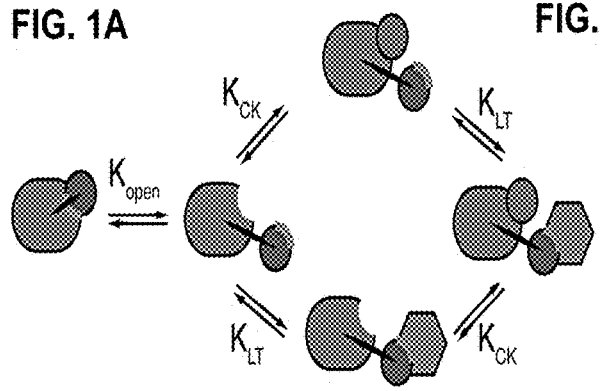
FIG. 1A-1F: Design of the LOCKR switch system.
Figure 1B:
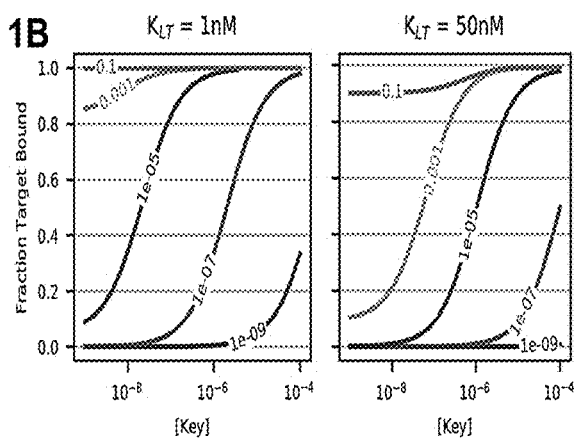
Figure 1C:
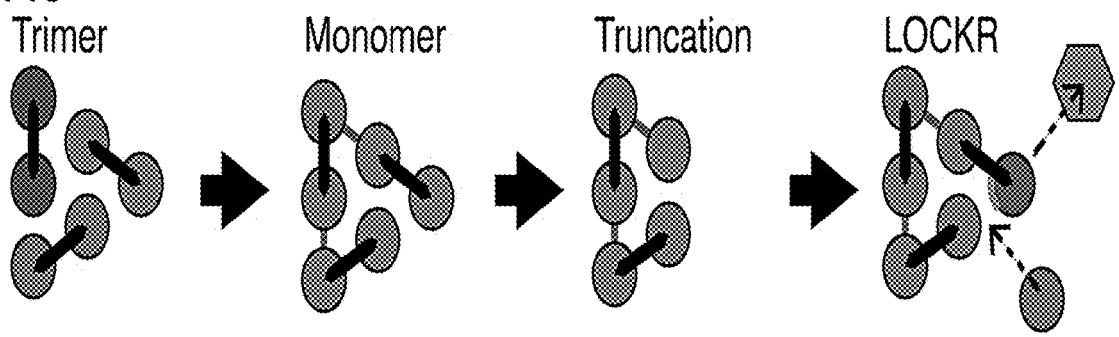
Figure 1D:
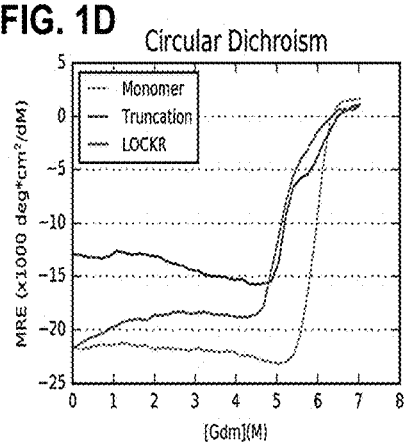
Figure 1E:
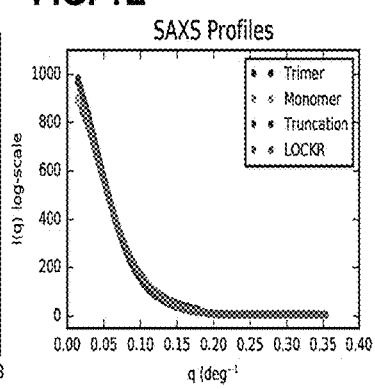
Figure 1F:
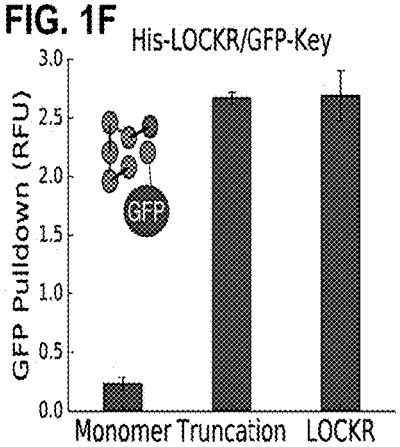

The five helix (cage) and six helix (cage plus latch) designs were soluble when recombinantly expressed in *E. coli*, and the purified proteins were largely monomeric by size-exclusion chromatography with multi-angle light scattering, and very thermostable, remaining folded at upwards of 95° C. and 5 M guanidine hydrochloride (FIG. 1d). Small-angle X-ray scattering (SAXS) spectra were in close agreement to the design models and previous of the original trimers (FIG. 1e), suggesting that the structure was not altered by the loops. The five-helix framework, but not the six-helix framework, bound the sixth helix fused to GFP in a pull-down assay (FIG. 1f); the latter result is expected since if the interfaces are otherwise identical, the intramolecular interaction $K_{open}$, should outcompete its intermolecular counterpart, $K_{CK}$, because of the reduced entropic cost of formation of intramolecular interactions. To tune $K_{open}$, we screened destabilizing mutations in the latch (large hydrophobics to alanine or serine, and alanine residues to larger hydrophobics or serine) and using the GFP pull-down assay, identified mutants with a range of affinities for the key. A double mutant, V223S/I238S, bound key as strongly as the five-helix cage without the latch (FIG. 1e, 10); the two serines likely weaken the cage-latch interaction because of the desolvation penalty associated with burying the sidechain hydroxyls, and because they decrease the helical propensity of the latch. SAXS and CD spectra indicate that in the absence of key, V223S,I238S is a well-folded six-helix bundle with structure similar to the original monomer (FIG. 1d). We call this cage-latch-key system LOCKR, for Latching Orthogonal Cage-Key pRoteins.

Figure 2A:
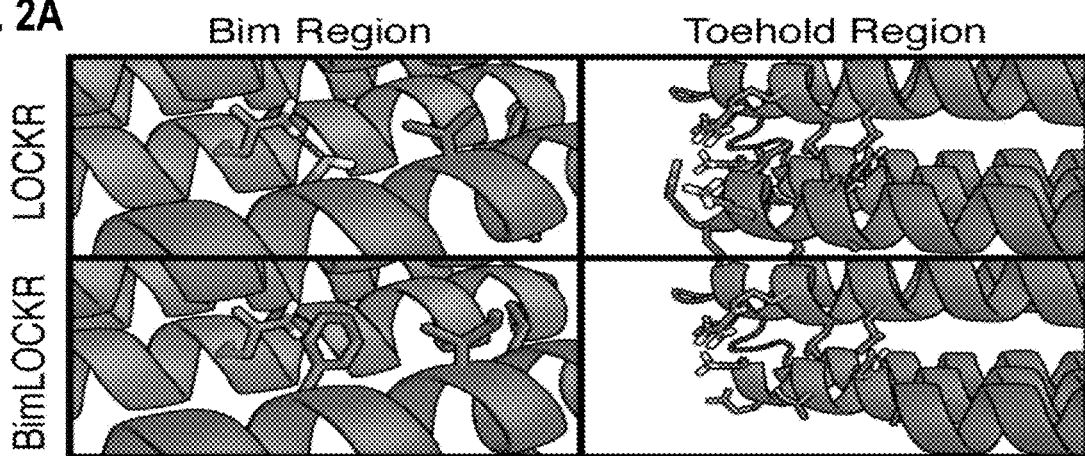
Figure 2B:
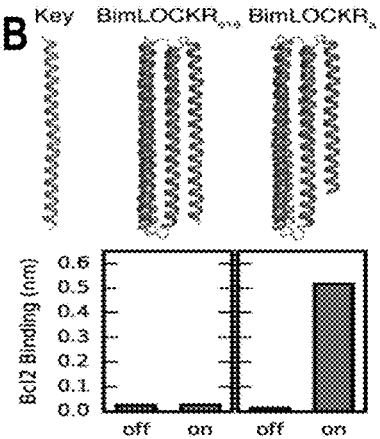
Figure 2B:
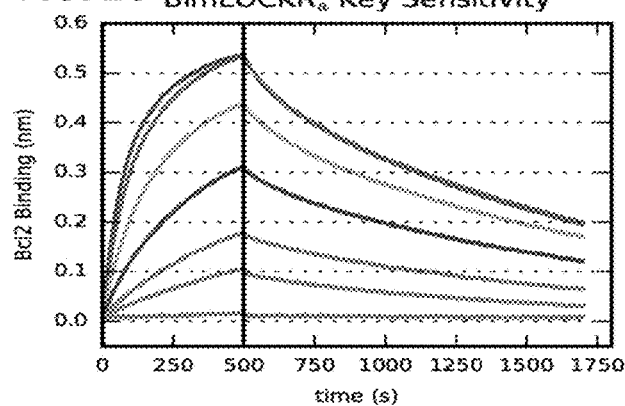

Controlling Bim-Bcl2 Binding, and Tuning the Dynamic Range of Activation:

To install function into LOCKR, we selected the Bim-Bcl2 interaction central to apoptosis as a model system, seeking to cage Bim such that binding to Bcl2 only occurred in the presence of key. We designed constructs with two possible Bim-related sequences designed onto the latch: a designed Bcl2-binding peptide (aBcl2LOCKR) or just the Bim residues crucial for Bcl2 binding (pBimLOCKR). Each has a different affinity for Bcl2, allowing us to sample a range of $K_{LT}$ values in the initial series of designs. Bim-related sequences were grafted onto the latch by sampling different helical registers such that residues involved in binding to Bcl2 are sequestered in the cage-latch interface (data not shown), optimizing for the burial of hydrophobic residues and surface exposure of polar residues. $K_{open}$ can be tuned by non-optimal interactions between the cage and Bim residues or by changing the length of the latch (FIG. 2a). Initial designs were tested for binding to Bcl2 by bio-layer interferometry, and were either showed little Bcl2 binding even in the presence of key, or Bcl2 binding even in the absence of key. The range of $K_{open}$ and $K_{CK}$ values accessible with this system was evidently not matched to $K_{LT}$ in this case: the key induced response was far from the ideal curves in FIG. 1b.

We hypothesized that the system could be improved by extending the interface area presented on the cage: extending the latch could increase the affinity for the cage (decrease $K_{open}$) to make the system more "off" in absence of key, while extending the key to be longer could allow it to outcompete the latch (decrease $K_{CK}$ relative to $K_{open}$), making the system more inducible. Taking advantage of the modular nature of de novo parametric helical bundles, the cage, latch and key were each extended by 5, 9 or 18 residues. To enable the key to outcompete the latch, the latter was truncated by four to nine residues to access a range of $K_{open}$ values; this creates a "toehold" on the cage for the key to bind). The 18-residue extension with a 9 residue toehold resulted in strongly inducible binding (FIG. 2b,c; the signal on bio-layer interferometry is not due to key binding Bcl2 nor the key adding bulk to inactive LOCKR. The activation of binding by the key is approximately 40-fold (FIG. 2c), comparable to or better than many naturally occurring processes that are regulated by protein interactions.

Figure 2D:
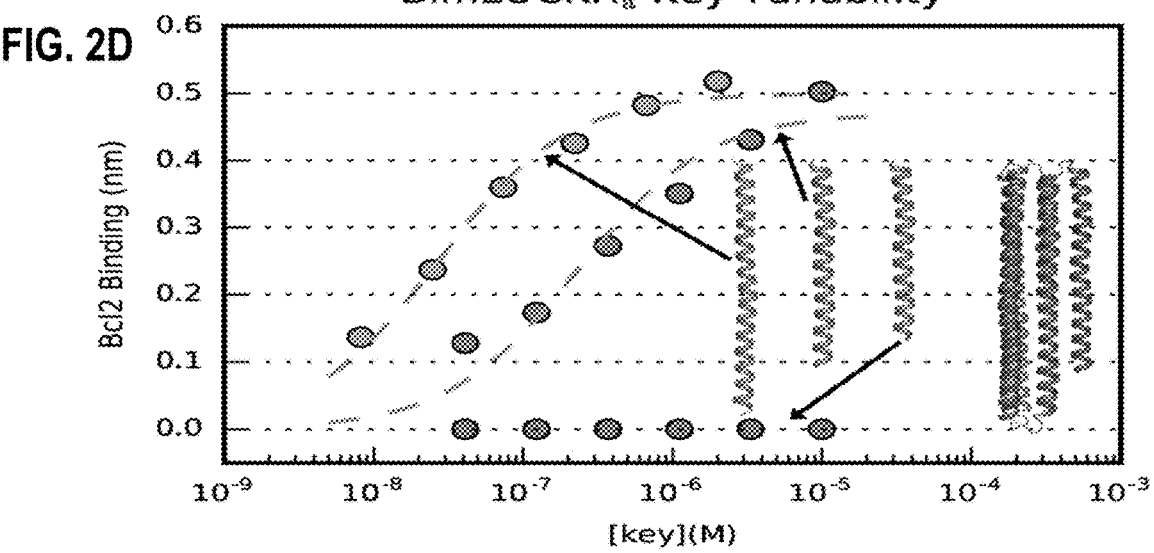

The range of key concentrations over which BimLOCKR is activated can be controlled by tuning $K_{CK}$ by varying the length of the key since the interaction energy is roughly proportional to the total surface area of interacting residues. The EC50 for the 58-length designed key is 55.6+/−34 nM (FIG. 2c,d), and for a 45 residue key, 230+/−58 nM. Truncating an additional five residues completely negates key activation, indicating the equilibria are very sensitive to small changes in free energy as expected from our model (FIG. 2d). To examine function of BimLOCKR over a three orders of magnitude range of $K_{LT}$ we studied key induced binding to Bcl2 homologs BclB and Bak (which bind Bim with Kd's of 0.17 nM (Bcl2), 20 nM (BclB), and 500 nM (Bak))[6]. Bio-layer interferometry experiments were performed with target immobilized assayed against the switch with or without key in solution, as well as with key immobilized and assayed against the switch alone or with target in solution. From these results, we can obtain the fraction of target or key bound as a function of the concentrations of switch, key, and target. A global fit of the model to these data for $K_{open}$, $K_{CK}$, and $K_{LT}$ yields estimates of $K_{open}$=0.01+/−0.0033, $K_{CK}$=2.1+/−1.1 nM, $K_{LT}$(Bcl2)=28+/−7.8 nM, and $K_{LT}$(BclB)=32+/−22 nM with no estimate for $K_{LT}$ (Bak) as little switch activation was observed. This fit has an RMSE (root-mean-square-error) of 0.072 nm to the observed BLI data. The approximate agreement of these estimates with the Bim binding Kd's (which were not used in the fitting) suggests the thermodynamic model (FIG. 1a) is a good representation of the system while possibly missing small features of the system affecting target binding.

Figure 3C:
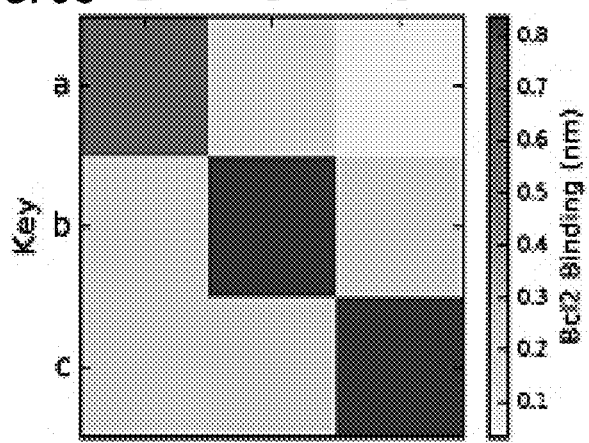
Figure 5A:
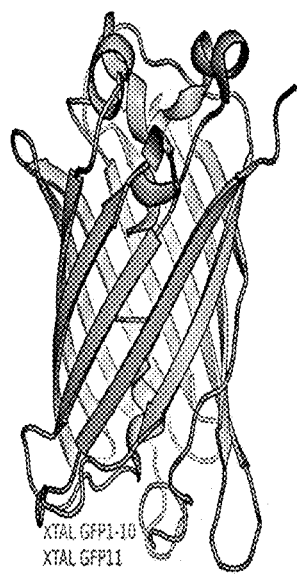
FIG. 5A-5D: LOCKR switch that can prevent split GFP11 from complementing GFP1-10 in the absence of Key.
Figure 5B:
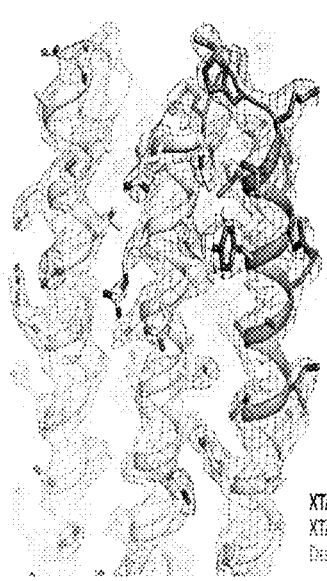
Figure 5C:
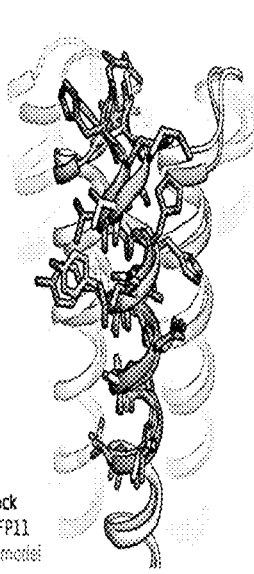
Figure 5D:
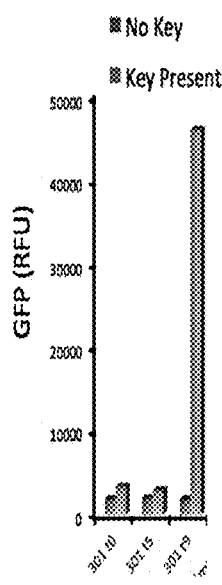
Figure 11A:
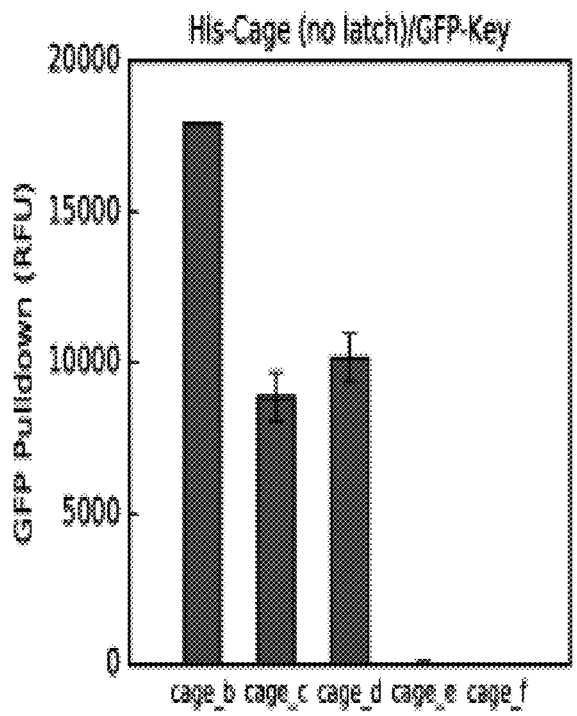
FIG. 11A-11B: Orthogonal LOCKR GFP assays.
Figure 11B:
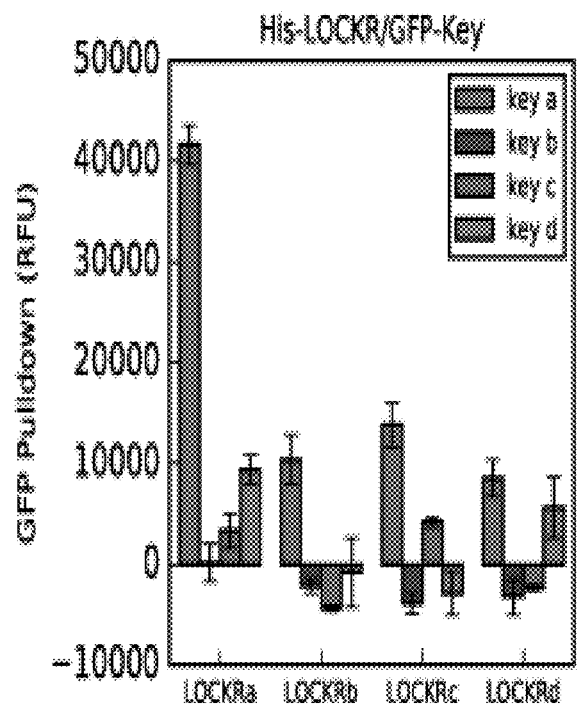

We next sought to design a series of orthogonal LOCKR systems with the goal of engineering multiple switches able to be activated selectively in a heterogeneous mixture. Specificity was designed for using different hydrogen bond networks at the cage-key interface. The latch helix was deleted from the original extended LOCKR$_a$ model and backbones for a new sixth helix were generated by parametrically sampling the radius, helical phase, and z-offset of the new latch/key helix. The resulting structures were scanned for new hydrogen bond networks spanning the interface between the new sixth helix and cage with all buried polar atoms participating in hydrogen bonds; the remaining interface around the networks was subjected to full sequence and sidechain rotamer optimization using Rosetta™ design. Five designs were selected based on packing quality, sequence dissimilarity, and lack of buried polar atoms not participating in hydrogen bonds. Truncations and toehold variants were assayed for cognate and off target key binding using the GFP pulldown assay from FIG. 1c. Three of the new designs were found to bind their cognate keys (FIG. 11) and did so orthogonally from one another. All bound key$_a$ to some extent yet is unknown. The Bim sequence was threaded onto the latches of these three designs as it was for the original design, BimLOCKR$_a$ (FIG. 2). BimLOCKR$_b$ and BimLOCKR, show 22-fold and 8-fold activation, respectively, from their cognate keys given a nine residue toehold on the latch (FIG. 3a,b). BimLOCKR$_a$, BimLOCKR$_b$ and BimLOCKR$_c$ are also orthogonal; each is activated only by its cognate key at concentrations up to 5 uM (FIG. 3c). The power of the buried hydrogen bond network approach to achieving specificity is illustrated by the fact that of the six designed BimLOCKR proteins, three successfully switch and can be activated orthogonally, a 50% success rate starting from a single scaffold.

Asymmetrized LOCKR Switches

Figure 9:
FIG. 9: Superposition of the crystal structure (white) of 1fix-short-noBim(AYYA)-t0 (FIG. 4B) onto the x-ray crystal structure of the base scaffold 5L6HC3_1[5] (dark) used to make LOCKRa (FIG. 1) demonstrates that the asymmetrizing mutations (variable positions shown in FIG. 8 MSA) do not affect the three-dimensional structure of the protein. The backbone RMSD between the two proteins is 0.85 Angstroms (from superposing of all backbone atoms between chains A).

The original LOCKR switch design (FIGS. 1-2) was built starting from a de novo designed symmetric homotrimer, 5L6HC3_1, which contains 6 helices[5]. The symmetric repeating sequence motifs create opportunities for misfolding and aggregation. To mitigate these effects, we redesigned the original LOCKR switch to be asymmetric (sequences listed at the end of this document). The asymmetric designs are better behaved, more monomeric, and we experimentally solved x-ray crystal structures (FIG. 4), both with the encoded BIM peptide (FIG. 4A), and without the BIM peptide (FIG. 4B). The experimental structure without BIM is nearly identical to the computational design model (FIG. 4B), demonstrating atomic-level accuracy of our design strategy. Details of computational design and experimental testing providing in Methods. See FIG. 9 for a superposition of the crystal structure of 1fix-short-noBim(AYYA)-t0 (FIG. 4B) onto the x-ray crystal structure of the base scaffold 5L6HC3_1[5] (dark) used to make LOCKRa (FIG. 1).

gfpLOCKR (GFP11-LOCKR)

Using the asymmetric designs as a starting point, we successful encoded the 11$^{th}$ strand of GFP into designed LOCKR switches (FIG. 5). A common split GFP consists of two parts: Strands 1-10, and Strand 11; when mixed, 1-10 combines with 11 to yield fluorescence. Here we demonstrate that the 11$^{th}$ strand is sequestered in the absence of Key, unable to combine with GFP-1-10, but readily yields fluorescence when mixed with Key in the presence of GFP-1-10 (FIG. 5). We experimentally determined x-ray crystal structures of the designed protein, which shows that GFP-11 is structurally encoded as an alpha helix, in a nearly identical conformation to that of the computational design model (FIG. 5); this result highlights the power and modularity of the LOCKR system, suggesting that we can encode bioactive peptides with secondary structure propensities that are non-helical.

Tuning for Co-Localization Dependence

Figure 6A:
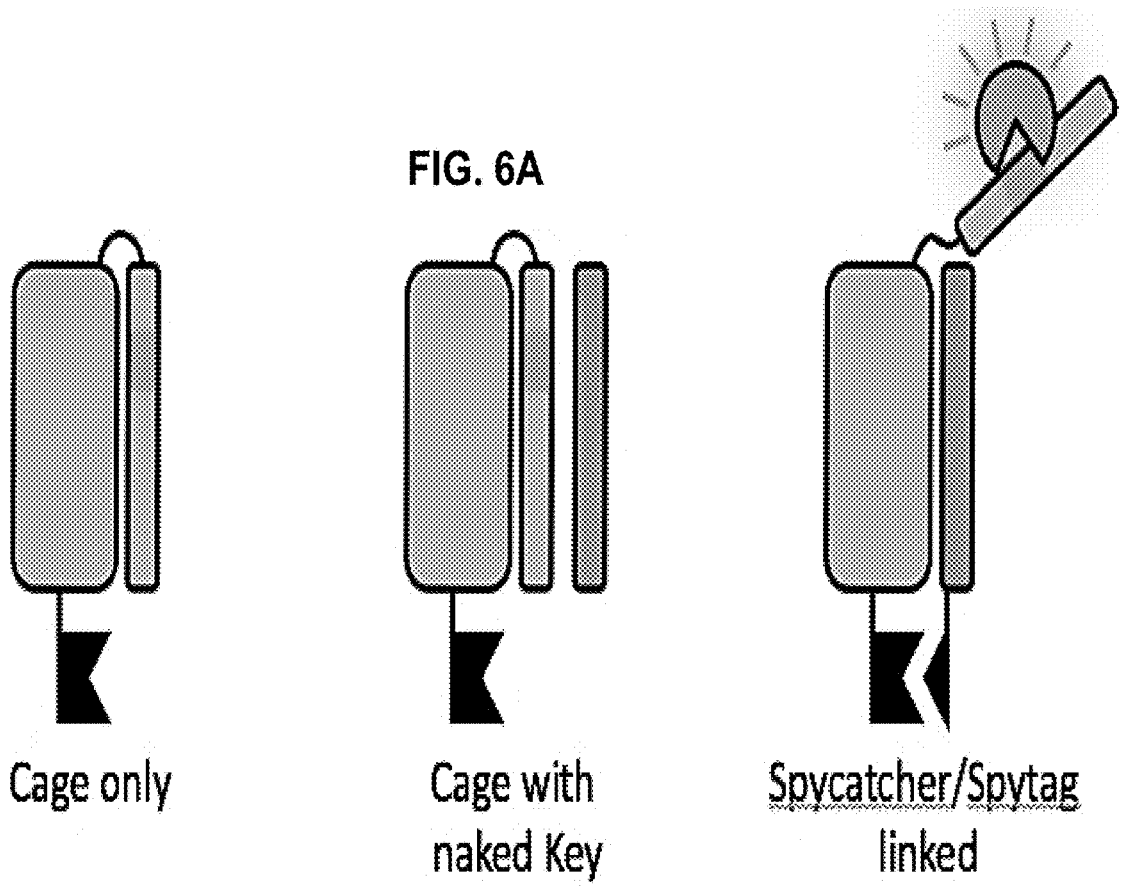
FIG. 6A-6C: Designed GFP11-LOCKR switch from FIG. 4, tuned to be colocalization-dependent.
Figure 6B:
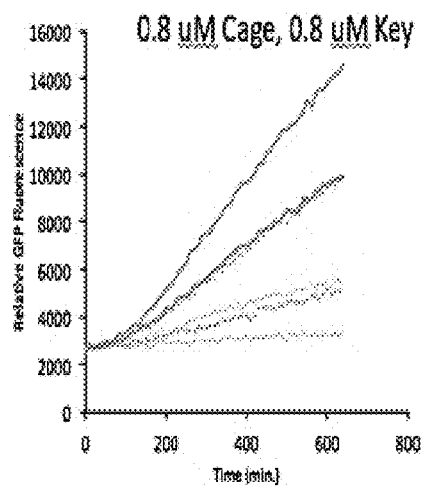
Figure 6C:
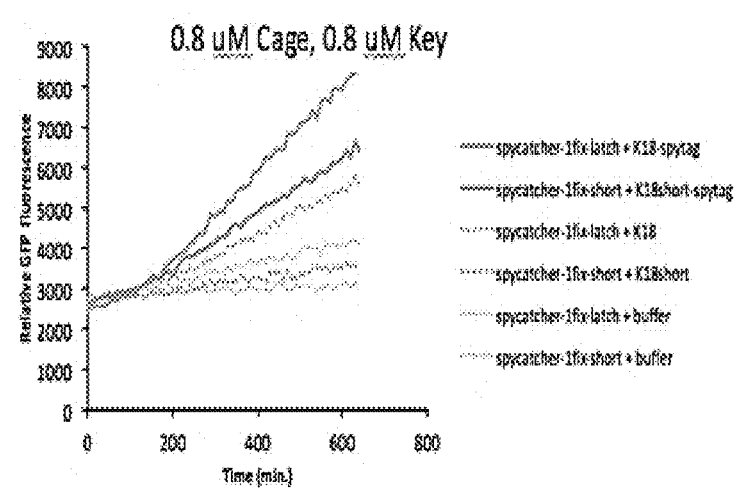

FIGS. 1-2 demonstrate that the dynamic range of LOCKR activation can be predictively tuned, suggesting that the system can be modulated to respond only when the Cage and Key are colocalized, which would be advantageous for a wide range of functions. Using the GFP11-LOCKR from FIG. 4, we demonstrated that this is indeed the case, and that that designed LOCKR switches can be tuned to be colocalization dependent using Spycatcher™/Spytag™ fusions (FIG. 6). Spycatcher™ covalently fuses to Spytag™; when Spycatcher™ fuse Cage was mixed with its Spytag-fused Key, it showed significantly more fluorescence that when mixed with its Key that was not fused to Spytag (FIG. 6).

Caged Intein LOCKR Switches

Figure 7:
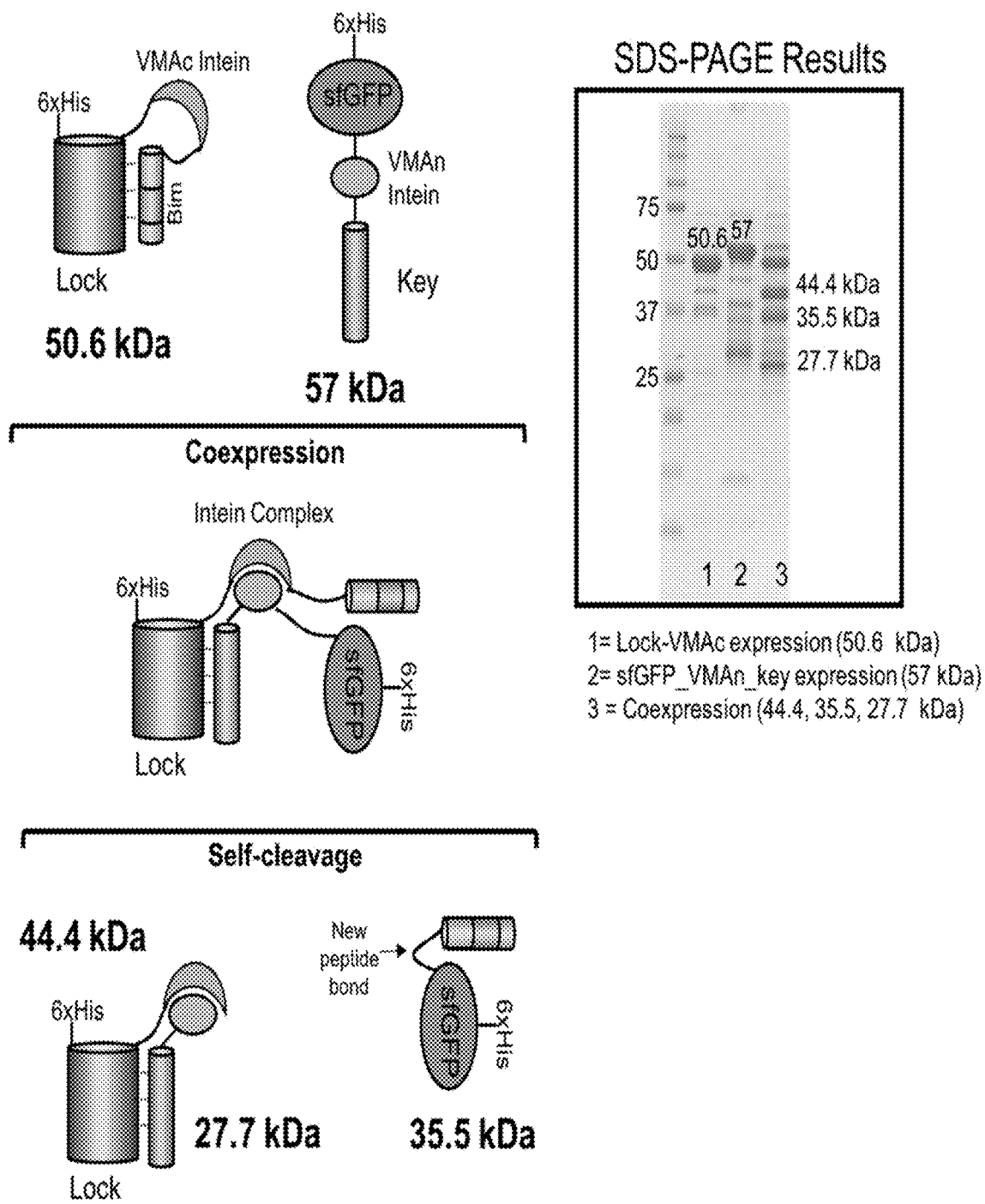
FIG. 7: Caged Intein LOCKR switches. Designed LOCKR switch with Cage component encoding the VMAc Intein shows successful activation when mixed with designed Key fused to sfGFP and VMAn Intein. The SDS-PAGE shows successful VMAc-VMAn reaction, with bands corresponding to the correct molecular weight of the expected spliced protein products.

Designed LOCKR switch, with Cage component encoding the VMAc Intein, shows successful activation when mixed with designed Key fused to sfGFP and VMAn Intein (FIG. 7). The SDS-PAGE shows successful VMAc-VMAn reaction, with bands corresponding to the correct molecular weight of the expected spliced protein products (FIG. 7).

Large-Scale High-Throughput Design of LOCKR Switches

The original LOCKR switch design (FIGS. 1-2) was built starting from a de novo designed symmetric homotrimer, 5L6HC3_1, which contains 6 helices[5]. We reasoned we should be make smaller LOCKR switches, consisting of 3 or 4 helices. Using everything that we learned from the testing and experimental validation of the original LOCKR switch, we created a computational pipeline to automate the design of thousands of new LOCKR switch scaffolds from scratch by exhaustively sampling Crick helical parameters[4,9].

These 2plus1 and 3plus1 LOCKR switches have smaller payload than the original designs (advantageous for cell engineering efforts), and due to lack of symmetry, are likely to be well-behaved and not aggregation-prone. (See Methods section for details of computational design and experimental testing).

strepLOCKR (STREPII-LOCKR)

Using the new 2+1 and 3+1 LOCKR scaffolds from the large-scale high-throughput design, we designed and tested new LOCKR scaffolds that encode and control the STREPII sequence, (N)WSHPQFEK (SEQ ID NO:63) (see Methods section for details). The designs (FIG. 13A) sequester the STREPII tag as compared to a positive control (FIG. 13B) and can be activated in the presence of Key (FIG. 13C-D), as determined by biolayer interferometry (Octet) data.

The data in FIG. 12 demonstrate caging of the PAH2 domain of the mSin3A transcriptional repressor. See the figure legend for details.

The data in FIG. 14 demonstrate 3plus1 LOCKR switches activating GFP fluorescence in response to expression of key. See the figure legend for details Discussion Here we demonstrate the power of the LOCKR platform by caging protein-protein interactions that can be inducibly activated by key. We show in vitro data caging the Bim peptide from binding its family members, GFP strand11 from completing the truncated 1-10 construct, and an anti-StrepTag™II antibody from binding caged StrepTag™II. The modularity and hyperstability of de novo designed proteins enables tuning of switch activation over a broad dynamic range by tuning the strength of the competing cage-key and cage-latch interfaces. Using this approach, we can now design switches beyond these proof-of-concept designs to cage peptides for more complex applications. LOCKR is useful for controlling native signaling networks, and in general for controlling biological function through fully synthetic networks of de novo signaling molecules.

LOCKR brings to proteins the modularity of DNA switching technology, but with advantages of being able to control, and be coupled to, the wide range of biochemical functions that can be carried out by proteins and bioactive peptides (which are much more diverse and wide ranging than nucleic acids).

Methods

PCR Mutagenesis and Isothermal Assembly

All primers for mutagenesis were ordered from Integrated DNA Technologies (IDT). Mutagenic primers were designed to anneal >18 bp on either side of the site for mutagenesis with the desired mutation encoded in the primer. PCR was used to create fragments upstream and downstream of the mutation site with >20 bp overlap with the desired pET vector. The resulting amplicons were isothermally assembled into either pET21b, pET28b, or pET29b restriction digested with XhoI and NdeI and transformed into chemically competent E. coli XL1-Blue cells. Monoclonal colonies were sequenced with Sanger sequencing. Sequence verified plasmid was purified using Qiagen miniprep kit and transformed into chemically competent E. coli BL21(DE3)Star, BL21(DE3)Star-pLysS cells (Invitrogen), or Lemo21(DE3) cells (NEB) for protein expression.

Synthetic Gene Construction

Synthetic genes were ordered from Genscript Inc. (Piscataway, N.J., USA) and delivered in pET 28b+, pET21b+, or pET29b+ E. coli expression vectors, inserted at the NdeI and XhoI sites of each vector. For pET28b+ constructs, synthesized DNA was cloned in frame with the N-terminal hexahistidine tag and thrombin cleavage site and a stop codon was added at the C-terminus. For pET21b+ constructs, a stop codon was added at the C-terminus such that the protein was expressed with no hexahistidine tag. For pET29b+ constructs, the synthesized DNA was cloned in frame with the C-terminal hexahistidine tag. Plasmids were transformed into chemically competent E. coli BL21(DE3) Star, BL21(DE3)Star-pLysS cells (Invitrogen), or Lemo21 (DE3) cells (NEB) for protein expression.

Bacterial Protein Expression and Purification

Starter cultures were grown in Lysogeny Broth (LB) or Terrific™ Broth II (TBII) overnight in the presence of 50 µg/mL carbenicillin (pET21b+) or 30 µg/mL (for LB) to 60 µg/mL (for TBII) kanamycin (pET28b+ and pET29b+). Starter cultures were used to inoculate 500 mL of Studier TBM-5052 autoinduction media containing antibiotic and grown at 37° C. for 24 hours. Cells were harvested by centrifugation at 4000 rcf for 20 minutes at 4° C. and resuspended in lysis buffer (20 mM Tris, 300 mM NaCl, 20 mM Imidazole, pH 8.0 at room temperature), then lysed by microfluidization in the presence of 1 mM PMSF. Lysates were cleared by centrifugation at 24,000 rcf for at least 30 minutes at 4° C. Supernatant was applied to Ni-NTA (Qiagen) columns pre-equilibrated in lysis buffer. The column was washed twice with 15 column volumes (CV) of wash buffer (20 mM Tris, 300 mM NaCl, 40 mM Imidazole, pH 8.0 at room temperature), followed by 15 CV of high-salt wash buffer (20 mM Tris, 1M NaCl, 40 mM Imidazole, pH 8.0 at room temperature) then 15 CV of wash buffer. Protein was eluted with 20 mM Tris, 300 mM NaCl, 250 mM Imidazole, pH 8.0 at room temperature. Proteins were further purified by gel filtration using FPLC and a Superdex™ 75 Increase 10/300 GL (GE) size exclusion column, pooling fractions containing monomeric protein.

Size-Exclusion Chromatography, Multi-Angle Light Scattering (SEC-MALS)

SEC-MALS experiments used a Superdex™ 75 Increase 10/300 GL (GE) size exclusion column connected to a miniDAWN™ TREOS multi-angle static light scattering and an Optilab T-rEX™ (refractometer with Extended range) detector (Wyatt Technology Corporation, Santa Barbara Calif., USA). Protein samples were injected at concentrations of 3-5 mg/mL in TBS (pH 8.0). Data was analyzed using ASTRATM™ (Wyatt Technologies) software to estimate the weight average molar mass (Mw) of eluted species, as well as the number average molar mass (Mn) to assess monodispersity by polydispersity index (PDI)=Mw/Mn.

Circular Dichroism (CD) Measurements

CD wavelength scans (260 to 195 nm) and temperature melts (25 to 95 C) were measured using an AVIV model 420 CD spectrometer. Temperature melts monitored absorption signal at 222 nm and were carried out at a heating rate of 4° C./min. Protein samples were at 0.3 mg/mL in PBS pH 7.4 in a 0.1 cm cuvette. Guanidinium chloride (GdmCl) titrations were performed on the same spectrometer with an automated titration apparatus in PBS pH 7.4 at 25 C, monitored at 222 nm with protein sample at 0.03 mg/mL in a 1 cm cuvette with stir bar. Each titration consisted of at least 40 evenly distributed concentration points with one minute mixing time for each step. Titrant solution consisted of the same concentration of protein in PBS+GdmCl. GdmCl concentration was determined by refractive index.

Small Angle X-Ray Scattering (SAXS)

Samples were exchanged into SAXS buffer (20 mM Tris, 150 mM NaCl, 2% glycerol, pH 8.0 at room temperature) via gel filtration. Scattering measurements were performed at the SIBYLS 12.3.1 beamline at the Advanced Light Source. The X-ray wavelength ($\lambda$) was 1.27 Å and the sample-to-detector distance of the Mar165 detector was 1.5 m, corresponding to a scattering vector q ($q=4\pi^*\sin(\theta/\lambda)$ where 2θ is the scattering angle) range of 0.01 to 0.59 $Å^{-1}$. Data sets were collected using 34 0.2 second exposures over a period of 7 seconds at 11 keV with protein at a concentration of 6 mg/mL. Data were also collected at a concentration of 3 mg/mL to determine concentration-dependence; all presented data was collected at the higher concentration as no concentration-dependent aggregation was observed. Data from 32 exposures was averaged separately over the Gunier, Parod, and Wide-q regions depending on signal quality over each region and frame. The averages were analyzed using the ScÅtter software package to analyze data and report statistics. FoXS was used to compare design models to experimental scattering profiles and calculate quality of fit (X) values. The hexahistidine tags and thrombin cleavage sites on the N-terminii of LOCKR proteins were modeled using Rosetta Remodel™ so that the design sequence matched that of the experimentally tested protein. To capture conformational flexibility of these residues, 100 independent models were generated, clustered, and the cluster center of the largest cluster was selected as a representative model for FoXS fitting without bias.

GFP Pulldown Assay

His-tagged LOCKR was expressed per the above protocol from pET28b+ while the key was expressed fused to superfolder GFP (sfGFP) without a his-tag in pET21b+. The his-tagged LOCKR was purified to completion and dialyized into TBS (20 mM Tris, 150 mM NaCl, pH 8.0 at room temperature); the key-GFP remained as lysate for this assay. 100 µL LOCKR at >1 uM was applied to a 96-well black Pierce® Nickel Coated Plate (ThermoFisher) and incubated at room temperature for 1 hour. Sample was discarded from the plate and washed 3× with 200 µL TBST (TBS+0.05% Tween-20). 100 µL of lysate containing key-GFP was added to each well and incubated at room temperature for 1 hour. Sample was discarded from the plate and washed 3× with 200 µL TBST (TBS+0.05% Tween-20). The plate was washed 1× with TBS, and 100 µL of TBS was added to each well. sfGFP fluorescence was measured on a Molecular Devices SpectraMax™ M5 plate reader or BioTek Synergy Neo2 plate reader; fluorescence was measured at 485 nm excitation and 530 nm emission, with a bandwidth of 20 nm for excitation and emission.

Bio-Layer Interferometry (BLI)

BLI measurements were made on an Octet® RED96 System (ForteBio) with streptavidin (SA) coated biosensors and all analysis was performed within ForteBio Data Analysis Software version 9.0.0.10. Assays were performed with protein diluted into HBS-EP+ Buffer from GE (10 mM HEPES, 150 mM NaCl, 3 mM EDTA, 0.05% v/v Surfactant P20, 0.5% non-fat dry milk, pH7.4 at room temperature). Biotinylated Bcl2 was loaded onto the SA tips to a threshold of 0.5 nm programmed into the machine's protocol. Baseline was obtained by dipping the loaded biosensors into HBS-EP+buffer; association kinetics were observed by dipping into wells containing defined concentrations of LOCKR and key, then dissociation kinetics were observed by dipping into the buffer used to obtain the baseline. Kinetic constants and response at equilibrium were computed by fitting a 1:1 binding model.

Thermodynamic LOCKR Model

The thermodynamic model in FIG. 1a illustrates three free parameters for five equillibrea. This defines three equations that relate the concentrations of all species (open or closed Switch, Key, Target, Switch-Key, Switch-Target, and Switch-Key-Target) at equilibrium.

$$K_{open}=[Switch_{open}]/[Switch_{closed}]$$

$$K_{CK}=[Switch_{open}][Key]/[Switch\text{-}Key]=[Switch\text{-}Target][Key]/[Switch\text{-}Key\text{-}Target]$$

$$K_{LT}=[Switch\text{-}Key][Target]/[Switch\text{-}Key\text{-}Target]=[Switch_{open}][Target]/[Switch\text{-}Target]$$

The total amount of each component (Switch, Key, and Target) is also constant and constrains the values of each species at equilibrium. This introduces the following equations to the model.

$$[Switch]_{total}=[Switch_{open}]+[Switch_{closed}]+[Switch\text{-}Key]+[Switch\text{-}Target]+[Switch\text{-}Key\text{-}Target]$$

$$[Key]_{total}=[Key]+[Switch\text{-}Key]+[Switch\text{-}Key\text{-}Target]$$

$$[Target]_{total}=[Target]+[Switch\text{-}Target]+[Switch\text{-}Key\text{-}Target]$$

These six equations were fed into sympy.nsolve( ) to find solutions given the six constants (three equilibrium constants, three total concentrations). Fraction bound was extracted from this solution and plotted for the corresponding figures.

Grafting Functional Sequence onto LOCKR Using Rosetta

Models of functional LOCKRs were made by grafting bioactive sequences onto the latch were designed using Rosetta™ XML to sample grafts starting at every helical register on the latch. This protocol uses two Rosetta movers, SimpleThreadingMover to change the amino acid sequence on the latch, and FastRelax™ with default settings to find the lowest energy structure given the functional mutations. Designs were selected by eye in PyMol™ 2.0 and high quality grafts had important binding residues interacting with the cage and minimized the number of buried unsatisfied hydrogen bonding residues.

Rosetta Design of Orthogonal LOCKR

Redesign of $LOCKR_a$ to orthogonal cage-key pairs using was carried out using Rosetta with score function beta_nov16. We extracted a model of the five-helix cage from the extended LOCKR model and used the Rosetta™ BundleGridSampler module to generate an ensemble of backbones for new latch geometries. The BundleGridSampler generates backbone geometry based on the Crick mathematical expressions for a coiled-coil, and allows efficient, parallel sampling of a regular grid of coiled-coil expression parameter values, which correspond to a continuum of peptide backbone conformations. For each parametrically-generated latch conformation sampled, Rosetta™ residue selectors specified the interface of the cage and latch for design of hydrogen bonding networks (HBNet) followed by Rosetta™ sidechain design. Residues were selected for design through Rosetta residue selectors by selecting the interface of the latch and cage via the InterfaceByVector residue selector. This residue selection was passed into both HBNet and sidechain design to strictly design the switching interface while leaving the cage with its original LOCKR sequence. Hydrogen Bond networks were designed using HBNetStapleInterface on the residues selected at the interface. The output contained designs with two or three hydrogen bond networks which span the three helices that make up the interface. All output from HBNet was then designed using PackRotamersMover to place residues at the interface while maintaining the hydrogen bond networks. Two rounds of design were done. The first used beta soft to aggressively pack the interface with potentially clashing rotamers while optimizing the interaction energy at the interface, then the structure was minimized using beta to resolve potential clashing atoms according to the full Rosetta score function. The final round of design placed rotamers with the full beta Rosetta score function to finally optimize the interactions across the cage-latch interface.

Candidate orthogonal LOCKR designs were selected based on lacking unsatisfied buried hydrogen bonding residues, the count of alanine residues as a proxy for packing quality, and sequence dissimilarity as a metric to find polar/hydrophobic patterns dissimilar enough to be orthogonal. Unsatisfied hydrogen bonding atoms were filtered out using the BuriedUnsatHbonds filter allowing no unsatisfied polar atoms according to the filter's metrics. Packing quality was determined by counting alanine residues at the interface because high alanine count means poor interdigitation of residues. A maximum of 15 alanine residues were allowed in the entire three helix interface. Pairwise sequence dissimilarity of every designed latch was scored with BLOSUM62 by aligning sequences using the Bio.pairwise2 package from BioPython as shown in seq_alignment.py. Alignment was performed disallowing gaps within the sequence through large opening and extension penalties which is analogous to a structural alignment of two helices to find the most similar superposition based on hydrophobic-polar patterning. Each score was subtracted from the maximum score to convert scores into a distance metric; the most diverse sequences has the lowest BLOSUM62 score which converts to the largest distance. The sequences were then clustered using HeirClust_fromRMSD.py and clustered with a cutoff of 170, resulting in 13 clusters. The center of each cluster was picked by maximizing distance between the 13 centers selected. The 13 candidates were then filtered by eye in PyMol™ 2.0 for unsatisfied hydrogen bonding atoms and qualitative packing quality. The five best designs by these three metrics were ordered as $LOCKR_{b-f}$.

Asymmetrized LOCKR Switches

The original $LOCKR_a$ switch was redesigned using Rosetta™ with HBNet; residues known to be important for LOCKR function were kept fixed, and remaining residues were optimized to preserve hydrophobic packing while introducing sequence diversity that minimized the number of repeating amino acid sequences and motifs. Synthetic DNA coding for the designs was obtained as described previously and designs were expressed, purified, and biophysically characterized as described previously. Crystallization trials were set up as described in the next section.

X-Ray Crystallography

Crystallization of Protein Samples

Purified protein samples were concentrated to 12-50 mg/ml in 20 mM Tris pH 8.0 and 100 mM NaCl. Samples were screened with a 5-position deck Mosquito crystal (ttplabtech) with an active humidity chamber, utilizing the following crystallization screens: JCSG+ (Qiagen), JCSG Core I-IV (Qiagen), PEG/Ion (Hampton Research), and Morpheus (Molecular Dimensions). The optimal conditions for crystallization of the different designs were found as follows:

- 1-fix-short-BIM-t0: 0.1M Tris pH 8.5, 5% (w/v) PEG 8000, 20% (v/v) PEG 300, 10% (v/v) Glycerol (no cryo needed)
- 1fix-short-GFP-t0: 0.2M Sodium chloride, 0.1M Sodium cacodylate pH 6.5, 2.0M Ammonium sulfate (plus 20% glycerol for cryo)
- 1fix-short-noBim(AYYA)-t0: 0.2M di-Sodium tartrate, 20% (w/v) PEG 3350 (no cryo added)

X-Ray Data Collection and Structure Determination

The crystals of the designed proteins were looped and placed in the corresponding reservoir solution, containing 20% (v/v) glycerol if the reservoir solution did not contain cryoprotectant, and flash-frozen in liquid nitrogen. The X-ray data sets were collected at the Advanced Light Source at Lawrence Berkeley National Laboratory with beamlines 8.2.1 and 8.2.2. Data sets were indexed and scaled using either XDS[35] or HKL2000[36]. Initial models were generated by the molecular-replacement method with the program PHASER™ [37] within the Phenix™ software suite[38], using the design models as the initial search models. Efforts were made to reduce model bias through refinement with simulated annealing using Phenix.refine, or, if the resolution was sufficient, by using Phenix.autobuild[40] with rebuild-in-place set to false, simulated annealing and prime-and-switch phasing. Iterative rounds of manual building in COOT and refinement in Phenix™ were used to produce the final models. Due to the high degree of self-similarity inherit in coiled-coil-like proteins, datasets for the reported structures suffered from a high degree of pseudo translational non-crystallographic symmetry, as report by Phenix.Xtriage™, which complicated structure refinement and may explain the higher than expected R values reported. RMSDs of bond lengths, angles and dihedrals from ideal geometries were calculated with Phenix™. The overall quality of all final models was assessed using the program MOLPROBITY™.

gfpLOCKR: (GFP11-LOCKR) Switch Design and Characterization

Using the asymmetrized $LOCKR_a$ design scaffold, the 11$^{th}$ strand of GFP was encoded into the Latch sequence of the Cage as described in the section above "Grafting Functional Sequence onto LOCKR using Rosetta™", and synthetic genes coding for the designed proteins obtained as described above. Proteins were purified and biophysically characterized as described above. To test for induction of fluorescence upon addition of Key, the proteins were mixed by pipetting and immediately assayed in a black 96-well plate using a Biotek Synergy Neo2 plate reader to monitor relative GFP fluorescence (Ex: 488, Em: 508, 10 minutes between reads). Cage leakiness was evaluated by measuring GFP fluorescence over time in the absence of Key In Vitro Co-Localization-Dependent Switching with gfpLOCKR (GFP11-LOCKR)

The GfpLOCKR Cage was cloned with SpyCatcher™ fused to its N-terminus via a floppy linker, the gfpLOCKR Key was cloned with SpyTag™ fused to its C-terminus via a floppy linker, and GFP1-10 was cloned into its own pET21 vector. These proteins were expressed in E. coli Lemo21 cells with Studier's autoinduction media overnight at 18 C. After expression, the producer cells were harvested by centrifugation and lysed by microfluidizer. The desired proteins were purified from clarified lysates by Ni-NTA affinity chromatography and quantitated by $A_{280}$ on a nanodrop. Proteins were diluted to final concentrations in PBS (GFP1-10: 1.9 uM in all samples; Cage: 1.5 uM, 0.8 uM, 0.4 uM, 0.2 uM, 0.094 uM; Key: 1.5 uM, 0.8 uM, 0.4 uM, 0.2 uM, 0.094 uM) and pooled as follows: SpyCatcher™-Cage alone (no Key), SpyCatcher™-Cage with naked Key (no SpyTag™), and SpyCatcher-Cage with SpyTag-Key. The proteins were mixed by pipetting and immediately assayed in a black 96-well plate using a Biotek Synergy Neo2 plate reader to monitor relative GFP fluorescence (Ex: 488, Em: 508, 10 minutes between reads). Cage leakiness was evaluated by measuring GFP fluorescence over time in the absence of Key. Co-localization dependence was confirmed by showing that SpyTag™-Key activated GFP fluorescence faster than did naked Key.

Caged Intein LOCKR Switches

The VMAc intein sequence was designed to be encoded into the Latch of $LOCKR_a$. The VMAn intein sequence was fused to $Key_a$. Constructs were cloned and purified as previous LOCKR designs described above. Intein activity (splicing) was assessed by SDS-PAGE.

Large-Scale High-Throughput Design of LOCKR Switches

The computational pipeline to design of thousands of new LOCKR switch scaffolds from scratch is as follows: backbones were exhaustively sampled using Crick helical parameters for 3-helix bundles (denoted 2plus1 or 2+1 because of a 2-helix scaffold plus 1-helix latch) and 4-helix bundles (denoted 3plus1 or 3+1 because of 3-helices plus 1-helix latch); parameters sampled include z-offset (−1.51, 0 and 1.51), helical phase every 10 degrees between 0 and 100, and superhelical radii for each helix ranging from 5-10 angstroms from the central superhelical axis (z-axis); based on the success of the original LOCKR design, we focused on designs with straight helices and no supercoiling (superhelical twist fixed to 0.0). Each generated helix is 58 residues in length; Rosetta loop closure methods were used to add loops connecting all helices into a single polypeptide chain (Cage scaffold). Sequence and sidechain design was carried out using HBNet, MC-HBNet, and RosettaDesign™. Additional designs were generated by truncating the helical bundles into shorter scaffolds, making versions with the Latch as either the N-terminal or C-terminal helix, and by trying different toehold lengths (truncations of Latch helix that end in a polar residue and remove at least one or two hydrophobic packing residues from the original design). Designs were selected based on computational methods learned from iterative testing and design of previous LOCKR scaffolds and HBNet helical bundles: important metrics include secondary structure shape complementarity (ss_sc)>0.65 (best designs had ss_sc>0.7); RosettaHoles™ filter in regions surrounding hydrogen bond networks to eliminate designs with large cavities adjacent to hydrogen bond networks in the core of the scaffolds; designs were required to have at least 2 distinct hydrogen bond networks that spanned all helices of the design model (i.e. each helix must contribute at least one amino acid sidechain to the network); the number of Ile, Leu, and Val residues, and number of contacts made by these amino acid types, as compared to Ala (smaller amino acid) also serves as a proxy that correlates well with designs that have tight, interdigitated hydrophobic packing, which is important for generating a stable protein scaffold.

strepLOCKR (STREPII-LOCKR) Computational Design:

LOCKR switches encoding the STREPII tag, (N)WSHPQFEK (SEQ ID NO:63), were designed using the 2plus1 and 3plus1 switches from the large-scale high-throughput LOCKR design set. This sequence is difficult to encode because of the Pro (which kinks alpha helices) and the Trp and His, which if buried must likely participate in hydrogen bonds. To address these issues, rather than sampling all helical residues, the large-scale design set was mined to find LOCKR scaffolds that already contained Trp (W), His (H) already pre-organized into hydrogen bond networks of the designs. Designs with pre-organized Phe (F) were also considered.

strepLOCKR (STREPII-LOCKR) Experimental Testing:

The purified proteins were tested for their ability to sequester the STREPII sequence in absence of Key, and activate in presence of Key using biolayer interferometry (Octet® RED96 System, PALL ForteBio): THE™ NWSHPQFEK (SEQ ID NO:63) Tag Antibody (mAb mouse, Genscript A01732-200) was loaded onto Anti-Mouse IgG Fc Capture (AMC) Biosensors (PALL ForteBio); tips were preconditioned by cycling between Glycine pH 1.65 and Octet assay buffer: HBS-EP+Buffer from GE (10 mM HEPES, 150 mM NaCl, 3 mM EDTA, 0.05% v/v Surfactant P20, 0.5% non-fat dry milk, pH7.4 at room temperature). Protein samples were diluted into Octet assay buffer, keeping dilution factors consistent as to minimize noise. The antibody-loaded tips were reused up to 8 times using the recommended regeneration protocol of cycling between Glycine pH 1.65 and Octet assay buffer (minimal loss in loading was observed when the tips were preconditions, and a signal threshold was set to ensure consistent loading of the tips each time).

The THE™ NWSHPQFEK (SEQ ID NO:63) Tag Antibody (mAb mouse, Genscript A01732-200) was used at a concentration of 5 ug/mL in Octet assay buffer; stocks of antibody were made up to 0.5 mg/mL with 400 ul mqH2O, aliquoted and stored at −80 C, thawed immediately before use.

Purification of Proteins from Bacterial Preps not Already Described Above:

Starter cultures were grown at 37° C. in either Luria-Bertani (LB) medium overnight, or in Terrific Broth for 8 hours, in the presence of 50 µg/ml carbenicillin (pET21-NESG) or 50 µg/ml kanamycin (pET-28b+). Starter cultures were used to inoculate 500 mL of LB (induced with 0.2 mM IPTG at OD600 of ~0.6-0.9) or Studier auto-induction media containing antibiotic. Cultures were expressed overnight at 18° C. (many designs were also later expressed at 37° C. for 4 hours with no noticeable difference in yield). Cells were harvested by centrifugation for 15 minutes at 5000 rcf 4° C. and resuspended in lysis buffer (20 mM Tris, 300 mM NaCl, 20 mM Imidazole, pH 8.0 at room temperature), then lysed by sonication in presence of lysozyme, DNAse, and EDTA-free cocktail protease inhibitor (Roche) or 1 mM PMSF. Lysates were cleared by centrifugation at 4° C. 18,000 rpm for at least 30 minutes and applied to Ni-NTA (Qiagen) columns pre-equilibrated in lysis buffer. The column was washed three times with 5 column volumes (CV) of wash buffer (20 mM Tris, 300 mM NaCl, 40 mM Imidazole, pH 8.0 at room temperature), followed by 3-5 CV of high-salt wash buffer (20 mM Tris, 1 M NaCl, 40 mM Imidazole, pH 8.0 at room temperature), and then 5 CV of wash buffer. Protein was eluted with 20 mM Tris, 300 mM NaCl, 250 mM Imidazole, pH 8.0 at room temperature. No reducing agents were added, as none of the designed proteins contained cysteines.

REFERENCES

1. Huang, P.-S., Boyken, S. E. & Baker, D. The coming of age of de novo protein design. *Nature* 537, 320-327 (2016).
2. Joh, N. H. et al. De novo design of a transmembrane $Zn^{2+}$-transporting four-helix bundle. *Science* 346, 1520-1524 (2014).
3. Davey, J. A., Damry, A. M., Goto, N. K. & Chica, R. A. Rational design of proteins that exchange on functional timescales. *Nat. Chem. Biol.* 13, 1280-1285 (2017).
4. Huang, P.-S. et al. High thermodynamic stability of parametrically designed helical bundles. *Science* 346, 481-485 (2014).
5. Boyken, S. E. et al. De novo design of protein homo-oligomers with modular hydrogen-bond network-mediated specificity. *Science* 352, 680-687 (2016).
6. Berger, S. et al. Computationally designed high specificity inhibitors delineate the roles of BCL2 family proteins in cancer. *Elife* 5, 1422 (2016).
7. Leaver-Fay, A. et al. ROSETTA3: an object-oriented software suite for the simulation and design of macromolecules. *Meth Enzymol* 487, 545-574 (2011).
8. Kuhlman, B. & Baker, D. Native protein sequences are close to optimal for their structures. *Proc Natl Acad Sci USA* 97, 10383-10388 (2000).
9. Crick, F. H. C. The packing of [alpha]-helices: simple coiled-coils. *Acta Cryst* (1953). Q6, 689-697 [doi: 10.1107/S0365110X53001964] 6, 1-9 (1953).
10. Glantz, S. T. et al. Functional and topological diversity of LOV domain photoreceptors. *Proc Natl Acad Sci USA* 113, E1442-51 (2016).
11. Dueber, J. E., Mirsky, E. A. & Lim, W. A. Engineering synthetic signaling proteins with ultrasensitive input/output control. 25, 660-662 (2007).
12. Dueber, J. E., Yeh, B. J., Chak, K. & Lim, W. A. Reprogramming control of an allosteric signaling switch through modular recombination. *Science* 301, 1904-1908 (2003).
13. Huang, P.-S. et al. RosettaRemodel: A Generalized Framework for Flexible Backbone Protein Design. *PLoS ONE* 6, e24109 (2011).
14. Schneidman-Duhovny, D., Hammel, M. & Sali, A. FoXS: a web server for rapid computation and fitting of SAXS profiles. *Nucleic Acids Res* 38, W540-4 (2010).
15. Maguire, J. B., Boyken, S. E., Baker, D. & Kuhlman, B. Rapid Sampling of Hydrogen Bond Networks for Computational Protein Design. *J. Chem. Theory Comput* 14, 2751-2760 (2018).

---

SEQUENCE LISTING (27358 sequences)

SEQ ID NO: 1 - protein, 272 aa, Artificial Sequence
  Synthetic
  MISC_FEATURE (1)..(21): optional
  MISC_FEATURE (244)..(244): X can be any residue
  MISC_FEATURE (259)..(259): X can be any residue
MGSSHHHHHHSSGLVPRGSHMSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASELTDPDEARKAIARXKRESKRIVEDAERLXREAAAASEKISRE

SEQ ID NO: 2 - protein, 273 aa, Artificial Sequence
  Synthetic
  MISC_FEATURE (1)..(21): optional
MGSSHHHHHHSSGLVPRGSHMGSKEAVTKLMALNLKLAEKLLEAIARLQELNIALVYLATELTDPERIREEIRKVKEESARIVEEAEEEIRRAAARSEDILREGSGSGSDAVAELQRLNLELAELLLRAAAKLQELNIDLVRLLTELTDPKTIRDAIERVKAESERIVREAERLIREAKADSERILREGSGSGDPDVARLQELFIELARELLEALARLQELNIDLVRLASELTDPDTIRDAIRRVKEESARIVEDARRLIKEAAEEAEKISRE

SEQ ID NO: 3 - protein, 273 aa, Artificial Sequence
  Synthetic
  MISC_FEATURE (1)..(21): optional
MGSSHHHHHHSSGLVPRGSHMGSKRAVTELQKLNIELARKLLRALAELMELNIALVYLAVELTDPRRIREEIRKVKEKSDEIVKRAEDEIRKAAAESEKILREGSGSGSDAVAELQRLNLELAKLLLEAIAKLQALNIDLVRLLTELTDPETIRRAIKRVKDESARIVEEAEKLIRAAKDKAREIIDKGSGSGDPDVARLQELNIELARELLEAAARLQELFIDLVRLASELTDPDEARKAIERVKREAERIVREAERLIREAKRASKEISDE

SEQ ID NO: 4 - protein, 295 aa, Artificial Sequence
  Synthetic
  MISC_FEATURE (1)..(21): optional
MGSSHHHHHHSSGLVPRGSHMKLLEAVTKLQALNIKLAEKLLEALARLQELNIALVYLAVELTDPKRIADEIKKVKDKSKEIVERAEEEIARAAAESKKILDEAEEEGSGSGSELLLEAVAELQALNLKLAELLLEAIAKLQELNIKLVELLTKLTDPATIREAIRKVKEDSERIVAEAERLIAAAKAESERIIREAERLAGSGSGSRELLRDVARLQELNIELARELLRAAAELQELNIKLVELASELTDPDEARKAIARVKRESKRIVEDAERLIREAAAASEKISREAERLI

SEQ ID NO: 5 - protein, 319 aa, Artificial Sequence
  Synthetic
  MISC_FEATURE (1)..(21): optional
MGSSHHHHHHSSGLVPRGSHMKLAEKLLEAVTKLQALNIKLAEKLLEALARLQELNIALVYLAVELTDPKRIADEIKKVKDKSKEIVERAEEEIARAAAESKKILDEAEEEIARAGSGSGSLKLAELLLEAVAELQALNLKLAELLLEAIAKLQELNIKLVELLTKLTDPATIREAIRKVKEDSERIVAEAERLIAAAKAESERIIREAERLIAAAAGSGSGSIELARELLRDVARLQELNIELARELLRAAAELQELNIKLVELASELTDPDEARKAIARVKRESKRIVEDAERLIREAAAASEKISREAERLIREAA

SEQ ID NO: 6 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLIREAAAASEKISREAERLIREAAAASEKISRE

SEQ ID NO: 7 - protein, 382 aa, Artificial Sequence
  Synthetic
  MISC_FEATURE (1)..(21): optional
MGSSHHHHHHSSGLVPRGSHMSHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGNKEEIEKLAKEAREKLKKAEKEHKEIHDKLRKKNKKAREDLKKKADELRETNKRVN

SEQ ID NO: 8 - protein, 382 aa, Artificial Sequence
  Synthetic
  MISC_FEATURE (1)..(21): optional
MGSSHHHHHHSSGLVPRGSHMSLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGSGSSEKVRRELKESLKENHKQNQKLLKDHKRAQEKLNRELEELKKKHKKTLDDIRRES

SEQ ID NO: 9 - protein, 382 aa, Artificial Sequence
  Synthetic
  MISC_FEATURE (1)..(21): optional
MGSSHHHHHHSSGLVPRGSHMSLEAVLKLFELNHKLSEKLLEAVLKLHALNQKLSQKLLEALARLLELNVALVELAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPEVARLQEAFIEQAREILRNVAAAQEALIEQARRLLALAALAQEAAIKAVELASEHGSGSGDTVKRILEELRRRFEKLAKDLDDIARKLLEDHKKHNKELKDKQRKIKKEADDAARS

SEQ ID NO: 10 - protein, 382 aa, Artificial Sequence
  Synthetic
  MISC_FEATURE (1)..(21): optional
MGSSHHHHHHSSGLVPRGSHMSLEAVLKLQDLNSKLSEKLSEAQLKLQALNNKLLRKLLEALLRLQDLNQALVNLALQLTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVAKSQEHLIEHARELLRQVAKSQELFIELARQLLRLAAKSQELAIKAVELASEAGSGSGDDVERRLRKANKESKKEAEELTEEAKKANEKTKEDSKELTKENRKTNKTIKDEARS

SEQ ID NO: 11 - protein, 382 aa, Artificial Sequence
  Synthetic
  MISC_FEATURE (1)..(21): optional
MGSSHHHHHHSSGLVPRGSHMSREAVEKLAELNHKLSHKLQQAQQKLQALNLKLLQKLLEALDRLQDLNNALVKLAQRLTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARQQETLIEQARRLLRNVAESQELFIEAARTVLRLAAKLQEINIKQVELASEAGSGSGDDEERRSEKTVQDAKREIKKVEDDLQRLNEEQKKKVKKQEDENQKTLKKHKDDARS

SEQ ID NO: 12 - protein, 258 aa, Artificial Sequence
  Synthetic
  MISC_FEATURE (1)..(21): optional
MGSSHHHHHHSSGLVPRGSHMNKEDATEAQKKAIRAAEELLKDVTRIQERAIREAEKALERLARVQEEAIRRVYEAVESKNKEELKKVKEEIEELLRRLKRELDELEREIRELLKEIKEKADRLEKEIRDLIERIRRDRNASDEVVTRLARLNEELIRELREDVRRLAELNKELLRELERAARELARLNEKLLELADRVETEEEARKAIARVKRESKRIVEDAERLIREAAAASEKISREAERLIREAAAASEKISRE

SEQ ID NO: 13 - protein, 262 aa, Artificial Sequence
  Synthetic
  MISC_FEATURE (1)..(21): optional
MGSSHHHHHHSSGLVPRGSHMDERLKRLNERLADELDKDLERLLRLNEELARELTRAAEELRELNEKLVELAKKLQGGRSREVAERAEKEREKIRRKLEEIKKEIKEDADRIKKRADELRRRLEKTLEDAARELEKLKREPRTEELKRKATELQKEAIRRAEELLKEVTDVQRRAIERAEELLEKLARLQEEAIRTVYLLVELNKVDRARKAIARVKRESKRIVEDAERLIREAAAASEKISREAERLIREAAAASEKISRE

SEQ ID NO: 14 - protein, 259 aa, Artificial Sequence
  Synthetic
  MISC_FEATURE (1)..(21): optional
MGSSHHHHHHSSGLVPRGSHMLIERLTRLEKEHVRELKRLLDTSLEILRRLVEAFETNLRQLKEALKRALEAANLHNEEVEEVLRKLEEDLRRLEEELRKTLDDVRKEVKRLKEELDKRIKEVEDELRKIKEKLKKGDKNEKRVLEEILRLAEDVLKKSDKLAKDVQERARELNEILEELSRKLQELFERVVEEVTRNVPTTERIEKVRRELKESLKENHKQNQKLLKDHKRAQEKLNRELEELKKKHKKTLDDIRRES

SEQ ID NO: 15 - protein, 263 aa, Artificial Sequence
  Synthetic
  MISC_FEATURE (1)..(21): optional
MGSSHHHHHHSSGLVPRGSHMSEERVLELAEEALRLSDEAAKEIQELARRLNEELEKLSKELQDLFERIVETVTRLIDADEETLKRAAEEIKKRLEDARKKAKEAADKAREELDRARKKLKELVDEIRKKAKDALEKAGADEELVARLLRLLEEHARELERLLRTSARIIERLLDAFRRNLEQLKEAADKAVEAAEEAVRRVEDVRVWSEKVRRELKESLKENHKQNQKLLKDHKRAQEKLNRELEELKKKHKKTLDDIRRES

SEQ ID NO: 16 - protein, 311 aa, Artificial Sequence
  Synthetic
  MISC_FEATURE (1)..(23): optional
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVEDAERLIREAAAASEKISREAERLIR

SEQ ID NO: 17 - protein, 311 aa, Artificial Sequence
  Synthetic
  MISC_FEATURE (1)..(23): optional
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESNAYYADAERLIREAAAASEKISREAERLIR

SEQ ID NO: 18 - protein, 280 aa, Artificial Sequence
  Synthetic
  MISC_FEATURE (1)..(21): optional
  MISC_FEATURE (234)..(240): optional
  MISC_FEATURE (249)..(249): X is any residue
  MISC_FEATURE (252)..(252): X is any residue
  MISC_FEATURE (260)..(260): X is any residue
MGSSHHHHHHSSGLVPRGSHMGSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASELTGSGSGSGDPKMAQELXDKXRAASLQIXGDAFYAILRALAASEKLSKE

SEQ ID NO: 19 - protein, 275 aa, Artificial Sequence
  Synthetic
  MISC_FEATURE (1)..(21): optional
  MISC_FEATURE (247)..(247): X is any residue
  MISC_FEATURE (262)..(262): X is any residue
MGSSHHHHHHSSGLVPRGSHMKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASEGSGSGSEIAEALRAIGDXFNESYRIVEDAERLXREAAAASEKISRE

SEQ ID NO: 20 - protein, 295 aa, Artificial Sequence
  Synthetic
  MISC_FEATURE (1)..(21): optional
MGSSHHHHHHSSGLVPRGSHMKLLEAVTKLQALNIKLAEKLLEALARLQELNIALVYLAVELTDPKRIADEIKKVKDKSKEIVERAEEEIARAAAESKKILDEAEEEGSGSGSELLLEAVAELQALNLKLAELLLEAIAKLQELNIKLVELLTKLTDPATIREAIRKVKEDSERIVAEAERLIAAAKAESERIIREAERLAGSGSGSRELLRDVARLQELNIELARELLRAAAELQELNIKLVELASELTDEIWIAQELRRIGDEFNAYYADAERLIREAAAASEKISREAERLI

SEQ ID NO: 21 - protein, 319 aa, Artificial Sequence
  Synthetic
  MISC_FEATURE (1)..(21): optional
MGSSHHHHHHSSGLVPRGSHMKLAEKLLEAVTKLQALNIKLAEKLLEALARLQELNIALVYLAVELTDPKRIADEIKKVKDKSKEIVERAEEEIARAAAESKKILDEAEEEIARAGSGSGSLKLAELLLEAVAELQALNLKLAELLLEAIAKLQELNIKLVELLTKLTDPATIREAIRKVKEDSERIVAEAERLIAAAKAESERIIREAERLIAAAAGSGSGSIELARELLRDVARLQELNIELARELLRAAAELQELNIKLVELASELTDEIWIAQELRRIGDEFNAYYADAERLIREAAAASEKISREAERLIREAA

SEQ ID NO: 22 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDEIWIAQELRRIGDEFNAYYADAERLIREAAAASEKISREAERLIREAAAASEKISRE

SEQ ID NO: 23 - protein, 382 aa, Artificial Sequence
  Synthetic
  MISC_FEATURE (1)..(21): optional
MGSSHHHHHHSSGLVPRGSHMSHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGNEIWIAQELRRIGDEFNAYYAEHKEIHDKLRKKNKKAREDLKKKADELRETNKRVN

SEQ ID NO: 24 - protein, 382 aa, Artificial Sequence
  Synthetic
  MISC_FEATURE (1)..(21): optional
MGSSHHHHHHSSGLVPRGSHMSLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGEIWIAQELRRIGDEFNAYYAQNQKLLKDHKRAQEKLNRELEELKKKHKKTLDDIRRES

SEQ ID NO: 25 - protein, 381 aa, Artificial Sequence
  Synthetic
  MISC_FEATURE (1)..(21): optional
MGSSHHHHHHSSGLVPRGSHMSLEAVLKLFELNHKLSEKLLEAVLKLHALNQKLSQKLLEALARLLELNVALVELAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPEVARLQEAFIEQAREILRNVAAAQEALIEQARRLLALAALAQEAAIKAVELASEHGSGSEIWIAQELRRIGDEFNAYYADLDDIARKLLEDHKKHNKELKDKQRKIKTIKDEARS

SEQ ID NO: 26 - protein, 382 aa, Artificial Sequence
  Synthetic
  MISC_FEATURE (1)..(21): optional
  MISC_FEATURE (320)..(321): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASGGNWSHPQFEKKAIARVKRESKRIVEDAERLIREAAAASEKISREAERLIREAAAASEKISRE

SEQ ID NO: 27 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDENWSHPQFEKRESKRIVEDAERLIREAAAASEKISREAERLIREAAAASEKISRE

SEQ ID NO: 28 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKNWSHPQFEKKRIVEDAERLIREAAAASEKISREAERLIREAAAASEKISRE

SEQ ID NO: 29 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIANWSHPQFEKVEDAERLIREAAAASEKISREAERLIREAAAASEKISRE

SEQ ID NO: 30 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARNWSHPQFEKEDAERLIREAAAASEKISREAERLIREAAAASEKISRE

SEQ ID NO: 31 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRENWSHPQFEKRLIREAAAASEKISREAERLIREAAAASEKISRE

SEQ ID NO: 32 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRNWSHPQFEKREAAAASEKISREAERLIREAAAASEKISRE

SEQ ID NO: 33 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVENWSHPQFEKAAASEKISREAERLIREAAAASEKISRE

SEQ ID NO: 34 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLINWSHPQFEKISREAERLIREAAAASEKISRE

SEQ ID NO: 35 - protein, 309 aa, Artificial Sequence
  Synthetic
  MISC_FEATURE (1)..(21): optional
  MISC_FEATURE (217)..(217): X is any residue
MGSSHHHHHHSSGLVPRGSHMGSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAXLQELNIKLVELASEGSGSGSGYELRRALEELEKALRELKKSLDELERSLEELEKNPSEDALVENNRLNVENNKIIVEVLRIIAEVLKINAKS

SEQ ID NO: 36 - protein, 319 aa, Artificial Sequence
  Synthetic
  MISC_FEATURE (1)..(21): optional
MGSSHHHHHHSSGLVPRGSHMGSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASEGSGSGSGKKLVEEVERALRELLKTSEDLVRKVEKALRELLELIRRGGTKDKIEEKIRRVLEEIKRELERQKRKIEDVLRQIKEELYRS

SEQ ID NO: 37 - protein, 398 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASEGSGSGSGYELRRALEELEKALRELKKSLDELERSLEELEKNPSEDALVENNRLNVENNKIIVEVLRIIAEVLKINAKS

SEQ ID NO: 38 - protein, 408 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASEGSGSGSGKKLVEEVERALRELLKTSEDLVRKVEKALRELLELIRRGGTKDKIEEKIRRVLEEIKRELERQKRKIEDVLRQIKEELYRS

SEQ ID NO: 39 - protein, 856 aa, Artificial Sequence
  Synthetic
  MISC_FEATURE (1)..(259): optional
  MISC_FEATURE (619)..(856): optional
GHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLIREAAAASEKISREAERLIREAAAASEKISREVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 40 - protein, 859 aa, Artificial Sequence
  Synthetic
  MISC_FEATURE (1)..(260): optional
  MISC_FEATURE (622)..(859): optional
MGHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGNKEEIEKLAKEAREKLKKAEKEHKEIHDKLRKKNKKAREDLKKKADELRETNKRVNVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 41 - protein, 858 aa, Artificial Sequence
  Synthetic
  MISC_FEATURE (1)..(259): optional
  MISC_FEATURE (621)..(858): optional
GHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGSGSSEKVRRELKESLKENHKQNQKLLKDHKRAQEKLNRELEELKKKHKKTLDDIRRESVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 42 - protein, 858 aa, Artificial Sequence
  Synthetic
  MISC_FEATURE (1)..(259): optional
  MISC_FEATURE (621)..(858): optional
GHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSLEAVLKLFELNHKLSEKLLEAVLKLHALNQKLSQKLLEALARLLELNVALVELAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPEVARLQEAFIEQAREILRNVAAAQEALIEQARRLLALAALAQEAAIKAVELASEHGSGSGDTVKRILEELRRRFEKLAKDLDDIARKLLEDHKKHNKELKDKQRKIKKEADDAARSVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 43 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAEENLYFQGAASEKISREAERLIREAAAASEKISRE

SEQ ID NO: 44 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARAHIVMVDAYKKRIVEDAERLIREAAAASEKISREAERLIREAAAASEKISRE

SEQ ID NO: 45 - protein, 359 aa, Artificial Sequence
  Synthetic
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDLALKLAGLDINSEKISREAERLIREAAAASEKISRE

SEQ ID NO: 46 - protein, 359 aa, Artificial Sequence
  Synthetic
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLIRELAEKLAGLDINAERLIREAAAASEKISRE

SEQ ID NO: 47 - protein, 359 aa, Artificial Sequence
  Synthetic
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKELAEKLRAGLDLNAAASEKISREAERLIREAAAASEKISRE

SEQ ID NO: 48 - protein, 359 aa, Artificial Sequence
  Synthetic
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKAAAKRARTSIREAAAASEKISREAERLIREAAAASEKISRE

SEQ ID NO: 49 - protein, 380 aa, Artificial Sequence
  Synthetic
  MISC_FEATURE (1)..(21): optional
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKTMFSSNRQKILERTETLNQEWKQRRIQAERLIREAAAASEKISRE

SEQ ID NO: 50 - protein, 16 aa, Artificial Sequence
  Synthetic
  MISC_FEATURE (2)..(4): X is any amino acid
  MISC_FEATURE (7)..(7): X is any amino acid
  MISC_FEATURE (11)..(11): X is any amino acid
  MISC_FEATURE (13)..(15): X is any amino acid
IXXXLRXIGDXFXXXY

SEQ ID NO: 51 - protein, 451 aa, Artificial Sequence
  Synthetic
  MISC_FEATURE (1)..(20): optional
  MISC_FEATURE (331)..(396): optional
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTGGSGGSGGSVLLNVLSKCAGSKKFRPAPAAAFARECRGFYFELQELKEDDYYGITLSDDSDHQFLLANQVVVHNCGGSGGSDEIWIAQELRRIGDEFNAYYADAERLIREAAAASEKISREAERLIREAA

SEQ ID NO: 52 - protein, 823 aa, Artificial Sequence
  Synthetic
  MISC_FEATURE (1)..(20): optional
MGSHHHHHHGSGSENLYFQGHMSKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKSGSGSGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYGGSGGSGGGGSGGSGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDEIWIAQELRRIGDEFNAYYADAERLSREAAAASEKISREAERSIREAAAASEKISRE

SEQ ID NO: 53 - protein, 822 aa, Artificial Sequence
  Synthetic
  MISC_FEATURE (1)..(463): optional
MGSSHHHHHHSSGLVPRGSHMSKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKSGSGSGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYGGSGGSGGGGSGGSGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDEIWIAQELRRIGDEFNAYYADAERLSREAAAASEKISREAERSIREAAAASEKISRE

SEQ ID NO: 54 - protein, 379 aa, Artificial Sequence
  Synthetic
  MISC_FEATURE (1)..(20): optional
  MISC_FEATURE (321)..(342): optional
  misc_feature (348)..(348): Xaa can be any naturally occurring amino acid
  misc_feature (365)..(365): Xaa can be any naturally occurring amino acid
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDEIWIAQELRRIGDEFNAYYADAERLXREAAAASEKISREAERXIREAAAASEKISRE

SEQ ID NO: 55 - protein, 379 aa, Artificial Sequence
  Synthetic
  MISC_FEATURE (1)..(20): optional
  MISC_FEATURE (321)..(342): optional
  misc_feature (348)..(348): Xaa can be any naturally occurring amino acid
  misc_feature (365)..(365): Xaa can be any naturally occurring amino acid
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELRDHMVLHEYVNAAGITFNAYYADAERLXREAAAASEKISREAERXIREAAAASEKISRE

SEQ ID NO: 56 - protein, 311 aa, Artificial Sequence
  Synthetic
  MISC_FEATURE (1)..(22): optional
  MISC_FEATURE (265)..(286): optional
  misc_feature (295)..(295): Xaa can be any naturally occurring amino acid
  misc_feature (298)..(298): Xaa can be any naturally occurring amino acid
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDEIWIAQELRRIGDEFNAYYADAERLIREXAAXSEKISREAERLIR

SEQ ID NO: 57 - protein, 311 aa, Artificial Sequence
  Synthetic
  MISC_FEATURE (1)..(22): optional
  MISC_FEATURE (265)..(286): optional
  misc_feature (295)..(295): Xaa can be any naturally occurring amino acid
  misc_feature (298)..(298): Xaa can be any naturally occurring amino acid
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELRDHMVLHEYVNAAGITFNAYYADAERLIREXAAXSEKISREAERLIR

SEQ ID NO: 58 - protein, 494 aa, Artificial Sequence
  Synthetic
  MISC_FEATURE (1)..(21): optional
  MISC_FEATURE (436)..(457): optional
  misc_feature (463)..(463): Xaa can be any naturally occurring amino acid
  misc_feature (480)..(480): Xaa can be any naturally occurring amino acid
MGSHHHHHHGSGSENLYFQGSAMVDTLSGLSSEQGQSGDMTIEEDSATHIKFSKRDEDGKELAGATMELRDSSGKTISTWISDGQVKDFYLYPGKYTFVETAAPDGYEVATAITFTVNEQGQVTVNGKATKGSGGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELRDHMVLHEYVNAAGITFNAYYADAERLXREAAAASEKISREAERXIREAAAASEKISRE

SEQ ID NO: 59 - protein, 423 aa, Artificial Sequence
  Synthetic
  MISC_FEATURE (1)..(21): optional
  MISC_FEATURE (377)..(398): optional
  misc_feature (407)..(407): Xaa can be any naturally occurring amino acid
  misc_feature (410)..(410): Xaa can be any naturally occurring amino acid
MGSHHHHHHGSGSENLYFQGSAMVDTLSGLSSEQGQSGDMTIEEDSATHIKFSKRDEDGKELAGATMELRDSSGKTISTWISDGQVKDFYLYPGKYTFVETAAPDGYEVATAITFTVNEQGQVTVNGKATKGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELRDHMVLHEYVNAAGITFNAYYADAERLIREXAAXSEKISREAERLIR

SEQ ID NO: 60 - protein, 20 aa, Artificial Sequence
  Synthetic
EIWIAQELRRIGDEFNAYYA

SEQ ID NO: 61 - protein, 379 aa, Artificial Sequence
  Synthetic
  MISC_FEATURE (1)..(20): optional
  MISC_FEATURE (322)..(334): optional
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTNIQMLLEAADYLERESKRIVEDAERLIREAAAASEKISREAERSIREAAAASEKISRE

SEQ ID NO: 62 - protein, 29 aa, Artificial Sequence
  Synthetic
KMAQELIDKVRAASLQINGDAFYAILRAL

SEQ ID NO: 63 - protein, 9 aa, Artificial Sequence
  Synthetic
  MISC_FEATURE (1)..(1): optional
NWSHPQFEK

SEQ ID NO: 64 - protein, 8 aa, Artificial Sequence
  Synthetic
  MISC_FEATURE (7)..(7): X is G or S
  MISC_FEATURE (8)..(8): X is any amino acid, except P
ENLYFQXX

SEQ ID NO: 65 - protein, 377 aa, Artificial Sequence
  Synthetic
  MISC_FEATURE (1)..(20): optional
  MISC_FEATURE (329)..(341): optional
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDPDEARKNIQMLLEAADYLEEDAERLIREAAAASEKISREAERLIREAASEKISRE

SEQ ID NO: 66 - protein, 6 aa, Artificial Sequence
  Synthetic
LVPRGS

SEQ ID NO: 67 - protein, 285 aa, Artificial Sequence
  Synthetic
  MISC_FEATURE (19)..(38): optional
MDEARKAIARVKRESKRIEIWIAQELRRIGDEFNAYYAEAEKLATDELWHRLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASE

SEQ ID NO: 68 - protein, 309 aa, Artificial Sequence
  Synthetic
  MISC_FEATURE (1)..(21): optional
  MISC_FEATURE (270)..(279): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARAHIVMVDAYKKRIVEDAERLIREAAAASEKISREAERLIR

SEQ ID NO: 69 - protein, 309 aa, Artificial Sequence
  Synthetic
  MISC_FEATURE (1)..(21): optional
  MISC_FEATURE (281)..(290): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKAHIVMVDAYKREAAAASEKISREAERLIR

SEQ ID NO: 70 - protein, 309 aa, Artificial Sequence
  Synthetic
  MISC_FEATURE (1)..(21): optional
  MISC_FEATURE (270)..(277): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARENLYFQGSESKRIVEDAERLIREAAAASEKISREAERLIR

SEQ ID NO: 71 - protein, 309 aa, Artificial Sequence
  Synthetic
  MISC_FEATURE (1)..(21): optional
  MISC_FEATURE (284)..(291): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVENLYFQGSEAAAASEKISREAERLIR

SEQ ID NO: 72 - protein, 309 aa, Artificial Sequence
  Synthetic
  MISC_FEATURE (1)..(21): optional
  MISC_FEATURE (270)..(280): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARVSGWRLFKKISRIVEDAERLIREAAAASEKISREAERLIR

SEQ ID NO: 73 - protein, 309 aa, Artificial Sequence
  Synthetic
  MISC_FEATURE (1)..(21): optional
  MISC_FEATURE (281)..(291): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKVSGWRLFKKISEAAAASEKISREAERLIR

SEQ ID NO: 74 - protein, 309 aa, Artificial Sequence
  Synthetic
  MISC_FEATURE (1)..(21): optional
  MISC_FEATURE (273)..(276): optional
  MISC_FEATURE (302)..(305): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIIQIGRESKRIVEDAERLIREAAAASEKISVQLGRLIR

SEQ ID NO: 75 - protein, 309 aa, Artificial Sequence
  Synthetic
  MISC_FEATURE (1)..(21): optional
  MISC_FEATURE (284)..(287): optional
  MISC_FEATURE (291)..(294): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVIQIGRLIVQLGAASEKISREAERLIR

SEQ ID NO: 76 - protein, 309 aa, Artificial Sequence
  Synthetic
  MISC_FEATURE (1)..(21): optional
  MISC_FEATURE (284)..(287): optional
  MISC_FEATURE (302)..(305): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVIQIGRLIREAAAASEKISVQLGRLIR

SEQ ID NO: 77 - protein, 309 aa, Artificial Sequence
  Synthetic
  MISC_FEATURE (1)..(21): optional
  MISC_FEATURE (272)..(300): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDESVKELEDKVEELLSKNYHLENEVARLKKLVGERSREAERLIR

SEQ ID NO: 78 - protein, 309 aa, Artificial Sequence
  Synthetic
  MISC_FEATURE (1)..(21): optional
  MISC_FEATURE (274)..(303): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIAGEIAALKQEIAALKKENAALKWEIAALKQGAERLIR

SEQ ID NO: 79 - protein, 309 aa, Artificial Sequence
  Synthetic
  MISC_FEATURE (1)..(21): optional
  MISC_FEATURE (278)..(304): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRGLEQEIAALEKENAALEWEIAALEQGGERLIR

SEQ ID NO: 80 - protein, 309 aa, Artificial Sequence
  Synthetic
  MISC_FEATURE (1)..(21): optional
  MISC_FEATURE (278)..(304): optional
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRGLKQKIAALKYKNAALKKKIAALKQGGERLIR

SEQ ID NO: 81 - protein, 186 aa, Artificial Sequence
  Synthetic
  MISC_FEATURE (151)..(158): optional
SRVEEIIEDLRRLLEEIRKENADSIRASKELLDRVKEINDTIIAELERLLKDIEKEVREKGSESEEVKKALRRVLEELEKLLRRVAEINEEVLRRNSKLVEEDARRNAEVLKELKRLVEELMREIGDEDKVRKVAEVAEKVLRDIDKLDRWSHPQFEKTNGEISKLDEDTRRVAERVKKAIEDLAK

SEQ ID NO: 82 - protein, 179 aa, Artificial Sequence
  Synthetic
  MISC_FEATURE (35)..(42): optional
SEVDEIIADNERALDEVRREVEEIDKENAERLGEWSHPQFEKGDRLAKALEEIRKGVRSRLVDELERAIREVEEVIRRVLERVRRLIEEVSKIITDVLREVERLHEEVTKELRKVEDGNSREALDALRRLIEKVVEDSARLIKKVDEALKAVNKEIEDLSREVADLVRAVAEELDARVK

SEQ ID NO: 83 - protein, 177 aa, Artificial Sequence
  Synthetic
  MISC_FEATURE (143)..(150): optional
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEEALSKAIKDVRDIVKKVKDELKEWSHPQFEKVDRLSEELKEWLKDVERVLKELTDKDR

SEQ ID NO: 84 - protein, 178 aa, Artificial Sequence
  Synthetic
  MISC_FEATURE (140)..(147): optional
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEWSHPQFEKGDKKILKEAHKESKEVNDRDRELLERLEESVR

SEQ ID NO: 85 - protein, 178 aa, Artificial Sequence
  Synthetic
  MISC_FEATURE (35)..(42): optional
SDAEELLKRVADLLKASLESLEKILRDSKELMDRWSHPQFEKLGESEELVDRAEKILRRGGSDKEVLDKIAEEVRRTNDDSRRLDEELHRLSRDTLRKLEENLRRTEKEVREMDKRAAERGVDERVREELKKLLTRVEEEHRKVLETDKKILKEAHKESKEVNDRDRELLERLEESVR

SEQ ID NO: 86 - protein, 242 aa, Artificial Sequence
  Synthetic
  MISC_FEATURE (212)..(219): optional
SEAEDLLERVKRVLDELIEIVDRNHELNARVVETSARLVERLLEEVERALETLEREIPGRELLDKAIKDLRDVLRRVAEKVKRSIEELKEVLEESRRVLEEVVRALAEVIDRVRRLVEKGVDLRDLIRELKRVLEEAVSLIERLVRLNTRAAEKDNESLRELVRAIKEALKRAVDMVRADGLDSRLVKKLDEIVKEVAKKLEDVVRANEELWSHPQFEKGSSVARLREAVERVARDLEETAR

SEQ ID NO: 87 - protein, 235 aa, Artificial Sequence
  Synthetic
  MISC_FEATURE (24)..(31): optional
SDEERLEKVVKDVIEKVRRILEKWSHPQFEKGSELRRILEEWEKIIREVLDKVRRGSGSADALVEVLEEILRLAEELSKRVEEVLREILKLAKALSDELVKVLAEIVEAAKRISRDDELRKAVEDVARELEDLAAKDRKILDDVREALERIAKEDKDILREAEETLRRLADEMRRSGVDERLLKRVVDILARLLELNATTIERLLRILEELLKLNKELAERVIRVLEKLLEEIKR

SEQ ID NO: 88 - protein, 235 aa, Artificial Sequence
  Synthetic
  MISC_FEATURE (198)..(205): optional
SVLETVKKALEDSSEKIERIVEEDERVAKESSDRIRRLVEEDKRVADEILDLIEKGGDTDTLAKLVEEWSRTSKKLLDDVLKLHKDWSDDSRRLLEEILRVHEELIRAVKEILDRGGKPEEVVRELEKVLKESLDTLEEIIRRLDEANARTVKRVADVIRELEDANAKVLEEIERKGDDKDAVIKVIEELIRANAAVWSHPQFEKGDLVRVNKTVWKELLRVNEKLARDLERVVK

SEQ ID NO: 89 - protein, 235 aa, Artificial Sequence
  Synthetic
  MISC_FEATURE (31)..(38): optional
SLVDELRKSLERNVRVSEEVARRLKEALGRWSHPQFEKGGDLIRLNEDVVRVVEKVGVDESAIERVRRIIEELNRALDAVLKKNEDLVRRLTELLDKLLEENRRLVEELDEDLKRRGGTEEVIDTILELIERSIERLKRLLDELLRIVREALKDNARVADENLKALKEILDELRKDGVSDEELKRVLEKAADLHARLKDAHRKLLEDLERIIRELKKKLDEVVEENKRSVDELKR

SEQ ID NO: 90 - protein, 237 aa, Artificial Sequence
  Synthetic
  MISC_FEATURE (20)..(27): optional
MKDAVIKVIEELIRANAAVWSHPQFEKGDLVRVNKTVWKELLRVNEKLARDLERALDERDVSAWETVKKALEDSSEKIERIVEEDERVAKESSDRIRRLVEEDKRVADEILDLIEKGGDTDTLAKLVEEWSRTSKKLLDDVLKLHKDWSDDSRRLLEEILRVHEELIRAVKEILDRGGAPEEVVRELEKVLKESLDTLEEIIRRLDEANARTVKRVADVIRELEDANAKVLEEIERK

SEQ ID NO: 91 - protein, 175 aa, Artificial Sequence
  Synthetic
  MISC_FEATURE (26)..(33): optional
MEEAASKAIKDVRDIVKKVKDELKEWSHPQFEKVDRLSEELKEWLKDVERVLKELTDREEASEEELKRVIDELRDRDRKVRRRVERVIEESAKRDDESRKRLTRAVEKLRADLKKLSVEGASDEVLKEIEEIIRRLEAEVRRVNAEVNASTEDLAREVEEVLRATNELIEELERR

SEQ ID NO: 92 - protein, 170 aa, Artificial Sequence
  Synthetic
SEVEDVVRKVEKLVRDLIKHVEENVRRVEEVVRKLIEEIKRIAEEITRIAEELAKEPGSEDLLRKLEKVLKEIDDKLKELEDRLRDMVRRSRESSEENERRLKRVEDEVRRDHMVLHEYVNAAGITKEVEKVNRESREVTRRVLEEAKEMLERVKKIVKEVIEKVRRVVK

SEQ ID NO: 93 - protein, 171 aa, Artificial Sequence
  Synthetic
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVERDHMVLHEYVNAAGITRRRLERLVEENERVVKKILDEIRRSVEENKRIVDKVRKDLDERRK

SEQ ID NO: 94 - protein, 172 aa, Artificial Sequence
  Synthetic
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLERDHMVLHEYVNAAGITDTVRRRNEKVNEDVKRMNDKLRRDNEDVIRRVEKLLRELEEKRRT

SEQ ID NO: 95 - protein, 172 aa, Artificial Sequence
  Synthetic
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRDHMVLHEYVNAAGITERNLDDLARVLKESEDDLAEILRRLKEVLEESERDLERVEREVRK

SEQ ID NO: 96 - protein, 171 aa, Artificial Sequence
  Synthetic
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVEKARDHMVLHEYVNAAGITRLERLVEENERVVKKILDEIRRSVEENKRIVDKVRKDLDERRK

SEQ ID NO: 97 - protein, 173 aa, Artificial Sequence
  Synthetic
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRDHMVLHEYVNAAGITVDEIKRLAEESLKRLEDLSRDHKRRAKELNDEIAKVVDELAKRAT

SEQ ID NO: 98 - protein, 174 aa, Artificial Sequence
  Synthetic
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRDHMVLHEYVNAAGITADRLIDLNRRIAEEVDKIVRDSIKKVEEIVTEVEKIVEKLIRDVR

SEQ ID NO: 99 - protein, 174 aa, Artificial Sequence
  Synthetic
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVRDHMVLHEYVNAAGITRESIERSRRFIEELEKIVEETLTESEKLARASSEITKTVLDEIRK

SEQ ID NO: 100 - protein, 171 aa, Artificial Sequence
  Synthetic
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVEKAGRDHMVLHEYVNAAGITLERLVEENERVVKKILDEIRRSVEENKRIVDKVRKDLDERRK

SEQ ID NO: 101 - protein, 174 aa, Artificial Sequence
  Synthetic
SEIEELEKRIDELLKELRDLSRRIAEEVKRLLEELKKLSKDSEDKLRELLERLKRKGVPEEELRRVEEEVERVVRESRKLNKETEDELRRLLEEIKESNDRVEKRARELKKLLRDHMVLHEYVNAAGITVREDKERLKKVLKDARDLIKKDKDLNEKLSRELEKLVRELEERAR

SEQ ID NO: 102 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRDHMVLHEYVNAAGITSRDNKRRMRRVLEEAKRLAKEDKERIDKIRKEIEELIKRLKDKAT

SEQ ID NO: 103 - protein, 174 aa, Artificial Sequence
  Synthetic
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDHMVLHEYVNAAGITSRDNKELLKKIEKEIRDLIKEDKERNRELSERLRKLVEELKKKAT

SEQ ID NO: 104 - protein, 174 aa, Artificial Sequence
  Synthetic
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRDHMVLHEYVNAAGITSRENKEKIRKILEDVKKLSEDNKRRNEELSRRVKTLVDEIKKRAT

SEQ ID NO: 105 - protein, 174 aa, Artificial Sequence
  Synthetic
EELERILDKVRKVIEEVRKRLRDDLRTVEKVLKETEEVLRRAAERAKRALERVEEAARRGRDRREIKEELKKVLDDLRELLRALEEKNRRVNKENEDSLRKIEEDLRDVLRKLRDHMVLHEYVNAAGITLRTIREEVERVLRKSNELSTRIKKRIDDVLETLERLLKELDDKLR

SEQ ID NO: 106 - protein, 174 aa, Artificial Sequence
  Synthetic
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRDHMVLHEYVNAAGITAKLVDEVDKENKRALRENEERVKTLNRENEEMLKRIEEEVRRATK

SEQ ID NO: 107 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTRDHMVLHEYVNAAGITERILEEAKKKHEDVLRRLEDSLRRVAELLKAALDRLREIVDRLRR

SEQ ID NO: 108 - protein, 172 aa, Artificial Sequence
  Synthetic
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLERERDHMVLHEYVNAAGITVRRRNEKVNEDVKRMNDKLRRDNEDVIRRVEKLLRELEEKRRT

SEQ ID NO: 109 - protein, 174 aa, Artificial Sequence
  Synthetic
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIRDHMVLHEYVNAAGITAEEDAERLDRLRRESEELNERVRRVDKKLLEEIRRKAKKVEDDTR

SEQ ID NO: 110 - protein, 174 aa, Artificial Sequence
  Synthetic
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRDHMVLHEYVNAAGITSRDNKELLKKIEKEIRDLIKEDKERNIELSERLRKLVEELKKKAT

SEQ ID NO: 111 - protein, 174 aa, Artificial Sequence
  Synthetic
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRRDHMVLHEYVNAAGITRDTIRENEEIAKEVREIVERSIKNLEEVAEEVERVVRELIEARR

SEQ ID NO: 112 - protein, 174 aa, Artificial Sequence
  Synthetic
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRDHMVLHEYVNAAGITDRLIDLNRRIAEEVDKIVRDSIKKVEEIVTEVEKIVEKLIRDVR

SEQ ID NO: 113 - protein, 173 aa, Artificial Sequence
  Synthetic
SLEELLEEARKTVERLIRESERVLRESEERVRRLIEELERVVRETRKRVKEVIERVEDEEALKELEKLLREDSKRVKEVLDDLRRDLERNKRRNEKVLRELEELLKRLEELVRERDHMVLHEYVNAAGITRVKEMLKRDEDTLREIERKVKEAVRDSERTLEEIEKRVTEEKT

SEQ ID NO: 114 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRDHMVLHEYVNAAGITLRDIERVSRELNKKLEEIVRRLKKVSDELNRRIEEIAERVRRRRK

SEQ ID NO: 115 - protein, 175 aa, Artificial Sequence
  Synthetic
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDRDHMVLHEYVNAAGITMERTRRVIEEIKKELRDILEKLRRVSEELNKKLDEILKRIEDRTR

SEQ ID NO: 116 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRRDHMVLHEYVNAAGITRDNKRRMRRVLEEAKRLAKEDKERIDKIRKEIEELIKRLKDKAT

SEQ ID NO: 117 - protein, 174 aa, Artificial Sequence
  Synthetic
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRRDHMVLHEYVNAAGITRENKEKIRKILEDVKKLSEDNKRRNEELSRRVKTLVDEIKKRAT

SEQ ID NO: 118 - protein, 175 aa, Artificial Sequence
  Synthetic
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRRDHMVLHEYVNAAGITLKRIEESLRRHRKENKRLLEELDRSLRELAKIVKEVLDEIRERTR

SEQ ID NO: 119 - skipped

SEQ ID NO: 120 - protein, 175 aa, Artificial Sequence
  Synthetic
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELERDHMVLHEYVNAAGITLDEVRKALKRHKDENDKLLKEIEDSLRRHKEENDRLLEKLKESTR

SEQ ID NO: 121 - protein, 172 aa, Artificial Sequence
  Synthetic
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGRDHMVLHEYVNAAGITRRRNEKVNEDVKRMNDKLRRDNEDVIRRVEKLLRELEEKRRT

SEQ ID NO: 122 - protein, 174 aa, Artificial Sequence
  Synthetic
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKRDHMVLHEYVNAAGITEEDAERLDRLRRESEELNERVRRVDKKLLEEIRRKAKKVEDDTR

SEQ ID NO: 123 - protein, 175 aa, Artificial Sequence
  Synthetic
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELERDHMVLHEYVNAAGITLDEVRKALARHKDENDKLLKEIEDSLRRHKEENDRLLEKLKESTR

SEQ ID NO: 124 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLRDHMVLHEYVNAAGITAKRAHDENERLIREVEELVRAHNKRNKELVDEVKRLVEKVIEEER

SEQ ID NO: 125 - protein, 174 aa, Artificial Sequence
  Synthetic
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRRDHMVLHEYVNAAGITRLIDLNRRIAEEVDKIVRDSIKKVEEIVTEVEKIVEKLIRDVR

SEQ ID NO: 126 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRRDHMVLHEYVNAAGITRDIERVSRELNKKLEEIVRRLKKVSDELNRRIEEIAERVRRRRK

SEQ ID NO: 127 - protein, 174 aa, Artificial Sequence
  Synthetic
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDRDHMVLHEYVNAAGITDNKELLKKIEKEIRDLIKEDKERNRELSERLRKLVEELKKKAT

SEQ ID NO: 128 - protein, 175 aa, Artificial Sequence
  Synthetic
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRDHMVLHEYVNAAGITDEVRKALKRHKDENDKLLKEIEDSLRRHKEENDRLLEKLKESTR

SEQ ID NO: 129 - protein, 174 aa, Artificial Sequence
  Synthetic
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRRDHMVLHEYVNAAGITLVDEVDKENKRALRENEERVKTLNRENEEMLKRIEEEVRRATK

SEQ ID NO: 130 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKRDHMVLHEYVNAAGITILEEAKKKHEDVLRRLEDSLRRVAELLKAALDRLREIVDRLRR

SEQ ID NO: 131 - protein, 172 aa, Artificial Sequence
  Synthetic
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIRDHMVLHEYVNAAGITRRNEKVNEDVKRMNDKLRRDNEDVIRRVEKLLRELEEKRRT

SEQ ID NO: 132 - protein, 175 aa, Artificial Sequence
  Synthetic
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRDHMVLHEYVNAAGITDEVRKALARHKDENDKLLKEIEDSLRRHKEENDRLLEKLKESTR

SEQ ID NO: 133 - protein, 174 aa, Artificial Sequence
  Synthetic
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRRDHMVLHEYVNAAGITKNRKLAEEVLRRVKKIVEENRKIASEVLDDVRKLVEDVLARAS

SEQ ID NO: 134 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRDHMVLHEYVNAAGITKRAHDENERLIREVEELVRAHNKRNKELVDEVKRLVEKVIEEER

SEQ ID NO: 135 - protein, 174 aa, Artificial Sequence
  Synthetic
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGRDHMVLHEYVNAAGITTIRENEEIAKEVREIVERSIKNLEEVAEEVERVVRELIEARR

SEQ ID NO: 136 - protein, 174 aa, Artificial Sequence
  Synthetic
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGRDHMVLHEYVNAAGITLIDLNRRIAEEVDKIVRDSIKKVEEIVTEVEKIVEKLIRDVR

SEQ ID NO: 137 - protein, 173 aa, Artificial Sequence
  Synthetic
SLEELLEEARKTVERLIRESERVLRESEERVRRLIEELERVVRETRKRVKEVIERVEDEEALKELEKLLREDSKRVKEVLDDLRRDLERNKRRNEKVLRELEELLKRLEELVREGVRDHMVLHEYVNAAGITKEMLKRDEDTLREIERKVKEAVRDSERTLEEIEKRVTEEKT

SEQ ID NO: 138 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRERDHMVLHEYVNAAGITDIERVSRELNKKLEEIVRRLKKVSDELNRRIEEIAERVRRRRK

SEQ ID NO: 139 - protein, 177 aa, Artificial Sequence
  Synthetic
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDHMVLHEYVNAAGITIRDLNKKNDDNVRRVKEVIDRAEKLVRDLLREIRKLIEKLIRDTE

SEQ ID NO: 140 - protein, 177 aa, Artificial Sequence
  Synthetic
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDRDHMVLHEYVNAAGITIREANERNKRNLEDVERVIRELNKENERVLREVEKKIEKLIRETE

SEQ ID NO: 141 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGRDHMVLHEYVNAAGITNKRRMRRVLEEAKRLAKEDKERIDKIRKEIEELIKRLKDKAT

SEQ ID NO: 142 - protein, 174 aa, Artificial Sequence
  Synthetic
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRNGRDHMVLHEYVNAAGITNKEKIRKILEDVKKLSEDNKRRNEELSRRVKTLVDEIKKRAT

SEQ ID NO: 143 - protein, 177 aa, Artificial Sequence
  Synthetic
SEAEKVVEELKKLLREVEKKIRDHTEDVKRILEELERRLRKHSEEVRRTAKELKDKNSDDDTVRKVKEELDRSHEKLREELRKVAKELKESNEELERDLKRLVEEAEDRLRRLKDRRDHMVLHEYVNAAGITKRTLDKLLRENRETLKRIEDRLRELLEENRKLLEKIERELRERSR

SEQ ID NO: 144 - protein, 177 aa, Artificial Sequence
  Synthetic
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRDHMVLHEYVNAAGITVDDSVRVNREVLKRVEEVLEESKRVNEKVEEDVRRVHEEVRKEIK

SEQ ID NO: 145 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGRDHMVLHEYVNAAGITLEEAKKKHEDVLRRLEDSLRRVAELLKAALDRLREIVDRLRR

SEQ ID NO: 146 - protein, 174 aa, Artificial Sequence
  Synthetic
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGRDHMVLHEYVNAAGITLRRAAEAHKKLIDDARESLERAKREHEKLIDRLKKILEELER

SEQ ID NO: 147 - protein, 174 aa, Artificial Sequence
  Synthetic
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGRDHMVLHEYVNAAGITDAERLDRLRRESEELNERVRRVDKKLLEEIRRKAKKVEDDTR

SEQ ID NO: 148 - protein, 176 aa, Artificial Sequence
  Synthetic
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDRDHMVLHEYVNAAGITDEARKLNEETIRRSEELVRRIERVIEEIIKRSEKLLEDVARESK

SEQ ID NO: 149 - protein, 175 aa, Artificial Sequence
  Synthetic
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRDHMVLHEYVNAAGITEVRKALARHKDENDKLLKEIEDSLRRHKEENDRLLEKLKESTR

SEQ ID NO: 150 - protein, 174 aa, Artificial Sequence
  Synthetic
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGRDHMVLHEYVNAAGITNRKLAEEVLRRVKKIVEENRKIASEVLDDVRKLVEDVLARAS

SEQ ID NO: 151 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRRDHMVLHEYVNAAGITRAHDENERLIREVEELVRAHNKRNKELVDEVKRLVEKVIEEER

SEQ ID NO: 152 - protein, 173 aa, Artificial Sequence
  Synthetic
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKRDHMVLHEYVNAAGITKRLAEESLKRLEDLSRDHKRRAKELNDEIAKVVDELAKRAT

SEQ ID NO: 153 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLRDHMVLHEYVNAAGITVRRVKEENRKVNEEVEKRLRELEEENKKVIEDLKSTVEELVERLR

SEQ ID NO: 154 - protein, 177 aa, Artificial Sequence; identical to SEQ ID NO: 153
  Synthetic

SEQ ID NO: 155 - protein, 177 aa, Artificial Sequence
  Synthetic
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGRDHMVLHEYVNAAGITIREIEKRLEELLKRVEKLTEDAKRDLERSNREHKELADRIKETAR

SEQ ID NO: 156 - protein, 178 aa, Artificial Sequence
  Synthetic
DEVEKLLRDLEELDRDIERKVRELLKRNKEVLDDIEREVRRLEKELRRIIKEVADVIRKTTDKRTVDKLLKELEKILKEVLDRVRRLLEEAKESLDRSREEIERLLEESKTLVDEVRRDHMVLHEYVNAAGITRDLIERAKRETDRLLEEAERLMREVVDRVRKILEEAKRLIDEARR

SEQ ID NO: 157 - protein, 174 aa, Artificial Sequence
  Synthetic
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDRDHMVLHEYVNAAGITIRENEEIAKEVREIVERSIKNLEEVAEEVERVVRELIEARR

SEQ ID NO: 158 - protein, 174 aa, Artificial Sequence
  Synthetic
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGDRDHMVLHEYVNAAGITIDLNRRIAEEVDKIVRDSIKKVEEIVTEVEKIVEKLIRDVR

SEQ ID NO: 159 - protein, 170 aa, Artificial Sequence
  Synthetic
SEVEDVVRKVEKLVRDLIKHVEENVRRVEEVVRKLIEEIKRIAEEITRIAEELAKEPGSEDLLRKLEKVLKEIDDKLKELEDRLRDMVRRSRESSEENERRLKRVEDEVRRNGISEERDHMVLHEYVNAAGITRESREVTRRVLEEAKEMLERVKKIVKEVIEKVRRVVK

SEQ ID NO: 160 - protein, 178 aa, Artificial Sequence
  Synthetic
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDHMVLHEYVNAAGITIRDLRRVLKETSDRVRELIDKHRRLSEEVEKDVKRLIDELKKKTD

SEQ ID NO: 161 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESRDHMVLHEYVNAAGITIERVSRELNKKLEEIVRRLKKVSDELNRRIEEIAERVRRRRK

SEQ ID NO: 162 - protein, 175 aa, Artificial Sequence
  Synthetic
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESRDHMVLHEYVNAAGITTRRVIEEIKKELRDILEKLRRVSEELNKKLDEILKRIEDRTR

SEQ ID NO: 163 - protein, 178 aa, Artificial Sequence
  Synthetic
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRDHMVLHEYVNAAGITIEKLKEDDKRSLERIERIVRRNNELNKESVDRIRKIIKEMEERAD

SEQ ID NO: 164 - protein, 177 aa, Artificial Sequence
  Synthetic
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDRDHMVLHEYVNAAGITEDSIRKLEELARRVDELVRESIERVDRNVEENKRLVREAIERRR

SEQ ID NO: 165 - protein, 177 aa, Artificial Sequence
  Synthetic
SEAEKVVEELKKLLREVEKKIRDHTEDVKRILEELERRLRKHSEEVRRTAKELKDKNSDDDTVRKVKEELDRSHEKLREELRKVAKELKESNEELERDLKRLVEEAEDRLRRLKDRVRDHMVLHEYVNAAGITRTLDKLLRENRETLKRIEDRLRELLEENRKLLEKIERELRERSR

SEQ ID NO: 166 - protein, 174 aa, Artificial Sequence
  Synthetic
EELERILDKVRKVIEEVRKRLRDDLRTVEKVLKETEEVLRRAAERAKRALERVEEAARRGRDRREIKEELKKVLDDLRELLRALEEKNRRVNKENEDSLRKIEEDLRDVLRKLEEEIRDHMVLHEYVNAAGITREEVERVLRKSNELSTRIKKRIDDVLETLERLLKELDDKLR

SEQ ID NO: 167 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRRDHMVLHEYVNAAGITDRSEKELRTVLRDVTEDIKRIAEELKKALEDSTEIIRRAEDELRT

SEQ ID NO: 168 - protein, 177 aa, Artificial Sequence
  Synthetic
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRRDHMVLHEYVNAAGITDDSVRVNREVLKRVEEVLEESKRVNEKVEEDVRRVHEEVRKEIK

SEQ ID NO: 169 - protein, 175 aa, Artificial Sequence
  Synthetic
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRRDHMVLHEYVNAAGITIEESLRRHRKENKRLLEELDRSLRELAKIVKEVLDEIRERTR

SEQ ID NO: 170 - protein, 175 aa, Artificial Sequence
  Synthetic
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRRDHMVLHEYVNAAGITVRKALKRHKDENDKLLKEIEDSLRRHKEENDRLLEKLKESTR

SEQ ID NO: 171 - protein, 178 aa, Artificial Sequence
  Synthetic
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELRDHMVLHEYVNAAGITLRDDEETNRDVVKKVREAVKKDADTNRKVIEEVKKVLEDAARRLD

SEQ ID NO: 172 - protein, 176 aa, Artificial Sequence
  Synthetic
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTRDHMVLHEYVNAAGITSIRELERVLEELAEKIDRSLKELDDVLRKNETDLKRVIEDLKR

SEQ ID NO: 173 - protein, 174 aa, Artificial Sequence
  Synthetic
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLRDHMVLHEYVNAAGITDEVDKENKRALRENEERVKTLNRENEEMLKRIEEEVRRATK

SEQ ID NO: 174 - protein, 178 aa, Artificial Sequence
  Synthetic
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELRDHMVLHEYVNAAGITVKENAELAERVFREVEKIVRENTKLAEDSVRELKRLVEELKKRAK

SEQ ID NO: 175 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVRDHMVLHEYVNAAGITEEAKKKHEDVLRRLEDSLRRVAELLKAALDRLREIVDRLRR

SEQ ID NO: 176 - protein, 174 aa, Artificial Sequence
  Synthetic
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVRDHMVLHEYVNAAGITRRAAEAHKKLIDDARESLERAKREHEKLIDRLKKILEELER

SEQ ID NO: 177 - protein, 172 aa, Artificial Sequence
  Synthetic
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDRDHMVLHEYVNAAGITNEKVNEDVKRMNDKLRRDNEDVIRRVEKLLRELEEKRRT

SEQ ID NO: 178 - protein, 178 aa, Artificial Sequence
  Synthetic
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLARDHMVLHEYVNAAGITRRLTKELEDVLREYERELRRLEEENKRVIDKTEEEIRRLADRLRR

SEQ ID NO: 179 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRDHMVLHEYVNAAGITKELEKEAREILKRSEDETDKLREKAERILEDLERANRRTMDEARR

SEQ ID NO: 180 - protein, 175 aa, Artificial Sequence
  Synthetic
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRRDHMVLHEYVNAAGITVRKALARHKDENDKLLKEIEDSLRRHKEENDRLLEKLKESTR

SEQ ID NO: 181 - protein, 175 aa, Artificial Sequence
  Synthetic
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGRDHMVLHEYVNAAGITEERIKRIEEEIKKIIDKSREDIKRVLEEIERLNAKAADDLRK

SEQ ID NO: 182 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGRDHMVLHEYVNAAGITAHDENERLIREVEELVRAHNKRNKELVDEVKRLVEKVIEEER

SEQ ID NO: 183 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERDHMVLHEYVNAAGITRRVKEENRKVNEEVEKRLRELEEENKKVIEDLKSTVEELVERLR

SEQ ID NO: 184 - protein, 177 aa, Artificial Sequence
  Synthetic
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGIRDHMVLHEYVNAAGITREIEKRLEELLKRVEKLTEDAKRDLERSNREHKELADRIKETAR

SEQ ID NO: 185 - protein, 174 aa, Artificial Sequence
  Synthetic
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGRDHMVLHEYVNAAGITRENEEIAKEVREIVERSIKNLEEVAEEVERVVRELIEARR

SEQ ID NO: 186 - skipped

SEQ ID NO: 187 - protein, 178 aa, Artificial Sequence
  Synthetic
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRRDHMVLHEYVNAAGITRDLRRVLKETSDRVRELIDKHRRLSEEVEKDVKRLIDELKKKTD

SEQ ID NO: 188 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDRDHMVLHEYVNAAGITERVSRELNKKLEEIVRRLKKVSDELNRRIEEIAERVRRRRK

SEQ ID NO: 189 - protein, 175 aa, Artificial Sequence
  Synthetic
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDRDHMVLHEYVNAAGITRRVIEEIKKELRDILEKLRRVSEELNKKLDEILKRIEDRTR

SEQ ID NO: 190 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDRDHMVLHEYVNAAGITRRMRRVLEEAKRLAKEDKERIDKIRKEIEELIKRLKDKAT

SEQ ID NO: 191 - skipped

SEQ ID NO: 192 - protein, 178 aa, Artificial Sequence
  Synthetic
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRDHMVLHEYVNAAGITKSEEKLRRVLKESEDIAKEAEDRLKTVLERVERIADEVLKRLTK

SEQ ID NO: 193 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDRDHMVLHEYVNAAGITRSEKELRTVLRDVTEDIKRIAEELKKALEDSTEIIRRAEDELRT

SEQ ID NO: 194 - protein, 175 aa, Artificial Sequence
  Synthetic
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKRDHMVLHEYVNAAGITEESLRRHRKENKRLLEELDRSLRELAKIVKEVLDEIRERTR

SEQ ID NO: 195 - protein, 175 aa, Artificial Sequence
  Synthetic
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPRDHMVLHEYVNAAGITRKALKRHKDENDKLLKEIEDSLRRHKEENDRLLEKLKESTR

SEQ ID NO: 196 - protein, 178 aa, Artificial Sequence
  Synthetic
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDRDHMVLHEYVNAAGITRDDEETNRDVVKKVREAVKKDADTNRKVIEEVKKVLEDAARRLD

SEQ ID NO: 197 - protein, 178 aa, Artificial Sequence
  Synthetic
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKRDHMVLHEYVNAAGITRANEESERVLRELAERNKTALEEAERVLRRLKEEIEKVLRKLKK

SEQ ID NO: 198 - protein, 176 aa, Artificial Sequence
  Synthetic
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVRDHMVLHEYVNAAGITIRELERVLEELAEKIDRSLKELDDVLRKNETDLKRVIEDLKR

SEQ ID NO: 199 - protein, 174 aa, Artificial Sequence
  Synthetic
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLPRDHMVLHEYVNAAGITEVDKENKRALRENEERVKTLNRENEEMLKRIEEEVRRATK

SEQ ID NO: 200 - skipped

SEQ ID NO: 201 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRRDHMVLHEYVNAAGITLEDVEREVKKSIEEVKEINRRLNEEVKKTIEEVKEIVKEVTERAK

SEQ ID NO: 202 - protein, 178 aa, Artificial Sequence
  Synthetic
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLARRDHMVLHEYVNAAGITRLTKELEDVLREYERELRRLEEENKRVIDKTEEEIRRLADRLRR

SEQ ID NO: 203 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGRDHMVLHEYVNAAGITEEKIREVIKEWERVHREVEELLKRLIDENRKVLDEIRKLLEEKSK

SEQ ID NO: 204 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRRDHMVLHEYVNAAGITELEKEAREILKRSEDETDKLREKAERILEDLERANRRTMDEARR

SEQ ID NO: 205 - protein, 175 aa, Artificial Sequence
  Synthetic
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPRDHMVLHEYVNAAGITRKALARHKDENDKLLKEIEDSLRRHKEENDRLLEKLKESTR

SEQ ID NO: 206 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERRDHMVLHEYVNAAGITRVKEENRKVNEEVEKRLRELEEENKKVIEDLKSTVEELVERLR

SEQ ID NO: 207 - protein, 177 aa, Artificial Sequence
  Synthetic
ELREDVERVVDEIRRLVEENVRRIDEVAKDIKRLADDNVRRVKELVRKIEEDIRRLKEEGVTEVVDELREEVRKLSEDNRRHSRELIERVKKLLKELEEHSRDLKRRVKELLEDLKRKGRDHMVLHEYVNAAGITERKSRDALRRLEEAIRRVRRESERVNRELDEVIKRVTEELKK

SEQ ID NO: 208 - protein, 174 aa, Artificial Sequence
  Synthetic
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVREKVDSRDHMVLHEYVNAAGITSRRFIEELEKIVEETLTESEKLARASSEITKTVLDEIRK

SEQ ID NO: 209 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKRDHMVLHEYVNAAGITRVSRELNKKLEEIVRRLKKVSDELNRRIEEIAERVRRRRK

SEQ ID NO: 210 - protein, 175 aa, Artificial Sequence
  Synthetic
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDKRDHMVLHEYVNAAGITRVIEEIKKELRDILEKLRRVSEELNKKLDEILKRIEDRTR

SEQ ID NO: 211 - protein, 177 aa, Artificial Sequence
  Synthetic
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKRDHMVLHEYVNAAGITLNKKNDDNVRRVKEVIDRAEKLVRDLLREIRKLIEKLIRDTE

SEQ ID NO: 212 - protein, 179 aa, Artificial Sequence
  Synthetic
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRARDHMVLHEYVNAAGITEEIKDLARKLAKSSDDTVREDEKLVEELRKDVKRIVRKIKKDLE

SEQ ID NO: 213 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVRDHMVLHEYVNAAGITRMRRVLEEAKRLAKEDKERIDKIRKEIEELIKRLKDKAT

SEQ ID NO: 214 - protein, 174 aa, Artificial Sequence
  Synthetic
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIRDHMVLHEYVNAAGITLLKKIEKEIRDLIKEDKERNRELSERLRKLVEELKKKAT

SEQ ID NO: 215 - protein, 178 aa, Artificial Sequence
  Synthetic
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRRDHMVLHEYVNAAGITSEEKLRRVLKESEDIAKEAEDRLKTVLERVERIADEVLKRLTK

SEQ ID NO: 216 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSRDHMVLHEYVNAAGITSEKELRTVLRDVTEDIKRIAEELKKALEDSTEIIRRAEDELRT

SEQ ID NO: 217 - protein, 175 aa, Artificial Sequence
  Synthetic
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKDRDHMVLHEYVNAAGITESLRRHRKENKRLLEELDRSLRELAKIVKEVLDEIRERTR

SEQ ID NO: 218 - protein, 175 aa, Artificial Sequence
  Synthetic
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPDRDHMVLHEYVNAAGITKALKRHKDENDKLLKEIEDSLRRHKEENDRLLEKLKESTR

SEQ ID NO: 219 - protein, 178 aa, Artificial Sequence
  Synthetic
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDDRDHMVLHEYVNAAGITDDEETNRDVVKKVREAVKKDADTNRKVIEEVKKVLEDAARRLD

SEQ ID NO: 220 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVRDHMVLHEYVNAAGITEDVEREVKKSIEEVKEINRRLNEEVKKTIEEVKEIVKEVTERAK

SEQ ID NO: 221 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKRDHMVLHEYVNAAGITAKKKHEDVLRRLEDSLRRVAELLKAALDRLREIVDRLRR

SEQ ID NO: 222 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGERDHMVLHEYVNAAGITEKIREVIKEWERVHREVEELLKRLIDENRKVLDEIRKLLEEKSK

SEQ ID NO: 223 - protein, 178 aa, Artificial Sequence
  Synthetic
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDRDHMVLHEYVNAAGITENKERLKELLRELKKLSDENKERIKKLLSDAEKIIEDVARRAK

SEQ ID NO: 224 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGRDHMVLHEYVNAAGITLEKEAREILKRSEDETDKLREKAERILEDLERANRRTMDEARR

SEQ ID NO: 225 - protein, 180 aa, Artificial Sequence
  Synthetic
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGRDHMVLHEYVNAAGITAKRIDELDEYTRESIRRAKKEIERLNRETKKVIEEVVKRIEEERK

SEQ ID NO: 226 - protein, 178 aa, Artificial Sequence
  Synthetic
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERDHMVLHEYVNAAGITRVEEEHRKVLETDKKILKEAHKESKEVNDRDRELLERLEESVR

SEQ ID NO: 227 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDRDHMVLHEYVNAAGITDENERLIREVEELVRAHNKRNKELVDEVKRLVEKVIEEER

SEQ ID NO: 228 - protein, 180 aa, Artificial Sequence
  Synthetic
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGRDHMVLHEYVNAAGITLERLKRTIEELLKRNRDLLADAEEKARRLLEENRKLLKAARDTAT

SEQ ID NO: 229 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKRDHMVLHEYVNAAGITVKEENRKVNEEVEKRLRELEEENKKVIEDLKSTVEELVERLR

SEQ ID NO: 230 - protein, 181 aa, Artificial Sequence
  Synthetic
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVRDHMVLHEYVNAAGITEKRLRELLKELEKTSRDLKKRLEELDRELKALVEKVERDLEELRK

SEQ ID NO: 231 - protein, 177 aa, Artificial Sequence
  Synthetic
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGRDHMVLHEYVNAAGITEEVSREVEKRLRRIIRELERVSKEVLDRLREIIEKLDRDAT

SEQ ID NO: 232 - protein, 174 aa, Artificial Sequence
  Synthetic
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGRERDHMVLHEYVNAAGITNEEIAKEVREIVERSIKNLEEVAEEVERVVRELIEARR

SEQ ID NO: 233 - protein, 174 aa, Artificial Sequence
  Synthetic
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGDGRERDHMVLHEYVNAAGITNRRIAEEVDKIVRDSIKKVEEIVTEVEKIVEKLIRDVR

SEQ ID NO: 234 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRDHMVLHEYVNAAGITLRKVAEDLKRSNDEVKELAERLEETIRDLLRRIEEILKEIEERVR

SEQ ID NO: 235 - protein, 181 aa, Artificial Sequence
  Synthetic
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRDHMVLHEYVNAAGITLRRAEEVIRDLERKVRKLERDIRENIKKNHREVREILRKIEEDVR

SEQ ID NO: 236 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMRDHMVLHEYVNAAGITVSRELNKKLEEIVRRLKKVSDELNRRIEEIAERVRRRRK

SEQ ID NO: 237 - protein, 177 aa, Artificial Sequence
  Synthetic
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDRDHMVLHEYVNAAGITNKKNDDNVRRVKEVIDRAEKLVRDLLREIRKLIEKLIRDTE

SEQ ID NO: 238 - protein, 178 aa, Artificial Sequence
  Synthetic
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRSERDHMVLHEYVNAAGITLKEDDKRSLERIERIVRRNNELNKESVDRIRKIIKEMEERAD

SEQ ID NO: 239 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVERDHMVLHEYVNAAGITMRRVLEEAKRLAKEDKERIDKIRKEIEELIKRLKDKAT

SEQ ID NO: 240 - protein, 174 aa, Artificial Sequence
  Synthetic
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIERDHMVLHEYVNAAGITLKKIEKEIRDLIKEDKERNRELSERLRKLVEELKKKAT

SEQ ID NO: 241 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGRDHMVLHEYVNAAGITEKELRTVLRDVTEDIKRIAEELKKALEDSTEIIRRAEDELRT

SEQ ID NO: 242 - protein, 177 aa, Artificial Sequence
  Synthetic
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGRDHMVLHEYVNAAGITVRVNREVLKRVEEVLEESKRVNEKVEEDVRRVHEEVRKEIK

SEQ ID NO: 243 - protein, 178 aa, Artificial Sequence
  Synthetic
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDDRRDHMVLHEYVNAAGITDEETNRDVVKKVREAVKKDADTNRKVIEEVKKVLEDAARRLD

SEQ ID NO: 244 - protein, 176 aa, Artificial Sequence
  Synthetic
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDRDHMVLHEYVNAAGITELERVLEELAEKIDRSLKELDDVLRKNETDLKRVIEDLKR

SEQ ID NO: 245 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDRDHMVLHEYVNAAGITDVEREVKKSIEEVKEINRRLNEEVKKTIEEVKEIVKEVTERAK

SEQ ID NO: 246 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKERDHMVLHEYVNAAGITKKKHEDVLRRLEDSLRRVAELLKAALDRLREIVDRLRR

SEQ ID NO: 247 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGRDHMVLHEYVNAAGITEKEAREILKRSEDETDKLREKAERILEDLERANRRTMDEARR

SEQ ID NO: 248 - protein, 176 aa, Artificial Sequence
  Synthetic
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDRDHMVLHEYVNAAGITKLNEETIRRSEELVRRIERVIEEIIKRSEKLLEDVARESK

SEQ ID NO: 249 - protein, 176 aa, Artificial Sequence
  Synthetic
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEARDHMVLHEYVNAAGITEKLDELIKHSEEVLERVKRLIDELRKHSEEVLEDLRRRAK

SEQ ID NO: 250 - protein, 180 aa, Artificial Sequence
  Synthetic
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVRDHMVLHEYVNAAGITKRIDELDEYTRESIRRAKKEIERLNRETKKVIEEVVKRIEEERK

SEQ ID NO: 251 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIRDHMVLHEYVNAAGITKKAIEDSSREIKRLLEESERVMKRSSEDIKRTLDDTRRVVEEVRR

SEQ ID NO: 252 - protein, 177 aa, Artificial Sequence
  Synthetic
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEERDHMVLHEYVNAAGITKDELKEWRDRNKELVDRLSEELKEWLKDVERVLKELTDKDR

SEQ ID NO: 253 - protein, 178 aa, Artificial Sequence
  Synthetic
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERRDHMVLHEYVNAAGITVEEEHRKVLETDKKILKEAHKESKEVNDRDRELLERLEESVR

SEQ ID NO: 254 - protein, 181 aa, Artificial Sequence
  Synthetic
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGRDHMVLHEYVNAAGITVEKIKKDLKELLERYEEIVRRIKELLKDLNREAEEVVRRLKEELR

SEQ ID NO: 255 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDARDHMVLHEYVNAAGITENERLIREVEELVRAHNKRNKELVDEVKRLVEKVIEEER

SEQ ID NO: 256 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGRDHMVLHEYVNAAGITKEENRKVNEEVEKRLRELEEENKKVIEDLKSTVEELVERLR

SEQ ID NO: 257 - protein, 180 aa, Artificial Sequence
  Synthetic
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDRDHMVLHEYVNAAGITEKLDRLNRENEKSSEELKRELDKINDENRETSERLKREIDETTR

SEQ ID NO: 258 - protein, 182 aa, Artificial Sequence
  Synthetic
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRRDHMVLHEYVNAAGITIKTAKKIIEDVLRASEDTIRRLEEIIRKVEEDSKRIIEEIERAAR

SEQ ID NO: 259 - protein, 179 aa, Artificial Sequence
  Synthetic
STREDARRLVERVRKEVKRLLKKNSDLLREVTERVKTLNERNRRLLEEVEREAKRLKDSDERDVERLLDRARKLVKESEDLIRKLLKDLRELVRRSEKDIDELRKELKRLLDELRARATDKRDHMVLHEYVNAAGITIRELEENVKTSEKLIEDLIRELEKSVDESRKRVEELVKELRT

SEQ ID NO: 260 - protein, 174 aa, Artificial Sequence
  Synthetic
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVREKVDSRLRDHMVLHEYVNAAGITRFIEELEKIVEETLTESEKLARASSEITKTVLDEIRK

SEQ ID NO: 261 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDHMVLHEYVNAAGITRKVAEDLKRSNDEVKELAERLEETIRDLLRRIEEILKEIEERVR

SEQ ID NO: 262 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMERDHMVLHEYVNAAGITSRELNKKLEEIVRRLKKVSDELNRRIEEIAERVRRRRK

SEQ ID NO: 263 - protein, 177 aa, Artificial Sequence
  Synthetic
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDDEEERDHMVLHEYVNAAGITRKLEELARRVDELVRESIERVDRNVEENKRLVREAIERRR

SEQ ID NO: 264 - protein, 179 aa, Artificial Sequence
  Synthetic
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKRDHMVLHEYVNAAGITIKDLARKLAKSSDDTVREDEKLVEELRKDVKRIVRKIKKDLE

SEQ ID NO: 265 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVETRDHMVLHEYVNAAGITRRVLEEAKRLAKEDKERIDKIRKEIEELIKRLKDKAT

SEQ ID NO: 266 - protein, 182 aa, Artificial Sequence
  Synthetic
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRRDHMVLHEYVNAAGITVEESRESVRRVLEKNRRVVEESKRLAEELLRRVKKVVDEIRKRVE

SEQ ID NO: 267 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVRDHMVLHEYVNAAGITKELRTVLRDVTEDIKRIAEELKKALEDSTEIIRRAEDELRT

SEQ ID NO: 268 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERDHMVLHEYVNAAGITLEENKRVMEKTEEVAKKSSEDIKRVADETRRRAEELLKEVDELRK

SEQ ID NO: 269 - protein, 179 aa, Artificial Sequence
  Synthetic
KDEETLKRLLEKAKEVVDRLKDENEKVTRDNHESVKKAKDANKRSNEKSERVARDAIRRVREAKEVVDTAEKLLRDNHEHSRDTVKKARELNETSRRHSERIVEKIEEILEEVERTLRENRRDHMVLHEYVNAAGITLEELSRENREAVKRISDEIKRLSDENAKDSERIIKEIDDRVR

SEQ ID NO: 270 - protein, 179 aa, Artificial Sequence
  Synthetic
REDERLEEIARKIKKVVDELVERNKKLTEDNHESVRRAEKRNRELSRELEEVAKRAIERIRSDKKVVDEVKKLLEDAKKHSKEVIDELRRLNEESKRSSEDTIRRMRKLLRELEETVKAKKRDHMVLHEYVNAAGITLEDLSRRNEEKVRRISEEIKKLSKDNERTIKEIIKEIEERVK

SEQ ID NO: 271 - protein, 178 aa, Artificial Sequence
  Synthetic
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKRDHMVLHEYVNAAGITEESERVLRELAERNKTALEEAERVLRRLKEEIEKVLRKLKK

SEQ ID NO: 272 - protein, 176 aa, Artificial Sequence
  Synthetic
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKRDHMVLHEYVNAAGITLERVLEELAEKIDRSLKELDDVLRKNETDLKRVIEDLKR

SEQ ID NO: 273 - protein, 182 aa, Artificial Sequence
  Synthetic
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLRRDHMVLHEYVNAAGITRRLLREIEEVSERHKREVDRLEREIEEVSREHKERVEKLLREIER

SEQ ID NO: 274 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDARDHMVLHEYVNAAGITVEREVKKSIEEVKEINRRLNEEVKKTIEEVKEIVKEVTERAK

SEQ ID NO: 275 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKRDHMVLHEYVNAAGITKKHEDVLRRLEDSLRRVAELLKAALDRLREIVDRLRR

SEQ ID NO: 276 - protein, 174 aa, Artificial Sequence; identical to SEQ ID NO: 275
  Synthetic

SEQ ID NO: 277 - protein, 181 aa, Artificial Sequence
  Synthetic
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRRDHMVLHEYVNAAGITEISREVKKDLERTVRENKKIVDEVAKALEDTVDKNRRIVEEVTT

SEQ ID NO: 278 - protein, 172 aa, Artificial Sequence
  Synthetic
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRDHMVLHEYVNAAGITNEDVKRMNDKLRRDNEDVIRRVEKLLRELEEKRRT

SEQ ID NO: 279 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESERDHMVLHEYVNAAGITIREVIKEWERVHREVEELLKRLIDENRKVLDEIRKLLEEKSK

SEQ ID NO: 280 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDRDHMVLHEYVNAAGITKAIEDSSREIKRLLEESERVMKRSSEDIKRTLDDTRRVVEEVRR

SEQ ID NO: 281 - protein, 175 aa, Artificial Sequence
  Synthetic
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSERDHMVLHEYVNAAGITLARHKDENDKLLKEIEDSLRRHKEENDRLLEKLKESTR

SEQ ID NO: 282 - protein, 181 aa, Artificial Sequence
  Synthetic
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLRDHMVLHEYVNAAGITEKIKKDLKELLERYEEIVRRIKELLKDLNREAEEVVRRLKEELR

SEQ ID NO: 283 - protein, 175 aa, Artificial Sequence
  Synthetic
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADRDHMVLHEYVNAAGITNERLIREVEELVRAHNKRNKELVDEVKRLVEKVIEEER

SEQ ID NO: 284 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVRDHMVLHEYVNAAGITEENRKVNEEVEKRLRELEEENKKVIEDLKSTVEELVERLR

SEQ ID NO: 285 - protein, 177 aa, Artificial Sequence; identical to SEQ ID NO: 284
  Synthetic

SEQ ID NO: 286 - protein, 182 aa, Artificial Sequence
  Synthetic
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRDHMVLHEYVNAAGITKTAKKIIEDVLRASEDTIRRLEEIIRKVEEDSKRIIEEIERAAR

SEQ ID NO: 287 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDHMVLHEYVNAAGITLERLKEEADRVRERSKKILTDLKKSSEDVKRESERMLKKLEDEIR

SEQ ID NO: 288 - protein, 174 aa, Artificial Sequence
  Synthetic
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGREEVRDHMVLHEYVNAAGITEIAKEVREIVERSIKNLEEVAEEVERVVRELIEARR

SEQ ID NO: 289 - protein, 178 aa, Artificial Sequence
  Synthetic
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDDEARDHMVLHEYVNAAGITRVLKETSDRVRELIDKHRRLSEEVEKDVKRLIDELKKKTD

SEQ ID NO: 290 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMEERDHMVLHEYVNAAGITRELNKKLEEIVRRLKKVSDELNRRIEEIAERVRRRRK

SEQ ID NO: 291 - protein, 178 aa, Artificial Sequence
  Synthetic
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRSEEERDHMVLHEYVNAAGITEDDKRSLERIERIVRRNNELNKESVDRIRKIIKEMEERAD

SEQ ID NO: 292 - protein, 179 aa, Artificial Sequence
  Synthetic
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGRDHMVLHEYVNAAGITKDLARKLAKSSDDTVREDEKLVEELRKDVKRIVRKIKKDLE

SEQ ID NO: 293 - protein, 183 aa, Artificial Sequence
  Synthetic
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKRDHMVLHEYVNAAGITERSLRENEKVADELRKRAEKSLEDVKRVVDELRKIVDDVLKRVED

SEQ ID NO: 294 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKRDHMVLHEYVNAAGITKRSLDESEKLNRESRKRVTRSLEKVDDLVRELEKLARKVLEEVKT

SEQ ID NO: 295 - protein, 174 aa, Artificial Sequence
  Synthetic
SEIEELEKRIDELLKELRDLSRRIAEEVKRLLEELKKLSKDSEDKLRELLERLKRKGVPEEELRRVEEEVERVVRESRKLNKETEDELRRLLEEIKESNDRVEKRARELKKLLRDGKDVEEVRDHMVLHEYVNAAGITKVLKDARDLIKKDKDLNEKLSRELEKLVRELEERAR

SEQ ID NO: 296 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVETVRDHMVLHEYVNAAGITRVLEEAKRLAKEDKERIDKIRKEIEELIKRLKDKAT

SEQ ID NO: 297 - protein, 174 aa, Artificial Sequence
  Synthetic
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIETLRDHMVLHEYVNAAGITKIEKEIRDLIKEDKERNRELSERLRKLVEELKKKAT

SEQ ID NO: 298 - protein, 177 aa, Artificial Sequence
  Synthetic
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGVDRDHMVLHEYVNAAGITVNREVLKRVEEVLEESKRVNEKVEEDVRRVHEEVRKEIK

SEQ ID NO: 299 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRDHMVLHEYVNAAGITEENKRVMEKTEEVAKKSSEDIKRVADETRRRAEELLKEVDELRK

SEQ ID NO: 300 - protein, 175 aa, Artificial Sequence
  Synthetic
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPDVRERDHMVLHEYVNAAGITKRHKDENDKLLKEIEDSLRRHKEENDRLLEKLKESTR

SEQ ID NO: 301 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKRDHMVLHEYVNAAGITEKVIDELLKKTDEVLKRARETIEDLNRKLDKVLKEVRDKLDRLRD

SEQ ID NO: 302 - protein, 179 aa, Artificial Sequence
  Synthetic
KDEETLKRLLEKAKEVVDRLKDENEKVTRDNHESVKKAKDANKRSNEKSERVARDAIRRVREAKEVVDTAEKLLRDNHEHSRDTVKKARELNETSRRHSERIVEKIEEILEEVERTLRENRGRDHMVLHEYVNAAGITEELSRENREAVKRISDEIKRLSDENAKDSERIIKEIDDRVR

SEQ ID NO: 303 - protein, 179 aa, Artificial Sequence
  Synthetic
SDDETVTKLLKEAEKVVRELTKRNKELLRKNHESVREAKKRNEDLSRKLEEVVRRLIEEIREREDVVRELEKLLEDAKRHSERIVREMEDLNRKSKKHSKETVDRLKDLLRKVEETARARKGRDHMVLHEYVNAAGITEELTRRNEKRIEEISDEIRRLSDTNRREIERIREELRRRAK

SEQ ID NO: 304 - protein, 176 aa, Artificial Sequence
  Synthetic
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKDRDHMVLHEYVNAAGITERVLEELAEKIDRSLKELDDVLRKNETDLKRVIEDLKR

SEQ ID NO: 305 - protein, 182 aa, Artificial Sequence
  Synthetic
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRRDHMVLHEYVNAAGITKENREIHERVKKALDDIVKELEELHERLKRRLEEILRRIAETVR

SEQ ID NO: 306 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKRDHMVLHEYVNAAGITEREVKKSIEEVKEINRRLNEEVKKTIEEVKEIVKEVTERAK

SEQ ID NO: 307 - protein, 183 aa, Artificial Sequence
  Synthetic
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRDHMVLHEYVNAAGITLKEVNDTSKDAERRLRETNERLNEIVKEVEKRIRELSEEVRKRVK

SEQ ID NO: 308 - protein, 183 aa, Artificial Sequence
  Synthetic
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRDHMVLHEYVNAAGITLKEVNKVSDEAHKRNKELNERVNRVNKEAHKRNEDLLREAERKVR

SEQ ID NO: 309 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRRDHMVLHEYVNAAGITLERLKREDKEVADRAEKLLREAEEHNKRSLDESRRVLEELDEEIR

SEQ ID NO: 310 - protein, 183 aa, Artificial Sequence
  Synthetic
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDRDHMVLHEYVNAAGITLRKLEEHNRRVVERLKRLLEELKKHNEDSLRKSEEVLRKLEEDAR

SEQ ID NO: 311 - protein, 182 aa, Artificial Sequence
  Synthetic
SIEDLVRELKKKVDEVAEDLRRKVREALERSRENIDRLKKHSEENLRRSEEVVDKLRKETREEEVKDILRRVLELSKRIVEESKEILDRVLELSKKVVDDIEEIIRRVEETVKEVLTRLSRVRDHMVLHEYVNAAGITREVTKLVEKLIRELEDINRKVNERNRRLAEESRKILDEVEKRVR

SEQ ID NO: 312 - protein, 174 aa, Artificial Sequence
  Synthetic
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIRDHMVLHEYVNAAGITKHEDVLRRLEDSLRRVAELLKAALDRLREIVDRLRR

SEQ ID NO: 313 - protein, 178 aa, Artificial Sequence
  Synthetic
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDRDHMVLHEYVNAAGITKVAKEIHDHDKEVTERLEDLLRRITEHARKSDREIEETAR

SEQ ID NO: 314 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEERDHMVLHEYVNAAGITREVIKEWERVHREVEELLKRLIDENRKVLDEIRKLLEEKSK

SEQ ID NO: 315 - protein, 176 aa, Artificial Sequence
  Synthetic
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRDHMVLHEYVNAAGITNEETIRRSEELVRRIERVIEEIIKRSEKLLEDVARESK

SEQ ID NO: 316 - protein, 180 aa, Artificial Sequence
  Synthetic
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSRDHMVLHEYVNAAGITIDELDEYTRESIRRAKKEIERLNRETKKVIEEVVKRIEEERK

SEQ ID NO: 317 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSRDHMVLHEYVNAAGITAIEDSSREIKRLLEESERVMKRSSEDIKRTLDDTRRVVEEVRR

SEQ ID NO: 318 - protein, 181 aa, Artificial Sequence
  Synthetic
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDRDHMVLHEYVNAAGITKIKKDLKELLERYEEIVRRIKELLKDLNREAEEVVRRLKEELR

SEQ ID NO: 319 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSRDHMVLHEYVNAAGITKRTIDRLLETSDRSLEKVEADLRRLNEELDRSLERAERTIRELAK

SEQ ID NO: 320 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDRDHMVLHEYVNAAGITENRKVNEEVEKRLRELEEENKKVIEDLKSTVEELVERLR

SEQ ID NO: 321 - protein, 177 aa, Artificial Sequence; identical to SEQ ID NO: 320
  Synthetic

SEQ ID NO: 322 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRRDHMVLHEYVNAAGITERLKEEADRVRERSKKILTDLKKSSEDVKRESERMLKKLEDEIR

SEQ ID NO: 323 - protein, 184 aa, Artificial Sequence
  Synthetic
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDHMVLHEYVNAAGITVKRLRELIEKLREEVEKIVDENRKTVEELRRRNEEIVRRLRREIE

SEQ ID NO: 324 - protein, 184 aa, Artificial Sequence
  Synthetic
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGRDHMVLHEYVNAAGITIRELREIVKRNTEIAREVVERAKRIVEKNEKLLKDVVEEAKKIVK

SEQ ID NO: 325 - protein, 181 aa, Artificial Sequence
  Synthetic
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGRDHMVLHEYVNAAGITLRELLKELEKTSRDLKKRLEELDRELKALVEKVERDLEELRK

SEQ ID NO: 326 - protein, 177 aa, Artificial Sequence
  Synthetic
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGASERDHMVLHEYVNAAGITSREVEKRLRRIIRELERVSKEVLDRLREIIEKLDRDAT

SEQ ID NO: 327 - protein, 177 aa, Artificial Sequence
  Synthetic
ELREDVERVVDEIRRLVEENVRRIDEVAKDIKRLADDNVRRVKELVRKIEEDIRRLKEEGVTEVVDELREEVRKLSEDNRRHSRELIERVKKLLKELEEHSRDLKRRVKELLEDLKRKGVDERRDHMVLHEYVNAAGITRDALRRLEEAIRRVRRESERVNRELDEVIKRVTEELKK

SEQ ID NO: 328 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDRDHMVLHEYVNAAGITVAEDLKRSNDEVKELAERLEETIRDLLRRIEEILKEIEERVR

SEQ ID NO: 329 - protein, 181 aa, Artificial Sequence
  Synthetic
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRKDRDHMVLHEYVNAAGITAEEVIRDLERKVRKLERDIRENIKKNHREVREILRKIEEDVR

SEQ ID NO: 330 - protein, 175 aa, Artificial Sequence
  Synthetic
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDKTEDIRDHMVLHEYVNAAGITEIKKELRDILEKLRRVSEELNKKLDEILKRIEDRTR

SEQ ID NO: 331 - protein, 177 aa, Artificial Sequence
  Synthetic
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDAVERDHMVLHEYVNAAGITNDDNVRRVKEVIDRAEKLVRDLLREIRKLIEKLIRDTE

SEQ ID NO: 332 - protein, 177 aa, Artificial Sequence
  Synthetic
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARRDHMVLHEYVNAAGITNKRNLEDVERVIRELNKENERVLREVEKKIEKLIRETE

SEQ ID NO: 333 - protein, 179 aa, Artificial Sequence
  Synthetic
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDRDHMVLHEYVNAAGITDLARKLAKSSDDTVREDEKLVEELRKDVKRIVRKIKKDLE

SEQ ID NO: 334 - protein, 183 aa, Artificial Sequence
  Synthetic
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKDRDHMVLHEYVNAAGITRSLRENEKVADELRKRAEKSLEDVKRVVDELRKIVDDVLKRVED

SEQ ID NO: 335 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDRDHMVLHEYVNAAGITRSLDESEKLNRESRKRVTRSLEKVDDLVRELEKLARKVLEEVKT

SEQ ID NO: 336 - protein, 181 aa, Artificial Sequence
  Synthetic
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRDHMVLHEYVNAAGITNRELLKRVEDEVRRLIRKLEELNRRTEEEVKKLIKKLEDDLK

SEQ ID NO: 337 - protein, 174 aa, Artificial Sequence
  Synthetic
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIETLLRDHMVLHEYVNAAGITIEKEIRDLIKEDKERNRELSERLRKLVEELKKKAT

SEQ ID NO: 338 - protein, 178 aa, Artificial Sequence
  Synthetic
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERDHMVLHEYVNAAGITLRRVLKESEDIAKEAEDRLKTVLERVERIADEVLKRLTK

SEQ ID NO: 339 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVDERDHMVLHEYVNAAGITLRTVLRDVTEDIKRIAEELKKALEDSTEIIRRAEDELRT

SEQ ID NO: 340 - protein, 179 aa, Artificial Sequence
  Synthetic
REDERLEEIARKIKKVVDELVERNKKLTEDNHESVRRAEKRNRELSRELEEVAKRAIERIRSDKKVVDEVKKLLEDAKKHSKEVIDELRRLNEESKRSSEDTIRRMRKLLRELEETVKAKKGDRDHMVLHEYVNAAGITDLSRRNEEKVRRISEEIKKLSKDNERTIKEIIKEIEERVK

SEQ ID NO: 341 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERRDHMVLHEYVNAAGITEDVNEKSERDVREINKESERVNEETEREVEDAIRKLREVLRRAKK

SEQ ID NO: 342 - protein, 176 aa, Artificial Sequence
  Synthetic
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKDVRDHMVLHEYVNAAGITRVLEELAEKIDRSLKELDDVLRKNETDLKRVIEDLKR

SEQ ID NO: 343 - protein, 174 aa, Artificial Sequence
  Synthetic
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLPKDDVERDHMVLHEYVNAAGITNKRALRENEERVKTLNRENEEMLKRIEEEVRRATK

SEQ ID NO: 344 - protein, 182 aa, Artificial Sequence
  Synthetic
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDRDHMVLHEYVNAAGITENREIHERVKKALDDIVKELEELHERLKRRLEEILRRIAETVR

SEQ ID NO: 345 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVRDHMVLHEYVNAAGITREVKKSIEEVKEINRRLNEEVKKTIEEVKEIVKEVTERAK

SEQ ID NO: 346 - protein, 183 aa, Artificial Sequence
  Synthetic
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRRDHMVLHEYVNAAGITKEVNDTSKDAERRLRETNERLNEIVKEVEKRIRELSEEVRKRVK

SEQ ID NO: 347 - protein, 183 aa, Artificial Sequence
  Synthetic
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRRDHMVLHEYVNAAGITKEVNKVSDEAHKRNKELNERVNRVNKEAHKRNEDLLREAERKVR

SEQ ID NO: 348 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGRDHMVLHEYVNAAGITERLKREDKEVADRAEKLLREAEEHNKRSLDESRRVLEELDEEIR

SEQ ID NO: 349 - protein, 183 aa, Artificial Sequence
  Synthetic
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGRDHMVLHEYVNAAGITRKLEEHNRRVVERLKRLLEELKKHNEDSLRKSEEVLRKLEEDAR

SEQ ID NO: 350 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELRDHMVLHEYVNAAGITEVIKEWERVHREVEELLKRLIDENRKVLDEIRKLLEEKSK

SEQ ID NO: 351 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERDHMVLHEYVNAAGITAREILKRSEDETDKLREKAERILEDLERANRRTMDEARR

SEQ ID NO: 352 - protein, 184 aa, Artificial Sequence
  Synthetic
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRRDHMVLHEYVNAAGITSRRNEESMRRVKEDADRVSEANKEVLDRVREEVKRLIEEVRETLR

SEQ ID NO: 353 - protein, 180 aa, Artificial Sequence
  Synthetic
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSERDHMVLHEYVNAAGITDELDEYTRESIRRAKKEIERLNRETKKVIEEVVKRIEEERK

SEQ ID NO: 354 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSERDHMVLHEYVNAAGITIEDSSREIKRLLEESERVMKRSSEDIKRTLDDTRRVVEEVRR

SEQ ID NO: 355 - protein, 181 aa, Artificial Sequence; identical to SEQ ID NO: 354
  Synthetic

SEQ ID NO: 356 - protein, 175 aa, Artificial Sequence
  Synthetic
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRDHMVLHEYVNAAGITIEEEIKKIIDKSREDIKRVLEEIERLNAKAADDLRK

SEQ ID NO: 357 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGRDHMVLHEYVNAAGITRTIDRLLETSDRSLEKVEADLRRLNEELDRSLERAERTIRELAK

SEQ ID NO: 358 - protein, 177 aa, Artificial Sequence
  Synthetic
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDERDHMVLHEYVNAAGITNRKVNEEVEKRLRELEEENKKVIEDLKSTVEELVERLR

SEQ ID NO: 359 - protein, 177 aa, Artificial Sequence
  Synthetic
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDRDHMVLHEYVNAAGITLEELLKRVEKLTEDAKRDLERSNREHKELADRIKETAR

SEQ ID NO: 360 - protein, 177 aa, Artificial Sequence; identical to SEQ ID NO: 359
  Synthetic

SEQ ID NO: 361 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDRDHMVLHEYVNAAGITRLKEEADRVRERSKKILTDLKKSSEDVKRESERMLKKLEDEIR

SEQ ID NO: 362 - protein, 184 aa, Artificial Sequence
  Synthetic
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGERDHMVLHEYVNAAGITRELREIVKRNTEIAREVVERAKRIVEKNEKLLKDVVEEAKKIVK

SEQ ID NO: 363 - protein, 181 aa, Artificial Sequence
  Synthetic
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGERDHMVLHEYVNAAGITRELLKELEKTSRDLKKRLEELDRELKALVEKVERDLEELRK

SEQ ID NO: 364 - protein, 178 aa, Artificial Sequence
  Synthetic
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDDEALRRDHMVLHEYVNAAGITLKETSDRVRELIDKHRRLSEEVEKDVKRLIDELKKKTD

SEQ ID NO: 365 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGRDHMVLHEYVNAAGITAEDLKRSNDEVKELAERLEETIRDLLRRIEEILKEIEERVR

SEQ ID NO: 366 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMEEIKRDHMVLHEYVNAAGITLNKKLEEIVRRLKKVSDELNRRIEEIAERVRRRRK

SEQ ID NO: 367 - protein, 177 aa, Artificial Sequence
  Synthetic
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDAVEDRDHMVLHEYVNAAGITDDNVRRVKEVIDRAEKLVRDLLREIRKLIEKLIRDTE

SEQ ID NO: 368 - protein, 177 aa, Artificial Sequence
  Synthetic
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARDRDHMVLHEYVNAAGITKRNLEDVERVIRELNKENERVLREVEKKIEKLIRETE

SEQ ID NO: 369 - protein, 177 aa, Artificial Sequence
  Synthetic
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDDEEEVKKRDHMVLHEYVNAAGITEELARRVDELVRESIERVDRNVEENKRLVREAIERRR

SEQ ID NO: 370 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSRDHMVLHEYVNAAGITSLDESEKLNRESRKRVTRSLEKVDDLVRELEKLARKVLEEVKT

SEQ ID NO: 371 - protein, 181 aa, Artificial Sequence
  Synthetic
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRRDHMVLHEYVNAAGITRELLKRVEDEVRRLIRKLEELNRRTEEEVKKLIKKLEDDLK

SEQ ID NO: 372 - protein, 182 aa, Artificial Sequence
  Synthetic
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGRDHMVLHEYVNAAGITSRESVRRVLEKNRRVVEESKRLAEELLRRVKKVVDEIRKRVE

SEQ ID NO: 373 - protein, 182 aa, Artificial Sequence
  Synthetic
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGRDHMVLHEYVNAAGITSRRSAKDALKRVEDRVRESDKSVRELLEENRKVVEDIKRRVD

SEQ ID NO: 374 - protein, 178 aa, Artificial Sequence
  Synthetic
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERRDHMVLHEYVNAAGITRRVLKESEDIAKEAEDRLKTVLERVERIADEVLKRLTK

SEQ ID NO: 375 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNRDHMVLHEYVNAAGITNKRVMEKTEEVAKKSSEDIKRVADETRRRAEELLKEVDELRK

SEQ ID NO: 376 - protein, 182 aa, Artificial Sequence
  Synthetic
DEVREVAERLRRLVDESRKRNEEVIKESEALVDRVRKTNEEVMKRLRELIDKLEKDIRRLKDKKTVEKIIREVLKKIDELLKRVERTNREISKENKRLLDEVRKTNEEISRRLKKLLEDIRRRNRDHMVLHEYVNAAGITNKEVLRKTEEMVKRSTETNKRLLERSKEVADRLRERIKEAAK

SEQ ID NO: 377 - protein, 175 aa, Artificial Sequence
  Synthetic
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKDVKELERDHMVLHEYVNAAGITHRKENKRLLEELDRSLRELAKIVKEVLDEIRERTR

SEQ ID NO: 378 - protein, 185 aa, Artificial Sequence
  Synthetic
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVRDHMVLHEYVNAAGITKKKVDELKRKNDEVHRRSREEVKRLLEENRKLLEDLRRMVREITQ

SEQ ID NO: 379 - protein, 185 aa, Artificial Sequence
  Synthetic
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGRDHMVLHEYVNAAGITLERSLREAEDLLRRVEEVIRTSKKESKDVLEKIERLLRDLERRTR

SEQ ID NO: 380 - protein, 182 aa, Artificial Sequence
  Synthetic
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKRDHMVLHEYVNAAGITNREIHERVKKALDDIVKELEELHERLKRRLEEILRRIAETVR

SEQ ID NO: 381 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVRDHMVLHEYVNAAGITEVKKSIEEVKEINRRLNEEVKKTIEEVKEIVKEVTERAK

SEQ ID NO: 382 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGRDHMVLHEYVNAAGITRLKREDKEVADRAEKLLREAEEHNKRSLDESRRVLEELDEEIR

SEQ ID NO: 383 - protein, 183 aa, Artificial Sequence
  Synthetic
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGRDHMVLHEYVNAAGITDLRRNNKEVVDRLKEVLERLKEHNRRSLDESRKVLRELKERIR

SEQ ID NO: 384 - protein, 180 aa, Artificial Sequence
  Synthetic
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIRDHMVLHEYVNAAGITESVKKVEEIARDIRRKVDESVKNVEKLLRDVDKKARDRKK

SEQ ID NO: 385 - protein, 185 aa, Artificial Sequence
  Synthetic
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGRDHMVLHEYVNAAGITRERLKRIVDENAKIVEDARRALEKIVKENEEILRRLKKELRELRK

SEQ ID NO: 386 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRDHMVLHEYVNAAGITVIKEWERVHREVEELLKRLIDENRKVLDEIRKLLEEKSK

SEQ ID NO: 387 - protein, 184 aa, Artificial Sequence
  Synthetic
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGRDHMVLHEYVNAAGITRRNEESMRRVKEDADRVSEANKEVLDRVREEVKRLIEEVRETLR

SEQ ID NO: 388 - protein, 176 aa, Artificial Sequence
  Synthetic
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVRDHMVLHEYVNAAGITETIRRSEELVRRIERVIEEIIKRSEKLLEDVARESK

SEQ ID NO: 389 - protein, 182 aa, Artificial Sequence
  Synthetic
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSRDHMVLHEYVNAAGITNKEVLRKTEEAVKRSTETNKRLLEASKEVADRLRERIKEAAK

SEQ ID NO: 390 - protein, 180 aa, Artificial Sequence
  Synthetic
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKRDHMVLHEYVNAAGITELDEYTRESIRRAKKEIERLNRETKKVIEEVVKRIEEERK

SEQ ID NO: 391 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEERDHMVLHEYVNAAGITEDSSREIKRLLEESERVMKRSSEDIKRTLDDTRRVVEEVRR

SEQ ID NO: 392 - protein, 183 aa, Artificial Sequence
  Synthetic
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVRDHMVLHEYVNAAGITENKRRVEDVARKSKELVEDVRRHSEEVVRRVEELVKEVEERVR

SEQ ID NO: 393 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDRDHMVLHEYVNAAGITTIDRLLETSDRSLEKVEADLRRLNEELDRSLERAERTIRELAK

SEQ ID NO: 394 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDHMVLHEYVNAAGITLDENRDRSKKVKEEIRRILEDLTRTTERVKREIAKLLKELEDTAR

SEQ ID NO: 395 - protein, 180 aa, Artificial Sequence
  Synthetic
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEARDHMVLHEYVNAAGITRSLEELRKEVERLKKEVEDSLRELKKSLEEWVKSLEEATR

SEQ ID NO: 396 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRDHMVLHEYVNAAGITHDENRRLVKEVIEEVEKLIRDNEKLAEDIEREIRRLLKELDEAAK

SEQ ID NO: 397 - protein, 182 aa, Artificial Sequence
  Synthetic
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEERDHMVLHEYVNAAGITEEARKRLEEVEEKSKKIIDDARRALDRIDKELRRVVEETRK

SEQ ID NO: 398 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDERDHMVLHEYVNAAGITLKEEADRVRERSKKILTDLKKSSEDVKRESERMLKKLEDEIR

SEQ ID NO: 399 - protein, 181 aa, Artificial Sequence
  Synthetic
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELRDHMVLHEYVNAAGITELLKELEKTSRDLKKRLEELDRELKALVEKVERDLEELRK

SEQ ID NO: 400 - protein, 177 aa, Artificial Sequence
  Synthetic
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGASEDVRDHMVLHEYVNAAGITEVEKRLRRIIRELERVSKEVLDRLREIIEKLDRDAT

SEQ ID NO: 401 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGARDHMVLHEYVNAAGITEDLKRSNDEVKELAERLEETIRDLLRRIEEILKEIEERVR

SEQ ID NO: 402 - protein, 177 aa, Artificial Sequence
  Synthetic
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARDVRDHMVLHEYVNAAGITRNLEDVERVIRELNKENERVLREVEKKIEKLIRETE

SEQ ID NO: 403 - protein, 183 aa, Artificial Sequence
  Synthetic
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKDSERDHMVLHEYVNAAGITLRENEKVADELRKRAEKSLEDVKRVVDELRKIVDDVLKRVED

SEQ ID NO: 404 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERDHMVLHEYVNAAGITLDESEKLNRESRKRVTRSLEKVDDLVRELEKLARKVLEEVKT

SEQ ID NO: 405 - protein, 177 aa, Artificial Sequence
  Synthetic
REIEELRKEIETLIRENEELNRRSKETSEELIRRLKKLNRDVEEEVRRLVKDLRDRGAPEEDVRRAEERVKKLIEDNKRHSDEVAKTDKKLNEDSERHTRRVEERLRELLDRLSRSDKDEVVRRVRDHMVLHEYVNAAGITEVNETSRRLATRDAKHTRDVLREIKRLADEIRERTR

SEQ ID NO: 406 - protein, 181 aa, Artificial Sequence
  Synthetic
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRERDHMVLHEYVNAAGITELLKRVEDEVRRLIRKLEELNRRTEEEVKKLIKKLEDDLK

SEQ ID NO: 407 - protein, 178 aa, Artificial Sequence
  Synthetic
SEIERIERENDRLNEENKKITEDIERELKRLLEENRELSRTIEEELERLLRELRKRNGGREEVLKEVEDRLRRIVEEIRRSDKRLEDIAREVKKRIRESDEELRRVSEEITRRLRKVRDEKTLRERDHMVLHEYVNAAGITKKLLDDLREVSKKNKEDLKRLLREVREVARKVKERAN

SEQ ID NO: 408 - protein, 182 aa, Artificial Sequence
  Synthetic
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGSRDHMVLHEYVNAAGITRESVRRVLEKNRRVVEESKRLAEELLRRVKKVVDEIRKRVE

SEQ ID NO: 409 - protein, 178 aa, Artificial Sequence
  Synthetic
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERARDHMVLHEYVNAAGITRVLKESEDIAKEAEDRLKTVLERVERIADEVLKRLTK

SEQ ID NO: 410 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVDEEVRDHMVLHEYVNAAGITTVLRDVTEDIKRIAEELKKALEDSTEIIRRAEDELRT

SEQ ID NO: 411 - protein, 177 aa, Artificial Sequence
  Synthetic
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGVDKRVRDHMVLHEYVNAAGITEVLKRVEEVLEESKRVNEKVEEDVRRVHEEVRKEIK

SEQ ID NO: 412 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVRDHMVLHEYVNAAGITKRVMEKTEEVAKKSSEDIKRVADETRRRAEELLKEVDELRK

SEQ ID NO: 413 - protein, 186 aa, Artificial Sequence
  Synthetic
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKRDHMVLHEYVNAAGITREVIERLKEKNKRLEDDSRRVITELRKKLKDLEDRVREEIEELRK

SEQ ID NO: 414 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKERDHMVLHEYVNAAGITIDELLKKTDEVLKRARETIEDLNRKLDKVLKEVRDKLDRLRD

SEQ ID NO: 415 - protein, 186 aa, Artificial Sequence
  Synthetic
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDHMVLHEYVNAAGITREVVRRAHETNERLVDRSRKAVEKAERTNRRLVEEIRKVAEEVRK

SEQ ID NO: 416 - protein, 178 aa, Artificial Sequence
  Synthetic
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKAREVRDHMVLHEYVNAAGITRVLRELAERNKTALEEAERVLRRLKEEIEKVLRKLKK

SEQ ID NO: 417 - protein, 185 aa, Artificial Sequence
  Synthetic
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDRDHMVLHEYVNAAGITERSLREAEDLLRRVEEVIRTSKKESKDVLEKIERLLRDLERRTR

SEQ ID NO: 418 - protein, 182 aa, Artificial Sequence
  Synthetic
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDRDHMVLHEYVNAAGITREIHERVKKALDDIVKELEELHERLKRRLEEILRRIAETVR

SEQ ID NO: 419 - protein, 186 aa, Artificial Sequence
  Synthetic
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGRDHMVLHEYVNAAGITKRALEELLKKHTRVVERVEKALDELDKELERIVREAEKELDRREK

SEQ ID NO: 420 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKRDHMVLHEYVNAAGITVKKSIEEVKEINRRLNEEVKKTIEEVKEIVKEVTERAK

SEQ ID NO: 421 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGERDHMVLHEYVNAAGITLKREDKEVADRAEKLLREAEEHNKRSLDESRRVLEELDEEIR

SEQ ID NO: 422 - protein, 183 aa, Artificial Sequence
  Synthetic
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGERDHMVLHEYVNAAGITLEEHNRRVVERLKRLLEELKKHNEDSLRKSEEVLRKLEEDAR

SEQ ID NO: 423 - protein, 183 aa, Artificial Sequence
  Synthetic
SIEDRIRELEKRLEKVLREIEEHSKKVVREAEKVLREIEENSRRNNKRLEEVLDEIRKRPVDETLVREVEEAVRRLKKHNKDSSDTARKLVEELKKELKESSDRVRKVVEELKDRLRKVLEKGGERDHMVLHEYVNAAGITLKEDNEDVVRRLKEVLKELRKHNKRSLDESEKVLRELRERIR

SEQ ID NO: 424 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERIRDHMVLHEYVNAAGITEILKRSEDETDKLREKAERILEDLERANRRTMDEARR

SEQ ID NO: 425 - protein, 176 aa, Artificial Sequence
  Synthetic
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIRDHMVLHEYVNAAGITTIRRSEELVRRIERVIEEIIKRSEKLLEDVARESK

SEQ ID NO: 426 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIRDHMVLHEYVNAAGITLRDIDKLDRESKEAFRATNEEIAKLDEDTARVAERVKKAIEDLAK

SEQ ID NO: 427 - protein, 180 aa, Artificial Sequence
  Synthetic
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLRDHMVLHEYVNAAGITLDEYTRESIRRAKKEIERLNRETKKVIEEVVKRIEEERK

SEQ ID NO: 428 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELRDHMVLHEYVNAAGITDSSREIKRLLEESERVMKRSSEDIKRTLDDTRRVVEEVRR

SEQ ID NO: 429 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSRDHMVLHEYVNAAGITEEDRKRLEESTRSVRKLLEELKRELEKSTRSVKALVDELRERVR

SEQ ID NO: 430 - protein, 183 aa, Artificial Sequence
  Synthetic
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTRDHMVLHEYVNAAGITNKRRVEDVARKSKELVEDVRRHSEEVVRRVEELVKEVEERVR

SEQ ID NO: 431 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDERDHMVLHEYVNAAGITIDRLLETSDRSLEKVEADLRRLNEELDRSLERAERTIRELAK

SEQ ID NO: 432 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRRDHMVLHEYVNAAGITDENRDRSKKVKEEIRRILEDLTRTTERVKREIAKLLKELEDTAR

SEQ ID NO: 433 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRRDHMVLHEYVNAAGITDENRRLVKEVIEEVEKLIRDNEKLAEDIEREIRRLLKELDEAAK

SEQ ID NO: 434 - protein, 182 aa, Artificial Sequence
  Synthetic
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVRDHMVLHEYVNAAGITEARKRLEEVEEKSKKIIDDARRALDRIDKELRRVVEETRK

SEQ ID NO: 435 - protein, 184 aa, Artificial Sequence
  Synthetic
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDDRDHMVLHEYVNAAGITLRELIEKLREEVEKIVDENRKTVEELRRRNEEIVRRLRREIE

SEQ ID NO: 436 - protein, 184 aa, Artificial Sequence
  Synthetic
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGEDERDHMVLHEYVNAAGITLREIVKRNTEIAREVVERAKRIVEKNEKLLKDVVEEAKKIVK

SEQ ID NO: 437 - protein, 187 aa, Artificial Sequence
  Synthetic
SEKERLKEELEKLSKEIEDILRDDKRSDDELRRRLRELLEKDRREDERLNEELKRMLEEARKRVSEDELRAIKKEIEDLNRRNEESLRAIEEKIKRLNDENRKSLEEIRRRLKRLVEEVDELRKRDRDHMVLHEYVNAAGITAEKLKRDIEDNNRKLRKVATELAKEIEDNSEKLREDAKRLSEKIK

SEQ ID NO: 438 - protein, 187 aa, Artificial Sequence
  Synthetic
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRDHMVLHEYVNAAGITIRKLAEDLKRNTEDLRRVIKELAERLEELNKRLKREIRRLKEELR

SEQ ID NO: 439 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGADRDHMVLHEYVNAAGITDLKRSNDEVKELAERLEETIRDLLRRIEEILKEIEERVR

SEQ ID NO: 440 - protein, 179 aa, Artificial Sequence
  Synthetic
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDIEDRDHMVLHEYVNAAGITRKLAKSSDDTVREDEKLVEELRKDVKRIVRKIKKDLE

SEQ ID NO: 441 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERRDHMVLHEYVNAAGITDESEKLNRESRKRVTRSLEKVDDLVRELEKLARKVLEEVKT

SEQ ID NO: 442 - protein, 182 aa, Artificial Sequence
  Synthetic
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGSDRDHMVLHEYVNAAGITESVRRVLEKNRRVVEESKRLAEELLRRVKKVVDEIRKRVE

SEQ ID NO: 443 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDRDHMVLHEYVNAAGITRVMEKTEEVAKKSSEDIKRVADETRRRAEELLKEVDELRK

SEQ ID NO: 444 - protein, 186 aa, Artificial Sequence
  Synthetic
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDRDHMVLHEYVNAAGITEVIERLKEKNKRLEDDSRRVITELRKKLKDLEDRVREEIEELRK

SEQ ID NO: 445 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEERDHMVLHEYVNAAGITDELLKKTDEVLKRARETIEDLNRKLDKVLKEVRDKLDRLRD

SEQ ID NO: 446 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKRDHMVLHEYVNAAGITNEKSERDVREINKESERVNEETEREVEDAIRKLREVLRRAKK

SEQ ID NO: 447 - protein, 179 aa, Artificial Sequence
  Synthetic
DEAEKAKRDSEKVVEDNRKMLEDSTRRAERLNEENKKELKKSTEEAEKILREIDETKRRGTDDEVVKDLIRRVEELLERSRKKLEDLTRDNERVLDESRRRLEKLIRDNERIVKDLTDRVVRVDEVRDHMVLHEYVNAAGITEVLRRNEEIIRRSIEDLERVLDRNRRELEDVIRRLKE

SEQ ID NO: 448 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKERDHMVLHEYVNAAGITKKSIEEVKEINRRLNEEVKKTIEEVKEIVKEVTERAK

SEQ ID NO: 449 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERDHMVLHEYVNAAGITKREDKEVADRAEKLLREAEEHNKRSLDESRRVLEELDEEIR

SEQ ID NO: 450 - protein, 183 aa, Artificial Sequence
  Synthetic
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGERRDHMVLHEYVNAAGITEEHNRRVVERLKRLLEELKKHNEDSLRKSEEVLRKLEEDAR

SEQ ID NO: 451 - protein, 183 aa, Artificial Sequence
  Synthetic
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGEKRDHMVLHEYVNAAGITRRNNKEVVDRLKEVLERLKEHNRRSLDESRKVLRELKERIR

SEQ ID NO: 452 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRDHMVLHEYVNAAGITILKRSEDETDKLREKAERILEDLERANRRTMDEARR

SEQ ID NO: 453 - protein, 178 aa, Artificial Sequence; identical to SEQ ID NO: 452
  Synthetic

SEQ ID NO: 454 - protein, 184 aa, Artificial Sequence
  Synthetic
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSRDHMVLHEYVNAAGITNEESMRRVKEDADRVSEANKEVLDRVREEVKRLIEEVRETLR

SEQ ID NO: 455 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGRDHMVLHEYVNAAGITRDIDKLDRESKEAFRATNEEIAKLDEDTARVAERVKKAIEDLAK

SEQ ID NO: 456 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRDHMVLHEYVNAAGITSSREIKRLLEESERVMKRSSEDIKRTLDDTRRVVEEVRR

SEQ ID NO: 457 - protein, 177 aa, Artificial Sequence
  Synthetic
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEEALSKAIRDHMVLHEYVNAAGITWRDRNKELVDRLSEELKEWLKDVERVLKELTDKDR

SEQ ID NO: 458 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDRDHMVLHEYVNAAGITEDRKRLEESTRSVRKLLEELKRELEKSTRSVKALVDELRERVR

SEQ ID NO: 459 - protein, 181 aa, Artificial Sequence
  Synthetic
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIRDHMVLHEYVNAAGITDLKELLERYEEIVRRIKELLKDLNREAEEVVRRLKEELR

SEQ ID NO: 460 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEERDHMVLHEYVNAAGITDRLLETSDRSLEKVEADLRRLNEELDRSLERAERTIRELAK

SEQ ID NO: 461 - protein, 177 aa, Artificial Sequence
  Synthetic
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLRDHMVLHEYVNAAGITLLKRVEKLTEDAKRDLERSNREHKELADRIKETAR

SEQ ID NO: 462 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRDHMVLHEYVNAAGITENRDRSKKVKEEIRRILEDLTRTTERVKREIAKLLKELEDTAR

SEQ ID NO: 463 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKRDHMVLHEYVNAAGITENRRLVKEVIEEVEKLIRDNEKLAEDIEREIRRLLKELDEAAK

SEQ ID NO: 464 - protein, 182 aa, Artificial Sequence
  Synthetic
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVKRDHMVLHEYVNAAGITARKRLEEVEEKSKKIIDDARRALDRIDKELRRVVEETRK

SEQ ID NO: 465 - protein, 182 aa, Artificial Sequence
  Synthetic
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVRDHMVLHEYVNAAGITIIEDVLRASEDTIRRLEEIIRKVEEDSKRIIEEIERAAR

SEQ ID NO: 466 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVRDHMVLHEYVNAAGITEEADRVRERSKKILTDLKKSSEDVKRESERMLKKLEDEIR

SEQ ID NO: 467 - protein, 187 aa, Artificial Sequence
  Synthetic
SEKERLKEELEKLSKEIEDILRDDKRSDDELRRRLRELLEKDRREDERLNEELKRMLEEARKRVSEDELRAIKKEIEDLNRRNEESLRAIEEKIKRLNDENRKSLEEIRRRLKRLVEEVDELRKRDNRDHMVLHEYVNAAGITEKLKRDIEDNNRKLRKVATELAKEIEDNSEKLREDAKRLSEKIK

SEQ ID NO: 468 - protein, 187 aa, Artificial Sequence
  Synthetic
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRRDHMVLHEYVNAAGITRKLAEDLKRNTEDLRRVIKELAERLEELNKRLKREIRRLKEELR

SEQ ID NO: 469 - protein, 181 aa, Artificial Sequence
  Synthetic
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRKDGATDRDHMVLHEYVNAAGITIRDLERKVRKLERDIRENIKKNHREVREILRKIEEDVR

SEQ ID NO: 470 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRDHMVLHEYVNAAGITESEKLNRESRKRVTRSLEKVDDLVRELEKLARKVLEEVKT

SEQ ID NO: 471 - protein, 181 aa, Artificial Sequence
  Synthetic
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDRDHMVLHEYVNAAGITLKRVEDEVRRLIRKLEELNRRTEEEVKKLIKKLEDDLK

SEQ ID NO: 472 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRDHMVLHEYVNAAGITELLKKTDEVLKRARETIEDLNRKLDKVLKEVRDKLDRLRD

SEQ ID NO: 473 - protein, 185 aa, Artificial Sequence
  Synthetic
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDERDHMVLHEYVNAAGITVDELKRKNDEVHRRSREEVKRLLEENRKLLEDLRRMVREITQ

SEQ ID NO: 474 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKRDHMVLHEYVNAAGITEKSERDVREINKESERVNEETEREVEDAIRKLREVLRRAKK

SEQ ID NO: 475 - protein, 186 aa, Artificial Sequence
  Synthetic
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDRDHMVLHEYVNAAGITVVREADERNKRLTKRSKEVLDEVHRANEEALKEVEEVVRRVTK

SEQ ID NO: 476 - protein, 178 aa, Artificial Sequence
  Synthetic
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKAREVADRDHMVLHEYVNAAGITLRELAERNKTALEEAERVLRRLKEEIEKVLRKLKK

SEQ ID NO: 477 - protein, 185 aa, Artificial Sequence
  Synthetic
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKERDHMVLHEYVNAAGITSLREAEDLLRRVEEVIRTSKKESKDVLEKIERLLRDLERRTR

SEQ ID NO: 478 - protein, 182 aa, Artificial Sequence
  Synthetic
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLREAGIDERDHMVLHEYVNAAGITIEEVSERHKREVDRLEREIEEVSREHKERVEKLLREIER

SEQ ID NO: 479 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKELRDHMVLHEYVNAAGITKSIEEVKEINRRLNEEVKKTIEEVKEIVKEVTERAK

SEQ ID NO: 480 - protein, 185 aa, Artificial Sequence
  Synthetic
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKRDHMVLHEYVNAAGITLKRIVDENAKIVEDARRALEKIVKENEEILRRLKKELRELRK

SEQ ID NO: 481 - protein, 184 aa, Artificial Sequence
  Synthetic
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKERDHMVLHEYVNAAGITREKNREVEKRARDSNRDLKRTNDEIAKEVRELIKKLREDLK

SEQ ID NO: 482 - protein, 178 aa, Artificial Sequence
  Synthetic
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRRDHMVLHEYVNAAGITLKRSEDETDKLREKAERILEDLERANRRTMDEARR

SEQ ID NO: 483 - protein, 182 aa, Artificial Sequence
  Synthetic
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDARDHMVLHEYVNAAGITVLRKTEEAVKRSTETNKRLLEASKEVADRLRERIKEAAK

SEQ ID NO: 484 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDRDHMVLHEYVNAAGITDIDKLDRESKEAFRATNEEIAKLDEDTARVAERVKKAIEDLAK

SEQ ID NO: 485 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDERDHMVLHEYVNAAGITDRKRLEESTRSVRKLLEELKRELEKSTRSVKALVDELRERVR

SEQ ID NO: 486 - protein, 178 aa, Artificial Sequence
  Synthetic
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRDHMVLHEYVNAAGITLNREVERVSRDTKKKSKELNEELKAVLDEVKRKAD

SEQ ID NO: 487 - protein, 183 aa, Artificial Sequence
  Synthetic
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKERDHMVLHEYVNAAGITRRVEDVARKSKELVEDVRRHSEEVVRRVEELVKEVEERVR

SEQ ID NO: 488 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEARDHMVLHEYVNAAGITRLLETSDRSLEKVEADLRRLNEELDRSLERAERTIRELAK

SEQ ID NO: 489 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRRDHMVLHEYVNAAGITNRDRSKKVKEEIRRILEDLTRTTERVKREIAKLLKELEDTAR

SEQ ID NO: 490 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKERDHMVLHEYVNAAGITNRRLVKEVIEEVEKLIRDNEKLAEDIEREIRRLLKELDEAAK

SEQ ID NO: 491 - protein, 182 aa, Artificial Sequence
  Synthetic
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVERDHMVLHEYVNAAGITIEDVLRASEDTIRRLEEIIRKVEEDSKRIIEEIERAAR

SEQ ID NO: 492 - protein, 184 aa, Artificial Sequence
  Synthetic
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDDRIRDHMVLHEYVNAAGITELIEKLREEVEKIVDENRKTVEELRRRNEEIVRRLRREIE

SEQ ID NO: 493 - protein, 179 aa, Artificial Sequence
  Synthetic
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDIEDLRRDHMVLHEYVNAAGITLAKSSDDTVREDEKLVEELRKDVKRIVRKIKKDLE

SEQ ID NO: 494 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRRDHMVLHEYVNAAGITSEKLNRESRKRVTRSLEKVDDLVRELEKLARKVLEEVKT

SEQ ID NO: 495 - protein, 181 aa, Artificial Sequence
  Synthetic
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDERDHMVLHEYVNAAGITKRVEDEVRRLIRKLEELNRRTEEEVKKLIKKLEDDLK

SEQ ID NO: 496 - protein, 186 aa, Artificial Sequence
  Synthetic
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSERDHMVLHEYVNAAGITIERLKEKNKRLEDDSRRVITELRKKLKDLEDRVREEIEELRK

SEQ ID NO: 497 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRDHMVLHEYVNAAGITLLKKTDEVLKRARETIEDLNRKLDKVLKEVRDKLDRLRD

SEQ ID NO: 498 - protein, 185 aa, Artificial Sequence
  Synthetic
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKRDHMVLHEYVNAAGITDELKRKNDEVHRRSREEVKRLLEENRKLLEDLRRMVREITQ

SEQ ID NO: 499 - protein, 186 aa, Artificial Sequence
  Synthetic
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDKRDHMVLHEYVNAAGITVRRAHETNERLVDRSRKAVEKAERTNRRLVEEIRKVAEEVRK

SEQ ID NO: 500 - protein, 186 aa, Artificial Sequence
  Synthetic
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERDHMVLHEYVNAAGITMREVDRANRELTKTSKKVLEDVDRTNRRLVKEVRDVVERARK

SEQ ID NO: 501 - protein, 186 aa, Artificial Sequence
  Synthetic
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDERDHMVLHEYVNAAGITVREADERNKRLTKRSKEVLDEVHRANEEALKEVEEVVRRVTK

SEQ ID NO: 502 - protein, 179 aa, Artificial Sequence
  Synthetic
REAEEVERKVEELNRRNRKVLDDARKESEEVVRRNREFLRRLEERVRTILRELDKRKRDGTSEEVIKRLIDRVRKILEDIRRLVDELIKRNERIVEKLTRIVEELIRRNKKLLEDIRRELVKVDEVLRRDHMVLHEYVNAAGITLRELERIHRELIKELKEVLKRLEKDAKEVIERLRT

SEQ ID NO: 503 - protein, 186 aa, Artificial Sequence
  Synthetic
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGADERDHMVLHEYVNAAGITLEELLKKHTRVVERVEKALDELDKELERIVREAEKELDRREK

SEQ ID NO: 504 - protein, 179 aa, Artificial Sequence
  Synthetic
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKELIRDHMVLHEYVNAAGITSIEEVKEINRRLNEEVKKTIEEVKEIVKEVTERAK

SEQ ID NO: 505 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERVRDHMVLHEYVNAAGITEDKEVADRAEKLLREAEEHNKRSLDESRRVLEELDEEIR

SEQ ID NO: 506 - protein, 183 aa, Artificial Sequence
  Synthetic
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGEREVRDHMVLHEYVNAAGITHNRRVVERLKRLLEELKKHNEDSLRKSEEVLRKLEEDAR

SEQ ID NO: 507 - protein, 182 aa, Artificial Sequence
  Synthetic
SIEDLVRELKKKVDEVAEDLRRKVREALERSRENIDRLKKHSEENLRRSEEVVDKLRKETREEEVKDILRRVLELSKRIVEESKEILDRVLELSKKVVDDIEEIIRRVEETVKEVLTRLSRVDDKVVKRDHMVLHEYVNAAGITVEKLIRELEDINRKVNERNRRLAEESRKILDEVEKRVR

SEQ ID NO: 508 - protein, 185 aa, Artificial Sequence
  Synthetic
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKERDHMVLHEYVNAAGITKRIVDENAKIVEDARRALEKIVKENEEILRRLKKELRELRK

SEQ ID NO: 509 - protein, 179 aa, Artificial Sequence
  Synthetic
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIERDHMVLHEYVNAAGITWERVHREVEELLKRLIDENRKVLDEIRKLLEEKSK

SEQ ID NO: 510 - protein, 184 aa, Artificial Sequence
  Synthetic
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDRDHMVLHEYVNAAGITESMRRVKEDADRVSEANKEVLDRVREEVKRLIEEVRETLR

SEQ ID NO: 511 - protein, 182 aa, Artificial Sequence
  Synthetic
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAERDHMVLHEYVNAAGITLRKTEEAVKRSTETNKRLLEASKEVADRLRERIKEAAK

SEQ ID NO: 512 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDERDHMVLHEYVNAAGITIDKLDRESKEAFRATNEEIAKLDEDTARVAERVKKAIEDLAK

SEQ ID NO: 513 - protein, 181 aa, Artificial Sequence
  Synthetic
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRRDHMVLHEYVNAAGITREIKRLLEESERVMKRSSEDIKRTLDDTRRVVEEVRR

SEQ ID NO: 514 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDRDHMVLHEYVNAAGITRKRLEESTRSVRKLLEELKRELEKSTRSVKALVDELRERVR

SEQ ID NO: 515 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKRDHMVLHEYVNAAGITLLETSDRSLEKVEADLRRLNEELDRSLERAERTIRELAK

SEQ ID NO: 516 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRERDHMVLHEYVNAAGITRDRSKKVKEEIRRILEDLTRTTERVKREIAKLLKELEDTAR

SEQ ID NO: 517 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEERDHMVLHEYVNAAGITRRLVKEVIEEVEKLIRDNEKLAEDIEREIRRLLKELDEAAK

SEQ ID NO: 518 - protein, 182 aa, Artificial Sequence
  Synthetic
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVKRKRDHMVLHEYVNAAGITKRLEEVEEKSKKIIDDARRALDRIDKELRRVVEETRK

SEQ ID NO: 519 - protein, 182 aa, Artificial Sequence
  Synthetic
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVEERDHMVLHEYVNAAGITEDVLRASEDTIRRLEEIIRKVEEDSKRIIEEIERAAR

SEQ ID NO: 520 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKRDHMVLHEYVNAAGITADRVRERSKKILTDLKKSSEDVKRESERMLKKLEDEIR

SEQ ID NO: 521 - protein, 181 aa, Artificial Sequence
  Synthetic
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELAERIRDHMVLHEYVNAAGITELEKTSRDLKKRLEELDRELKALVEKVERDLEELRK

SEQ ID NO: 522 - protein, 180 aa, Artificial Sequence
  Synthetic
STEEVLDEIRKLHKTLTEDIKRVLREIEELHRRTIEENKEVLDKIREDYKRVIDDVRTKDTPNVEKLLKDLEKSAKENEEHNERTLREDDRVLKEIRRRATELLKANEEMLRRIEEVMRAGKVDAEELLRDHMVLHEYVNAAGITLRKESKRVVDETRKLSEENLEHSERVLRKVEEDLR

SEQ ID NO: 523 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRTRDHMVLHEYVNAAGITEKLNRESRKRVTRSLEKVDDLVRELEKLARKVLEEVKT

SEQ ID NO: 524 - protein, 182 aa, Artificial Sequence
  Synthetic
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGKDAEERDHMVLHEYVNAAGITKDALKRVEDRVRESDKSVRELLEENRKVVEDIKRRVD

SEQ ID NO: 525 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKRDHMVLHEYVNAAGITEKTEEVAKKSSEDIKRVADETRRRAEELLKEVDELRK

SEQ ID NO: 526 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMRDHMVLHEYVNAAGITSERDVREINKESERVNEETEREVEDAIRKLREVLRRAKK

SEQ ID NO: 527 - protein, 186 aa, Artificial Sequence
  Synthetic
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDKERDHMVLHEYVNAAGITRRAHETNERLVDRSRKAVEKAERTNRRLVEEIRKVAEEVRK

SEQ ID NO: 528 - protein, 186 aa, Artificial Sequence
  Synthetic
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERRDHMVLHEYVNAAGITREVDRANRELTKTSKKVLEDVDRTNRRLVKEVRDVVERARK

SEQ ID NO: 529 - protein, 186 aa, Artificial Sequence
  Synthetic
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDRDHMVLHEYVNAAGITREADERNKRLTKRSKEVLDEVHRANEEALKEVEEVVRRVTK

SEQ ID NO: 530 - protein, 182 aa, Artificial Sequence
  Synthetic
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLREAGIDERVRDHMVLHEYVNAAGITEVSERHKREVDRLEREIEEVSREHKERVEKLLREIER

SEQ ID NO: 531 - protein, 182 aa, Artificial Sequence
  Synthetic
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDKAEERDHMVLHEYVNAAGITERVKKALDDIVKELEELHERLKRRLEEILRRIAETVR

SEQ ID NO: 532 - protein, 186 aa, Artificial Sequence
  Synthetic
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGADEERDHMVLHEYVNAAGITEELLKKHTRVVERVEKALDELDKELERIVREAEKELDRREK

SEQ ID NO: 533 - protein, 183 aa, Artificial Sequence
  Synthetic
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERVRRDHMVLHEYVNAAGITDKEVADRAEKLLREAEEHNKRSLDESRRVLEELDEEIR

SEQ ID NO: 534 - protein, 183 aa, Artificial Sequence
  Synthetic
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGEREVDRDHMVLHEYVNAAGITNRRVVERLKRLLEELKKHNEDSLRKSEEVLRKLEEDAR

SEQ ID NO: 535 - protein, 185 aa, Artificial Sequence
  Synthetic
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVRDHMVLHEYVNAAGITRIVDENAKIVEDARRALEKIVKENEEILRRLKKELRELRK

SEQ ID NO: 536 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDRDHMVLHEYVNAAGITDKLDRESKEAFRATNEEIAKLDEDTARVAERVKKAIEDLAK

SEQ ID NO: 537 - protein, 186 aa, Artificial Sequence
  Synthetic
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDRDHMVLHEYVNAAGITKKLDDETRRVIEDTNKKIADLDKATRDVVRKVLEEVKKLEK

SEQ ID NO: 538 - protein, 181 aa, Artificial Sequence
  Synthetic
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLRDHMVLHEYVNAAGITELLERYEEIVRRIKELLKDLNREAEEVVRRLKEELR

SEQ ID NO: 539 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETRDHMVLHEYVNAAGITDRSKKVKEEIRRILEDLTRTTERVKREIAKLLKELEDTAR

SEQ ID NO: 540 - protein, 181 aa, Artificial Sequence
  Synthetic
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELAERIERDHMVLHEYVNAAGITLEKTSRDLKKRLEELDRELKALVEKVERDLEELRK

SEQ ID NO: 541 - protein, 187 aa, Artificial Sequence
  Synthetic
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDRDHMVLHEYVNAAGITAEDLKRNTEDLRRVIKELAERLEELNKRLKREIRRLKEELR

SEQ ID NO: 542 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGADEKILRDHMVLHEYVNAAGITSNDEVKELAERLEETIRDLLRRIEEILKEIEERVR

SEQ ID NO: 543 - protein, 181 aa, Artificial Sequence
  Synthetic
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDEIARDHMVLHEYVNAAGITVEDEVRRLIRKLEELNRRTEEEVKKLIKKLEDDLK

SEQ ID NO: 544 - protein, 182 aa, Artificial Sequence
  Synthetic
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGKDAEEVRDHMVLHEYVNAAGITDALKRVEDRVRESDKSVRELLEENRKVVEDIKRRVD

SEQ ID NO: 545 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKVRDHMVLHEYVNAAGITKTEEVAKKSSEDIKRVADETRRRAEELLKEVDELRK

SEQ ID NO: 546 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRKRDHMVLHEYVNAAGITKKTDEVLKRARETIEDLNRKLDKVLKEVRDKLDRLRD

SEQ ID NO: 547 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMERDHMVLHEYVNAAGITERDVREINKESERVNEETEREVEDAIRKLREVLRRAKK

SEQ ID NO: 548 - protein, 186 aa, Artificial Sequence
  Synthetic
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDARDHMVLHEYVNAAGITEADERNKRLTKRSKEVLDEVHRANEEALKEVEEVVRRVTK

SEQ ID NO: 549 - protein, 182 aa, Artificial Sequence
  Synthetic
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDKAEELRDHMVLHEYVNAAGITRVKKALDDIVKELEELHERLKRRLEEILRRIAETVR

SEQ ID NO: 550 - protein, 183 aa, Artificial Sequence
  Synthetic
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRKEEVVKERDHMVLHEYVNAAGITKDAERRLRETNERLNEIVKEVEKRIRELSEEVRKRVK

SEQ ID NO: 551 - protein, 183 aa, Artificial Sequence
  Synthetic
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRKEEVVKTRDHMVLHEYVNAAGITDEAHKRNKELNERVNRVNKEAHKRNEDLLREAERKVR

SEQ ID NO: 552 - protein, 183 aa, Artificial Sequence
  Synthetic
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGEKELEERDHMVLHEYVNAAGITKEVVDRLKEVLERLKEHNRRSLDESRKVLRELKERIR

SEQ ID NO: 553 - protein, 185 aa, Artificial Sequence
  Synthetic
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVRDHMVLHEYVNAAGITIVDENAKIVEDARRALEKIVKENEEILRRLKKELRELRK

SEQ ID NO: 554 - protein, 188 aa, Artificial Sequence
  Synthetic
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERDHMVLHEYVNAAGITSEKSNEEVKRTVEELVRRMEESNDRVRDLVRRLVEELKRAVD

SEQ ID NO: 555 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKRDHMVLHEYVNAAGITKLDRESKEAFRATNEEIAKLDEDTARVAERVKKAIEDLAK

SEQ ID NO: 556 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKRDHMVLHEYVNAAGITETSDRSLEKVEADLRRLNEELDRSLERAERTIRELAK

SEQ ID NO: 557 - protein, 182 aa, Artificial Sequence
  Synthetic
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVEEVLRDHMVLHEYVNAAGITVLRASEDTIRRLEEIIRKVEEDSKRIIEEIERAAR

SEQ ID NO: 558 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKKVRDHMVLHEYVNAAGITRVRERSKKILTDLKKSSEDVKRESERMLKKLEDEIR

SEQ ID NO: 559 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKVRRDHMVLHEYVNAAGITTEEVAKKSSEDIKRVADETRRRAEELLKEVDELRK

SEQ ID NO: 560 - protein, 186 aa, Artificial Sequence
  Synthetic
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSEELARDHMVLHEYVNAAGITLKEKNKRLEDDSRRVITELRKKLKDLEDRVREEIEELRK

SEQ ID NO: 561 - protein, 185 aa, Artificial Sequence
  Synthetic
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKEEVVKRDHMVLHEYVNAAGITAEDLLRRVEEVIRTSKKESKDVLEKIERLLRDLERRTR

SEQ ID NO: 562 - protein, 183 aa, Artificial Sequence
  Synthetic
SIEDRIRELEKRLEKVLREIEEHSKKVVREAEKVLREIEENSRRNNKRLEEVLDEIRKRPVDETLVREVEEAVRRLKKHNKDSSDTARKLVEELKKELKESSDRVRKVVEELKDRLRKVLEKGGEEDVRKVRDHMVLHEYVNAAGITDVVRRLKEVLKELRKHNKRSLDESEKVLRELRERIR

SEQ ID NO: 563 - protein, 188 aa, Artificial Sequence
  Synthetic
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERRDHMVLHEYVNAAGITEKSNEEVKRTVEELVRRMEESNDRVRDLVRRLVEELKRAVD

SEQ ID NO: 564 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARDHMVLHEYVNAAGITLDRESKEAFRATNEEIAKLDEDTARVAERVKKAIEDLAK

SEQ ID NO: 565 - protein, 186 aa, Artificial Sequence
  Synthetic
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVRDHMVLHEYVNAAGITLDDETRRVIEDTNKKIADLDKATRDVVRKVLEEVKKLEK

SEQ ID NO: 566 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERDHMVLHEYVNAAGITSKKVKEEIRRILEDLTRTTERVKREIAKLLKELEDTAR

SEQ ID NO: 567 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEELVKRDHMVLHEYVNAAGITVKEVIEEVEKLIRDNEKLAEDIEREIRRLLKELDEAAK

SEQ ID NO: 568 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKKVERDHMVLHEYVNAAGITVRERSKKILTDLKKSSEDVKRESERMLKKLEDEIR

SEQ ID NO: 569 - protein, 186 aa, Artificial Sequence
  Synthetic
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSEELARRDHMVLHEYVNAAGITKEKNKRLEDDSRRVITELRKKLKDLEDRVREEIEELRK

SEQ ID NO: 570 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRKLERDHMVLHEYVNAAGITTDEVLKRARETIEDLNRKLDKVLKEVRDKLDRLRD

SEQ ID NO: 571 - protein, 185 aa, Artificial Sequence
  Synthetic
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKVKRDRDHMVLHEYVNAAGITRKNDEVHRRSREEVKRLLEENRKLLEDLRRMVREITQ

SEQ ID NO: 572 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMEEVRDHMVLHEYVNAAGITDVREINKESERVNEETEREVEDAIRKLREVLRRAKK

SEQ ID NO: 573 - protein, 184 aa, Artificial Sequence
  Synthetic
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVRDHMVLHEYVNAAGITRVKEDADRVSEANKEVLDRVREEVKRLIEEVRETLR

SEQ ID NO: 574 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARRDHMVLHEYVNAAGITDRESKEAFRATNEEIAKLDEDTARVAERVKKAIEDLAK

SEQ ID NO: 575 - protein, 186 aa, Artificial Sequence
  Synthetic
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTRDHMVLHEYVNAAGITDDETRRVIEDTNKKIADLDKATRDVVRKVLEEVKKLEK

SEQ ID NO: 576 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERRDHMVLHEYVNAAGITEESTRSVRKLLEELKRELEKSTRSVKALVDELRERVR

SEQ ID NO: 577 - protein, 183 aa, Artificial Sequence
  Synthetic
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDRDHMVLHEYVNAAGITSDRSLEKVEADLRRLNEELDRSLERAERTIRELAK

SEQ ID NO: 578 - protein, 187 aa, Artificial Sequence
  Synthetic
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDELRRDHMVLHEYVNAAGITLKRNTEDLRRVIKELAERLEELNKRLKREIRRLKEELR

SEQ ID NO: 579 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMEEVERDHMVLHEYVNAAGITVREINKESERVNEETEREVEDAIRKLREVLRRAKK

SEQ ID NO: 580 - protein, 186 aa, Artificial Sequence
  Synthetic
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDAKRKRDHMVLHEYVNAAGITERNKRLTKRSKEVLDEVHRANEEALKEVEEVVRRVTK

SEQ ID NO: 581 - protein, 185 aa, Artificial Sequence
  Synthetic
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKEEVVKKLRDHMVLHEYVNAAGITDLLRRVEEVIRTSKKESKDVLEKIERLLRDLERRTR

SEQ ID NO: 582 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARDHMVLHEYVNAAGITKVKEEIRRILEDLTRTTERVKREIAKLLKELEDTAR

SEQ ID NO: 583 - protein, 185 aa, Artificial Sequence; identical to SEQ ID NO: 582
  Synthetic

SEQ ID NO: 584 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEELVKRVRDHMVLHEYVNAAGITEVIEEVEKLIRDNEKLAEDIEREIRRLLKELDEAAK

SEQ ID NO: 585 - protein, 185 aa, Artificial Sequence
  Synthetic
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKVKRDARRDHMVLHEYVNAAGITNDEVHRRSREEVKRLLEENRKLLEDLRRMVREITQ

SEQ ID NO: 586 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVRDHMVLHEYVNAAGITESKEAFRATNEEIAKLDEDTARVAERVKKAIEDLAK

SEQ ID NO: 587 - protein, 186 aa, Artificial Sequence
  Synthetic
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVRDHMVLHEYVNAAGITETRRVIEDTNKKIADLDKATRDVVRKVLEEVKKLEK

SEQ ID NO: 588 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVRDHMVLHEYVNAAGITSTRSVRKLLEELKRELEKSTRSVKALVDELRERVR

SEQ ID NO: 589 - protein, 185 aa, Artificial Sequence
  Synthetic
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARRDHMVLHEYVNAAGITVKEEIRRILEDLTRTTERVKREIAKLLKELEDTAR

SEQ ID NO: 590 - protein, 187 aa, Artificial Sequence
  Synthetic
SEKETVRDELRKLVETIRKLLEEDKESDKRLADRIRELNEENKEDTERLIRELEKVLEELRKKVSEDELRKLRKRIEDLRRRDEELNKRSREKLEDLNERNKDSLRRIEDELRKLVEEAREVEKRDNDEERLRKLRDHMVLHEYVNAAGITENNKRLRKAIKELLDELRKINKELREVIKKLLDDAR

SEQ ID NO: 591 - protein, 186 aa, Artificial Sequence
  Synthetic
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERVKEAIKRDHMVLHEYVNAAGITNRELTKTSKKVLEDVDRTNRRLVKEVRDVVERARK

SEQ ID NO: 592 - protein, 186 aa, Artificial Sequence
  Synthetic
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDAKRKLDRDHMVLHEYVNAAGITNKRLTKRSKEVLDEVHRANEEALKEVEEVVRRVTK

SEQ ID NO: 593 - protein, 186 aa, Artificial Sequence
  Synthetic
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVARDHMVLHEYVNAAGITSKEAFRATNEEIAKLDEDTARVAERVKKAIEDLAK

SEQ ID NO: 594 - protein, 187 aa, Artificial Sequence
  Synthetic
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDELRELLRDHMVLHEYVNAAGITNTEDLRRVIKELAERLEELNKRLKREIRRLKEELR

SEQ ID NO: 595 - protein, 188 aa, Artificial Sequence
  Synthetic
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVRDHMVLHEYVNAAGITEVKRTVEELVRRMEESNDRVRDLVRRLVEELKRAVD

SEQ ID NO: 596 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKRDHMVLHEYVNAAGITVEVVRRVIKALKEVLERHVDATREVIERVKRVNKRLLEAVREVVT

SEQ ID NO: 597 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDRDHMVLHEYVNAAGITEVVRRVIKALKEVLERHVDATREVIERVKRVNKRLLEAVREVVT

SEQ ID NO: 598 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRDHMVLHEYVNAAGITVEELRRLHEEIKERLDDVARRSEEELRRIIKKLKEVVKEIRKKLK

SEQ ID NO: 599 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIERDHMVLHEYVNAAGITERLLRVAEEVIRRILKVNTELMRVDERSIRESLKAISEVLKVLDT

SEQ ID NO: 600 - protein, 231 aa, Artificial Sequence; identical to SEQ ID NO: 599
  Synthetic

SEQ ID NO: 601 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKERDHMVLHEYVNAAGITVDDVLRIIARILKLLRDLTRRLAEVAKAVHKLLEELLRKLKEDTR

SEQ ID NO: 602 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDERDHMVLHEYVNAAGITVVRRVIKALKEVLERHVDATREVIERVKRVNKRLLEAVREVVT

SEQ ID NO: 603 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRRDHMVLHEYVNAAGITEELRRLHEEIKERLDDVARRSEEELRRIIKKLKEVVKEIRKKLK

SEQ ID NO: 604 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEERDHMVLHEYVNAAGITRLLRVAEEVIRRILKVNTELMRVDERSIRESLKAISEVLKVLDT

SEQ ID NO: 605 - protein, 231 aa, Artificial Sequence; identical to SEQ ID NO: 604
  Synthetic

SEQ ID NO: 606 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEIRDHMVLHEYVNAAGITVRRVIKALKEVLERHVDATREVIERVKRVNKRLLEAVREVVT

SEQ ID NO: 607 - protein, 229 aa, Artificial Sequence; identical to SEQ ID NO: 606
  Synthetic

SEQ ID NO: 608 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKRDHMVLHEYVNAAGITELRRLHEEIKERLDDVARRSEEELRRIIKKLKEVVKEIRKKLK

SEQ ID NO: 609 - protein, 231 aa, Artificial Sequence; identical to SEQ ID NO: 608
  Synthetic

SEQ ID NO: 610 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKRDHMVLHEYVNAAGITLLRVAEEVIRRILKVNTELMRVDERSIRESLKAISEVLKVLDT

SEQ ID NO: 611 - protein, 231 aa, Artificial Sequence; identical to SEQ ID NO: 610
  Synthetic

SEQ ID NO: 612 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDRDHMVLHEYVNAAGITDVLRIIARILKLLRDLTRRLAEVAKAVHKLLEELLRKLKEDTR

SEQ ID NO: 613 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISRDHMVLHEYVNAAGITRRVIKALKEVLERHVDATREVIERVKRVNKRLLEAVREVVT

SEQ ID NO: 614 - protein, 229 aa, Artificial Sequence; identical to SEQ ID NO: 613
  Synthetic

SEQ ID NO: 615 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVERDHMVLHEYVNAAGITEREIRRLAKRLKELSDRLEEKIRKIKRELDDLSARLREKIERTRK

SEQ ID NO: 616 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGRDHMVLHEYVNAAGITLRRLHEEIKERLDDVARRSEEELRRIIKKLKEVVKEIRKKLK

SEQ ID NO: 617 - protein, 231 aa, Artificial Sequence; identical to SEQ ID NO: 616
  Synthetic

SEQ ID NO: 618 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIRDHMVLHEYVNAAGITLRVAEEVIRRILKVNTELMRVDERSIRESLKAISEVLKVLDT

SEQ ID NO: 619 - protein, 231 aa, Artificial Sequence; identical to SEQ ID NO: 618
  Synthetic

SEQ ID NO: 620 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDRRDHMVLHEYVNAAGITVLRIIARILKLLRDLTRRLAEVAKAVHKLLEELLRKLKEDTR

SEQ ID NO: 621 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGRDHMVLHEYVNAAGITRVIKALKEVLERHVDATREVIERVKRVNKRLLEAVREVVT

SEQ ID NO: 622 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEERDHMVLHEYVNAAGITREIRRLAKRLKELSDRLEEKIRKIKRELDDLSARLREKIERTRK

SEQ ID NO: 623 - protein, 234 aa, Artificial Sequence; identical to SEQ ID NO: 622
  Synthetic

SEQ ID NO: 624 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGRDHMVLHEYVNAAGITRRLHEEIKERLDDVARRSEEELRRIIKKLKEVVKEIRKKLK

SEQ ID NO: 625 - protein, 231 aa, Artificial Sequence; identical to SEQ ID NO: 624
  Synthetic

SEQ ID NO: 626 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDRDHMVLHEYVNAAGITRVAEEVIRRILKVNTELMRVDERSIRESLKAISEVLKVLDT

SEQ ID NO: 627 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDRERDHMVLHEYVNAAGITLRIIARILKLLRDLTRRLAEVAKAVHKLLEELLRKLKEDTR

SEQ ID NO: 628 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSRDHMVLHEYVNAAGITVIKALKEVLERHVDATREVIERVKRVNKRLLEAVREVVT

SEQ ID NO: 629 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELRDHMVLHEYVNAAGITEIRRLAKRLKELSDRLEEKIRKIKRELDDLSARLREKIERTRK

SEQ ID NO: 630 - protein, 234 aa, Artificial Sequence; identical to SEQ ID NO: 629
  Synthetic

SEQ ID NO: 631 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVRDHMVLHEYVNAAGITRLHEEIKERLDDVARRSEEELRRIIKKLKEVVKEIRKKLK

SEQ ID NO: 632 - protein, 231 aa, Artificial Sequence; identical to SEQ ID NO: 631
  Synthetic

SEQ ID NO: 633 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRDHMVLHEYVNAAGITRRIKEKLRKALEELEREHRELEKELDKLHDESRKEHERIEEELRR

SEQ ID NO: 634 - protein, 236 aa, Artificial Sequence; identical to SEQ ID NO: 633
  Synthetic

SEQ ID NO: 635 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDRDHMVLHEYVNAAGITVAEEVIRRILKVNTELMRVDERSIRESLKAISEVLKVLDT

SEQ ID NO: 636 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREERDHMVLHEYVNAAGITRIIARILKLLRDLTRRLAEVAKAVHKLLEELLRKLKEDTR

SEQ ID NO: 637 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKRDHMVLHEYVNAAGITIKALKEVLERHVDATREVIERVKRVNKRLLEAVREVVT

SEQ ID NO: 638 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGRDHMVLHEYVNAAGITIRRLAKRLKELSDRLEEKIRKIKRELDDLSARLREKIERTRK

SEQ ID NO: 639 - protein, 234 aa, Artificial Sequence; identical to SEQ ID NO: 638
  Synthetic

SEQ ID NO: 640 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPRDHMVLHEYVNAAGITLHEEIKERLDDVARRSEEELRRIIKKLKEVVKEIRKKLK

SEQ ID NO: 641 - protein, 231 aa, Artificial Sequence; identical to SEQ ID NO: 640
  Synthetic

SEQ ID NO: 642 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRRDHMVLHEYVNAAGITRIKEKLRKALEELEREHRELEKELDKLHDESRKEHERIEEELRR

SEQ ID NO: 643 - protein, 236 aa, Artificial Sequence; identical to SEQ ID NO: 642
  Synthetic

SEQ ID NO: 644 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDERDHMVLHEYVNAAGITAEEVIRRILKVNTELMRVDERSIRESLKAISEVLKVLDT

SEQ ID NO: 645 - protein, 231 aa, Artificial Sequence; identical to SEQ ID NO: 644
  Synthetic

SEQ ID NO: 646 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRDHMVLHEYVNAAGITIIARILKLLRDLTRRLAEVAKAVHKLLEELLRKLKEDTR

SEQ ID NO: 647 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIRDHMVLHEYVNAAGITREHIKALEKLARDLKEILRRHIEALKELARDLAEVIRKLLEDVKR

SEQ ID NO: 648 - protein, 237 aa, Artificial Sequence; identical to SEQ ID NO: 647
  Synthetic

SEQ ID NO: 649 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLRDHMVLHEYVNAAGITRRLAKRLKELSDRLEEKIRKIKRELDDLSARLREKIERTRK

SEQ ID NO: 650 - protein, 234 aa, Artificial Sequence; identical to SEQ ID NO: 649
  Synthetic

SEQ ID NO: 651 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTRDHMVLHEYVNAAGITEELEDRLRRLLEKLARDSAELMRELERILDRYARESEELDRRLAE

SEQ ID NO: 652 - protein, 238 aa, Artificial Sequence; identical to SEQ ID NO: 651
  Synthetic

SEQ ID NO: 653 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERDHMVLHEYVNAAGITLDRLRKLLERLREILRENLEALKKTLKRLEDVVREILEDLKRERK

SEQ ID NO: 654 - protein, 238 aa, Artificial Sequence; identical to SEQ ID NO: 653
  Synthetic

SEQ ID NO: 655 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPERDHMVLHEYVNAAGITHEEIKERLDDVARRSEEELRRIIKKLKEVVKEIRKKLK

SEQ ID NO: 656 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGRDHMVLHEYVNAAGITIKEKLRKALEELEREHRELEKELDKLHDESRKEHERIEEELRR

SEQ ID NO: 657 - protein, 236 aa, Artificial Sequence; identical to SEQ ID NO: 656
  Synthetic

SEQ ID NO: 658 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDRDHMVLHEYVNAAGITEEVIRRILKVNTELMRVDERSIRESLKAISEVLKVLDT

SEQ ID NO: 659 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRDHMVLHEYVNAAGITIARILKLLRDLTRRLAEVAKAVHKLLEELLRKLKEDTR

SEQ ID NO: 660 - protein, 238 aa, Artificial Sequence
  Synthetic
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRDHMVLHEYVNAAGITIKRIEDSLRELEKTVRELLKRIKEASDKVREDVDRLIKELKEAAD

SEQ ID NO: 661 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVRDHMVLHEYVNAAGITALKEVLERHVDATREVIERVKRVNKRLLEAVREVVT

SEQ ID NO: 662 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRDHMVLHEYVNAAGITEHIKALEKLARDLKEILRRHIEALKELARDLAEVIRKLLEDVKR

SEQ ID NO: 663 - protein, 237 aa, Artificial Sequence; identical to SEQ ID NO: 662
  Synthetic

SEQ ID NO: 664 - protein, 232 aa, Artificial Sequence
  Synthetic
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDRDHMVLHEYVNAAGITIDDLLKTSRDLVKRVLDLVDEVVKRVEDLVERVKEKIDT

SEQ ID NO: 665 - protein, 239 aa, Artificial Sequence
  Synthetic
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRDHMVLHEYVNAAGITEDLLKEDKERLEKIARDIERDLERYARDLKRLEDELREDIERARR

SEQ ID NO: 666 - protein, 239 aa, Artificial Sequence; identical to SEQ ID NO: 665
  Synthetic

SEQ ID NO: 667 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSRDHMVLHEYVNAAGITRLAKRLKELSDRLEEKIRKIKRELDDLSARLREKIERTRK

SEQ ID NO: 668 - protein, 234 aa, Artificial Sequence; identical to SEQ ID NO: 667
  Synthetic

SEQ ID NO: 669 - protein, 238 aa, Artificial Sequence
  Synthetic
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRDHMVLHEYVNAAGITELEERARKILRDDERDLRALEKRIRDIIREDREELERLKERARK

SEQ ID NO: 670 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKRDHMVLHEYVNAAGITELEDRLRRLLEKLARDSAELMRELERILDRYARESEELDRRLAE

SEQ ID NO: 671 - protein, 238 aa, Artificial Sequence; identical to SEQ ID NO: 670
  Synthetic

SEQ ID NO: 672 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERRDHMVLHEYVNAAGITDRLRKLLERLREILRENLEALKKTLKRLEDVVREILEDLKRERK

SEQ ID NO: 673 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEERDHMVLHEYVNAAGITEEIKERLDDVARRSEEELRRIIKKLKEVVKEIRKKLK

SEQ ID NO: 674 - protein, 231 aa, Artificial Sequence; identical to SEQ ID NO: 673
  Synthetic

SEQ ID NO: 675 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDRDHMVLHEYVNAAGITKEKLRKALEELEREHRELEKELDKLHDESRKEHERIEEELRR

SEQ ID NO: 676 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERDHMVLHEYVNAAGITEDILEKVERTLKKLLDDSARMAEEVKKTLKELLERSEKVAEDVRK

SEQ ID NO: 677 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRRDHMVLHEYVNAAGITARILKLLRDLTRRLAEVAKAVHKLLEELLRKLKEDTR

SEQ ID NO: 678 - protein, 238 aa, Artificial Sequence
  Synthetic
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRRDHMVLHEYVNAAGITKRIEDSLRELEKTVRELLKRIKEASDKVREDVDRLIKELKEAAD

SEQ ID NO: 679 - protein, 238 aa, Artificial Sequence; identical to SEQ ID NO: 678
  Synthetic

SEQ ID NO: 680 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDRDHMVLHEYVNAAGITKSKEILERIERAIDELLKVSEEILKLSEDASEELLKILREFAK

SEQ ID NO: 681 - protein, 229 aa, Artificial Sequence
  Synthetic
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLRDHMVLHEYVNAAGITLKEVLERHVDATREVIERVKRVNKRLLEAVREVVT

SEQ ID NO: 682 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRRDHMVLHEYVNAAGITHIKALEKLARDLKEILRRHIEALKELARDLAEVIRKLLEDVKR

SEQ ID NO: 683 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDRDHMVLHEYVNAAGITLAKRLKELSDRLEEKIRKIKRELDDLSARLREKIERTRK

SEQ ID NO: 684 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKRDHMVLHEYVNAAGITLEDRLRRLLEKLARDSAELMRELERILDRYARESEELDRRLAE

SEQ ID NO: 685 - protein, 238 aa, Artificial Sequence; identical to SEQ ID NO: 684
  Synthetic

SEQ ID NO: 686 - protein, 240 aa, Artificial Sequence
  Synthetic
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKRDHMVLHEYVNAAGITLDVVRRILEALAKLIKELLEALEEVLRRNKELIRELLRVLDEALK

SEQ ID NO: 687 - protein, 240 aa, Artificial Sequence; identical to SEQ ID NO: 686
  Synthetic

SEQ ID NO: 688 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIRDHMVLHEYVNAAGITEIKERLDDVARRSEEELRRIIKKLKEVVKEIRKKLK

SEQ ID NO: 689 - protein, 231 aa, Artificial Sequence; identical to SEQ ID NO: 688
  Synthetic

SEQ ID NO: 690 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVRDHMVLHEYVNAAGITEKLRKALEELEREHRELEKELDKLHDESRKEHERIEEELRR

SEQ ID NO: 691 - protein, 236 aa, Artificial Sequence; identical to SEQ ID NO: 690
  Synthetic

SEQ ID NO: 692 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERRDHMVLHEYVNAAGITDILEKVERTLKKLLDDSARMAEEVKKTLKELLERSEKVAEDVRK

SEQ ID NO: 693 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDERDHMVLHEYVNAAGITSKEILERIERAIDELLKVSEEILKLSEDASEELLKILREFAK

SEQ ID NO: 694 - protein, 237 aa, Artificial Sequence; identical to SEQ ID NO: 693
  Synthetic

SEQ ID NO: 695 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKRDHMVLHEYVNAAGITKRLLDNLKENTDRLKEVIDRNLADLRDLAEELRAVIERLLEDARR

SEQ ID NO: 696 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGRDHMVLHEYVNAAGITIKALEKLARDLKEILRRHIEALKELARDLAEVIRKLLEDVKR

SEQ ID NO: 697 - protein, 237 aa, Artificial Sequence; identical to SEQ ID NO: 696
  Synthetic

SEQ ID NO: 698 - protein, 237 aa, Artificial Sequence
  Synthetic
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKRDHMVLHEYVNAAGITLRDHKAKNDKILRDVEEVLRRHLEELARILKDVKKVLDEARK

SEQ ID NO: 699 - protein, 239 aa, Artificial Sequence
  Synthetic
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRDHMVLHEYVNAAGITKVLKELVEELEKLVRDHNRVVEEVVRELVELLSRAVEVIKEVVK

SEQ ID NO: 700 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGRDHMVLHEYVNAAGITRDLLRLLEEDSRTNSEVVKRLLDLLREDSKANSEVVKRLLDVLRE

SEQ ID NO: 701 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIRDHMVLHEYVNAAGITRRLIEILRRDVELNLDVAKKLLELLKEDSKLNLDVARELLELLDR

SEQ ID NO: 702 - protein, 240 aa, Artificial Sequence; identical to SEQ ID NO: 701
  Synthetic

SEQ ID NO: 703 - protein, 238 aa, Artificial Sequence
  Synthetic
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGRDHMVLHEYVNAAGITLKLVEKLIRRNLRLLEELLRLVREILRTSNEILEEILKDARR

SEQ ID NO: 704 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKRDHMVLHEYVNAAGITAKRLKELSDRLEEKIRKIKRELDDLSARLREKIERTRK

SEQ ID NO: 705 - protein, 234 aa, Artificial Sequence; identical to SEQ ID NO: 704
  Synthetic

SEQ ID NO: 706 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGRDHMVLHEYVNAAGITEDRLRRLLEKLARDSAELMRELERILDRYARESEELDRRLAE

SEQ ID NO: 707 - protein, 238 aa, Artificial Sequence; identical to SEQ ID NO: 706
  Synthetic

SEQ ID NO: 708 - protein, 240 aa, Artificial Sequence
  Synthetic
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDRDHMVLHEYVNAAGITDVVRRILEALAKLIKELLEALEEVLRRNKELIRELLRVLDEALK

SEQ ID NO: 709 - protein, 240 aa, Artificial Sequence; identical to SEQ ID NO: 708
  Synthetic

SEQ ID NO: 710 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRRDHMVLHEYVNAAGITLRKLLERLREILRENLEALKKTLKRLEDVVREILEDLKRERK

SEQ ID NO: 711 - protein, 238 aa, Artificial Sequence; identical to SEQ ID NO: 710
  Synthetic

SEQ ID NO: 712 - protein, 231 aa, Artificial Sequence
  Synthetic
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRDHMVLHEYVNAAGITIKERLDDVARRSEEELRRIIKKLKEVVKEIRKKLK

SEQ ID NO: 713 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPRDHMVLHEYVNAAGITKLRKALEELEREHRELEKELDKLHDESRKEHERIEEELRR

SEQ ID NO: 714 - protein, 236 aa, Artificial Sequence; identical to SEQ ID NO: 713
  Synthetic

SEQ ID NO: 715 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTRDHMVLHEYVNAAGITILEKVERTLKKLLDDSARMAEEVKKTLKELLERSEKVAEDVRK

SEQ ID NO: 716 - protein, 231 aa, Artificial Sequence
  Synthetic
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRRDHMVLHEYVNAAGITIRRILKVNTELMRVDERSIRESLKAISEVLKVLDT

SEQ ID NO: 717 - protein, 231 aa, Artificial Sequence; identical to SEQ ID NO: 716
  Synthetic

SEQ ID NO: 718 - protein, 231 aa, Artificial Sequence
  Synthetic
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILRDHMVLHEYVNAAGITILKLLRDLTRRLAEVAKAVHKLLEELLRKLKEDTR

SEQ ID NO: 719 - protein, 238 aa, Artificial Sequence
  Synthetic
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGERDHMVLHEYVNAAGITIEDSLRELEKTVRELLKRIKEASDKVREDVDRLIKELKEAAD

SEQ ID NO: 720 - protein, 238 aa, Artificial Sequence; identical to SEQ ID NO: 719
  Synthetic

SEQ ID NO: 721 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEERDHMVLHEYVNAAGITKEILERIERAIDELLKVSEEILKLSEDASEELLKILREFAK

SEQ ID NO: 722 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDERDHMVLHEYVNAAGITLEDLARDTRRVIEEAKRLLKEWRDRNKEVADTLKKLLEDLIRKIR

SEQ ID NO: 723 - protein, 241 aa, Artificial Sequence; identical to SEQ ID NO: 722
  Synthetic

SEQ ID NO: 724 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTRDHMVLHEYVNAAGITRLLDNLKENTDRLKEVIDRNLADLRDLAEELRAVIERLLEDARR

SEQ ID NO: 725 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGRDHMVLHEYVNAAGITEKVLDDSAKELEKLKRELERLLEESRRKLEKLKRDLERVLEETRR

SEQ ID NO: 726 - protein, 241 aa, Artificial Sequence; identical to SEQ ID NO: 725
  Synthetic

SEQ ID NO: 727 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLRDHMVLHEYVNAAGITKALEKLARDLKEILRRHIEALKELARDLAEVIRKLLEDVKR

SEQ ID NO: 728 - protein, 239 aa, Artificial Sequence
  Synthetic
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRRDHMVLHEYVNAAGITVLKELVEELEKLVRDHNRVVEEVVRELVELLSRAVEVIKEVVK

SEQ ID NO: 729 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSRDHMVLHEYVNAAGITDLLRLLEEDSRTNSEVVKRLLDLLREDSKANSEVVKRLLDVLRE

SEQ ID NO: 730 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGRDHMVLHEYVNAAGITRLIEILRRDVELNLDVAKKLLELLKEDSKLNLDVARELLELLDR

SEQ ID NO: 731 - protein, 241 aa, Artificial Sequence
  Synthetic
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGRDHMVLHEYVNAAGITKRRVERLLEDIERLLAELEKLNEDVLRENKALLEDLERRVRERKK

SEQ ID NO: 732 - protein, 239 aa, Artificial Sequence
  Synthetic
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLRDHMVLHEYVNAAGITLKEDKERLEKIARDIERDLERYARDLKRLEDELREDIERARR

SEQ ID NO: 733 - protein, 239 aa, Artificial Sequence; identical to SEQ ID NO: 732
  Synthetic

SEQ ID NO: 734 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGARDHMVLHEYVNAAGITDRLRRLLEKLARDSAELMRELERILDRYARESEELDRRLAE

SEQ ID NO: 735 - protein, 238 aa, Artificial Sequence; identical to SEQ ID NO: 734
  Synthetic

SEQ ID NO: 736 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNRDHMVLHEYVNAAGITEDDLRKIERDAEREYKKLKDELEELTERYRREIRKLKEELKADRK

SEQ ID NO: 737 - protein, 242 aa, Artificial Sequence; identical to SEQ ID NO: 736
  Synthetic

SEQ ID NO: 738 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRDHMVLHEYVNAAGITRKLLERLREILRENLEALKKTLKRLEDVVREILEDLKRERK

SEQ ID NO: 739 - protein, 238 aa, Artificial Sequence; identical to SEQ ID NO: 738
  Synthetic

SEQ ID NO: 740 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPERDHMVLHEYVNAAGITLRKALEELEREHRELEKELDKLHDESRKEHERIEEELRR

SEQ ID NO: 741 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDRDHMVLHEYVNAAGITLEKVERTLKKLLDDSARMAEEVKKTLKELLERSEKVAEDVRK

SEQ ID NO: 742 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELRDHMVLHEYVNAAGITEILERIERAIDELLKVSEEILKLSEDASEELLKILREFAK

SEQ ID NO: 743 - protein, 237 aa, Artificial Sequence; identical to SEQ ID NO: 742
  Synthetic

SEQ ID NO: 744 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDRDHMVLHEYVNAAGITEDLARDTRRVIEEAKRLLKEWRDRNKEVADTLKKLLEDLIRKIR

SEQ ID NO: 745 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGRDHMVLHEYVNAAGITLLDNLKENTDRLKEVIDRNLADLRDLAEELRAVIERLLEDARR

SEQ ID NO: 746 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVRDHMVLHEYVNAAGITKVLDDSAKELEKLKRELERLLEESRRKLEKLKRDLERVLEETRR

SEQ ID NO: 747 - protein, 241 aa, Artificial Sequence; identical to SEQ ID NO: 746
  Synthetic

SEQ ID NO: 748 - protein, 239 aa, Artificial Sequence
  Synthetic
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNRDHMVLHEYVNAAGITLKELVEELEKLVRDHNRVVEEVVRELVELLSRAVEVIKEVVK

SEQ ID NO: 749 - protein, 239 aa, Artificial Sequence; identical to SEQ ID NO: 748
  Synthetic

SEQ ID NO: 750 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDRDHMVLHEYVNAAGITLLRLLEEDSRTNSEVVKRLLDLLREDSKANSEVVKRLLDVLRE

SEQ ID NO: 751 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSRDHMVLHEYVNAAGITLIEILRRDVELNLDVAKKLLELLKEDSKLNLDVARELLELLDR

SEQ ID NO: 752 - protein, 240 aa, Artificial Sequence; identical to SEQ ID NO: 751
  Synthetic

SEQ ID NO: 753 - protein, 239 aa, Artificial Sequence
  Synthetic
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLERDHMVLHEYVNAAGITKEDKERLEKIARDIERDLERYARDLKRLEDELREDIERARR

SEQ ID NO: 754 - protein, 239 aa, Artificial Sequence; identical to SEQ ID NO: 753
  Synthetic

SEQ ID NO: 755 - protein, 238 aa, Artificial Sequence
  Synthetic
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDRDHMVLHEYVNAAGITLVEKLIRRNLRLLEELLRLVREILRTSNEILEEILKDARR

SEQ ID NO: 756 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPRDHMVLHEYVNAAGITRLRRLLEKLARDSAELMRELERILDRYARESEELDRRLAE

SEQ ID NO: 757 - protein, 238 aa, Artificial Sequence; identical to SEQ ID NO: 756
  Synthetic

SEQ ID NO: 758 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVRDHMVLHEYVNAAGITDDLRKIERDAEREYKKLKDELEELTERYRREIRKLKEELKADRK

SEQ ID NO: 759 - protein, 242 aa, Artificial Sequence; identical to SEQ ID NO: 758
  Synthetic

SEQ ID NO: 760 - protein, 240 aa, Artificial Sequence
  Synthetic
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRDHMVLHEYVNAAGITVRRILEALAKLIKELLEALEEVLRRNKELIRELLRVLDEALK

SEQ ID NO: 761 - protein, 240 aa, Artificial Sequence; identical to SEQ ID NO: 760
  Synthetic

SEQ ID NO: 762 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRRDHMVLHEYVNAAGITKLLERLREILRENLEALKKTLKRLEDVVREILEDLKRERK

SEQ ID NO: 763 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDRDHMVLHEYVNAAGITRKALEELEREHRELEKELDKLHDESRKEHERIEEELRR

SEQ ID NO: 764 - protein, 236 aa, Artificial Sequence; identical to SEQ ID NO: 763
  Synthetic

SEQ ID NO: 765 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPRDHMVLHEYVNAAGITKRDSEKVVDDLKKELERIKREVKRLIEENARTLADIKRAVDEARK

SEQ ID NO: 766 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDRDHMVLHEYVNAAGITEKVERTLKKLLDDSARMAEEVKKTLKELLERSEKVAEDVRK

SEQ ID NO: 767 - protein, 238 aa, Artificial Sequence
  Synthetic
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSRDHMVLHEYVNAAGITDSLRELEKTVRELLKRIKEASDKVREDVDRLIKELKEAAD

SEQ ID NO: 768 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELARDHMVLHEYVNAAGITILERIERAIDELLKVSEEILKLSEDASEELLKILREFAK

SEQ ID NO: 769 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDARDHMVLHEYVNAAGITDLARDTRRVIEEAKRLLKEWRDRNKEVADTLKKLLEDLIRKIR

SEQ ID NO: 770 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIRDHMVLHEYVNAAGITLDNLKENTDRLKEVIDRNLADLRDLAEELRAVIERLLEDARR

SEQ ID NO: 771 - protein, 240 aa, Artificial Sequence; identical to SEQ ID NO: 770
  Synthetic

SEQ ID NO: 772 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSRDHMVLHEYVNAAGITVLDDSAKELEKLKRELERLLEESRRKLEKLKRDLERVLEETRR

SEQ ID NO: 773 - protein, 241 aa, Artificial Sequence; identical to SEQ ID NO: 772
  Synthetic

SEQ ID NO: 774 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDERDHMVLHEYVNAAGITLEKLARDLKEILRRHIEALKELARDLAEVIRKLLEDVKR

SEQ ID NO: 775 - protein, 237 aa, Artificial Sequence; identical to SEQ ID NO: 774
  Synthetic

SEQ ID NO: 776 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGRDHMVLHEYVNAAGITLEIIEELVRLNNEILERLLKIVRELHKDNIKILEDLLRIIEEVLR

SEQ ID NO: 777 - protein, 243 aa, Artificial Sequence; identical to SEQ ID NO: 776
  Synthetic

SEQ ID NO: 778 - protein, 239 aa, Artificial Sequence
  Synthetic
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSRDHMVLHEYVNAAGITKELVEELEKLVRDHNRVVEEVVRELVELLSRAVEVIKEVVK

SEQ ID NO: 779 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRDHMVLHEYVNAAGITKEDLDRILEEYRRLLEEIKRKLEEILRRVEELHRRLRRKLEEIDR

SEQ ID NO: 780 - protein, 243 aa, Artificial Sequence; identical to SEQ ID NO: 779
  Synthetic

SEQ ID NO: 781 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKRDHMVLHEYVNAAGITLRLLEEDSRTNSEVVKRLLDLLREDSKANSEVVKRLLDVLRE

SEQ ID NO: 782 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSERDHMVLHEYVNAAGITIEILRRDVELNLDVAKKLLELLKEDSKLNLDVARELLELLDR

SEQ ID NO: 783 - protein, 240 aa, Artificial Sequence; identical to SEQ ID NO: 782
  Synthetic

SEQ ID NO: 784 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDERDHMVLHEYVNAAGITLRELNEITKDLEAKLEKLLRDLNELTKALEEELKRLLDELKKRTD

SEQ ID NO: 785 - protein, 243 aa, Artificial Sequence; identical to SEQ ID NO: 784
  Synthetic

SEQ ID NO: 786 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRDHMVLHEYVNAAGITKELADRYREEVRKSKDKLRSILEDYKRKVDELKERLRELIEEVET

SEQ ID NO: 787 - protein, 243 aa, Artificial Sequence; identical to SEQ ID NO: 786
  Synthetic

SEQ ID NO: 788 - protein, 238 aa, Artificial Sequence
  Synthetic
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKRDHMVLHEYVNAAGITVEKLIRRNLRLLEELLRLVREILRTSNEILEEILKDARR

SEQ ID NO: 789 - protein, 234 aa, Artificial Sequence
  Synthetic
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELERDHMVLHEYVNAAGITLKELSDRLEEKIRKIKRELDDLSARLREKIERTRK

SEQ ID NO: 790 - protein, 234 aa, Artificial Sequence; identical to SEQ ID NO: 789
  Synthetic

SEQ ID NO: 791 - protein, 238 aa, Artificial Sequence
  Synthetic
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDERDHMVLHEYVNAAGITARKILRDDERDLRALEKRIRDIIREDREELERLKERARK

SEQ ID NO: 792 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGRDHMVLHEYVNAAGITRRLEEEVERVARELEKAHRDLERDIRRVAEELKKLLKKLRDDRR

SEQ ID NO: 793 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDERDHMVLHEYVNAAGITIRVLEEILKINEELNRKIIKFARENLERNRRVNKKVIEVLREAAR

SEQ ID NO: 794 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKRDHMVLHEYVNAAGITLRRLLEKLARDSAELMRELERILDRYARESEELDRRLAE

SEQ ID NO: 795 - protein, 238 aa, Artificial Sequence; identical to SEQ ID NO: 794
  Synthetic

SEQ ID NO: 796 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSRDHMVLHEYVNAAGITDLRKIERDAEREYKKLKDELEELTERYRREIRKLKEELKADRK

SEQ ID NO: 797 - protein, 242 aa, Artificial Sequence; identical to SEQ ID NO: 796
  Synthetic

SEQ ID NO: 798 - protein, 240 aa, Artificial Sequence
  Synthetic
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRRDHMVLHEYVNAAGITRRILEALAKLIKELLEALEEVLRRNKELIRELLRVLDEALK

SEQ ID NO: 799 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKRDHMVLHEYVNAAGITLLERLREILRENLEALKKTLKRLEDVVREILEDLKRERK

SEQ ID NO: 800 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLRDHMVLHEYVNAAGITKALEELEREHRELEKELDKLHDESRKEHERIEEELRR

SEQ ID NO: 801 - protein, 236 aa, Artificial Sequence; identical to SEQ ID NO: 800
  Synthetic

SEQ ID NO: 802 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGRDHMVLHEYVNAAGITRDSEKVVDDLKKELERIKREVKRLIEENARTLADIKRAVDEARK

SEQ ID NO: 803 - protein, 243 aa, Artificial Sequence; identical to SEQ ID NO: 802
  Synthetic

SEQ ID NO: 804 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERDHMVLHEYVNAAGITKVERTLKKLLDDSARMAEEVKKTLKELLERSEKVAEDVRK

SEQ ID NO: 805 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELARRDHMVLHEYVNAAGITLERIERAIDELLKVSEEILKLSEDASEELLKILREFAK

SEQ ID NO: 806 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRDHMVLHEYVNAAGITLARDTRRVIEEAKRLLKEWRDRNKEVADTLKKLLEDLIRKIR

SEQ ID NO: 807 - protein, 241 aa, Artificial Sequence; identical to SEQ ID NO: 806
  Synthetic

SEQ ID NO: 808 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKRDHMVLHEYVNAAGITDNLKENTDRLKEVIDRNLADLRDLAEELRAVIERLLEDARR

SEQ ID NO: 809 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSERDHMVLHEYVNAAGITLDDSAKELEKLKRELERLLEESRRKLEKLKRDLERVLEETRR

SEQ ID NO: 810 - protein, 241 aa, Artificial Sequence; identical to SEQ ID NO: 809
  Synthetic

SEQ ID NO: 811 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDRDHMVLHEYVNAAGITEKLARDLKEILRRHIEALKELARDLAEVIRKLLEDVKR

SEQ ID NO: 812 - protein, 237 aa, Artificial Sequence; identical to SEQ ID NO: 811
  Synthetic

SEQ ID NO: 813 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKRDHMVLHEYVNAAGITEIIEELVRLNNEILERLLKIVRELHKDNIKILEDLLRIIEEVLR

SEQ ID NO: 814 - protein, 243 aa, Artificial Sequence; identical to SEQ ID NO: 813
  Synthetic

SEQ ID NO: 815 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRRDHMVLHEYVNAAGITEDLDRILEEYRRLLEEIKRKLEEILRRVEELHRRLRRKLEEIDR

SEQ ID NO: 816 - protein, 243 aa, Artificial Sequence; identical to SEQ ID NO: 815
  Synthetic

SEQ ID NO: 817 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEERDHMVLHEYVNAAGITEILRRDVELNLDVAKKLLELLKEDSKLNLDVARELLELLDR

SEQ ID NO: 818 - protein, 240 aa, Artificial Sequence; identical to SEQ ID NO: 817
  Synthetic

SEQ ID NO: 819 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESRDHMVLHEYVNAAGITRELNEITKDLEAKLEKLLRDLNELTKALEEELKRLLDELKKRTD

SEQ ID NO: 820 - protein, 243 aa, Artificial Sequence; identical to SEQ ID NO: 819
  Synthetic

SEQ ID NO: 821 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRRDHMVLHEYVNAAGITELADRYREEVRKSKDKLRSILEDYKRKVDELKERLRELIEEVET

SEQ ID NO: 822 - protein, 243 aa, Artificial Sequence; identical to SEQ ID NO: 821
  Synthetic

SEQ ID NO: 823 - protein, 241 aa, Artificial Sequence
  Synthetic
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSERDHMVLHEYVNAAGITVERLLEDIERLLAELEKLNEDVLRENKALLEDLERRVRERKK

SEQ ID NO: 824 - protein, 241 aa, Artificial Sequence; identical to SEQ ID NO: 823
  Synthetic

SEQ ID NO: 825 - protein, 239 aa, Artificial Sequence
  Synthetic
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLEGSRDHMVLHEYVNAAGITDKERLEKIARDIERDLERYARDLKRLEDELREDIERARR

SEQ ID NO: 826 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGRDHMVLHEYVNAAGITEKRHEDLRRELEKLLRDYKRELEEIERALEEIEKTLKRRADETRR

SEQ ID NO: 827 - protein, 238 aa, Artificial Sequence
  Synthetic
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDRDHMVLHEYVNAAGITRKILRDDERDLRALEKRIRDIIREDREELERLKERARK

SEQ ID NO: 828 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDRDHMVLHEYVNAAGITRLEEEVERVARELEKAHRDLERDIRRVAEELKKLLKKLRDDRR

SEQ ID NO: 829 - protein, 243 aa, Artificial Sequence; identical to SEQ ID NO: 828
  Synthetic

SEQ ID NO: 830 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRDHMVLHEYVNAAGITRVLEEILKINEELNRKIIKFARENLERNRRVNKKVIEVLREAAR

SEQ ID NO: 831 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKERDHMVLHEYVNAAGITRRLLEKLARDSAELMRELERILDRYARESEELDRRLAE

SEQ ID NO: 832 - protein, 238 aa, Artificial Sequence; identical to SEQ ID NO: 831
  Synthetic

SEQ ID NO: 833 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSERDHMVLHEYVNAAGITLRKIERDAEREYKKLKDELEELTERYRREIRKLKEELKADRK

SEQ ID NO: 834 - protein, 242 aa, Artificial Sequence; identical to SEQ ID NO: 833
  Synthetic

SEQ ID NO: 835 - protein, 240 aa, Artificial Sequence
  Synthetic
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLRDHMVLHEYVNAAGITRILEALAKLIKELLEALEEVLRRNKELIRELLRVLDEALK

SEQ ID NO: 836 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDRDHMVLHEYVNAAGITLERLREILRENLEALKKTLKRLEDVVREILEDLKRERK

SEQ ID NO: 837 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRDHMVLHEYVNAAGITALEELEREHRELEKELDKLHDESRKEHERIEEELRR

SEQ ID NO: 838 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRDHMVLHEYVNAAGITVERTLKKLLDDSARMAEEVKKTLKELLERSEKVAEDVRK

SEQ ID NO: 839 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRRDHMVLHEYVNAAGITARDTRRVIEEAKRLLKEWRDRNKEVADTLKKLLEDLIRKIR

SEQ ID NO: 840 - protein, 241 aa, Artificial Sequence; identical to SEQ ID NO: 839
  Synthetic

SEQ ID NO: 841 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLRDHMVLHEYVNAAGITKLARDLKEILRRHIEALKELARDLAEVIRKLLEDVKR

SEQ ID NO: 842 - protein, 237 aa, Artificial Sequence; identical to SEQ ID NO: 841
  Synthetic

SEQ ID NO: 843 - protein, 245 aa, Artificial Sequence
  Synthetic
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRRDHMVLHEYVNAAGITAESLRLIRELLKEIEKIVKEIIELLERLNDELRKIIEAILETTKK

SEQ ID NO: 844 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGRDHMVLHEYVNAAGITDLDRILEEYRRLLEEIKRKLEEILRRVEELHRRLRRKLEEIDR

SEQ ID NO: 845 - protein, 243 aa, Artificial Sequence; identical to SEQ ID NO: 844
  Synthetic

SEQ ID NO: 846 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSRDHMVLHEYVNAAGITELNEITKDLEAKLEKLLRDLNELTKALEEELKRLLDELKKRTD

SEQ ID NO: 847 - protein, 243 aa, Artificial Sequence; identical to SEQ ID NO: 846
  Synthetic

SEQ ID NO: 848 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTRDHMVLHEYVNAAGITLADRYREEVRKSKDKLRSILEDYKRKVDELKERLRELIEEVET

SEQ ID NO: 849 - protein, 243 aa, Artificial Sequence; identical to SEQ ID NO: 848
  Synthetic

SEQ ID NO: 850 - protein, 238 aa, Artificial Sequence
  Synthetic
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVRDHMVLHEYVNAAGITKLIRRNLRLLEELLRLVREILRTSNEILEEILKDARR

SEQ ID NO: 851 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSRDHMVLHEYVNAAGITKRHEDLRRELEKLLRDYKRELEEIERALEEIEKTLKRRADETRR

SEQ ID NO: 852 - protein, 245 aa, Artificial Sequence; identical to SEQ ID NO: 851
  Synthetic

SEQ ID NO: 853 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRRDHMVLHEYVNAAGITVLEEILKINEELNRKIIKFARENLERNRRVNKKVIEVLREAAR

SEQ ID NO: 854 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDRDHMVLHEYVNAAGITRLLEKLARDSAELMRELERILDRYARESEELDRRLAE

SEQ ID NO: 855 - protein, 238 aa, Artificial Sequence; identical to SEQ ID NO: 854
  Synthetic

SEQ ID NO: 856 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEERDHMVLHEYVNAAGITRKIERDAEREYKKLKDELEELTERYRREIRKLKEELKADRK

SEQ ID NO: 857 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDRDHMVLHEYVNAAGITERLREILRENLEALKKTLKRLEDVVREILEDLKRERK

SEQ ID NO: 858 - protein, 236 aa, Artificial Sequence
  Synthetic
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRRDHMVLHEYVNAAGITLEELEREHRELEKELDKLHDESRKEHERIEEELRR

SEQ ID NO: 859 - protein, 236 aa, Artificial Sequence; identical to SEQ ID NO: 858
  Synthetic

SEQ ID NO: 860 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDERDHMVLHEYVNAAGITSEKVVDDLKKELERIKREVKRLIEENARTLADIKRAVDEARK

SEQ ID NO: 861 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRRDHMVLHEYVNAAGITERTLKKLLDDSARMAEEVKKTLKELLERSEKVAEDVRK

SEQ ID NO: 862 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILRDHMVLHEYVNAAGITEEIKRRLKEVIDRYEDELRKLRKEYKEKIDKYERKLEEIERRERT

SEQ ID NO: 863 - protein, 246 aa, Artificial Sequence
  Synthetic
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGRDHMVLHEYVNAAGITLERNTRVIKEIIDLLRTVIRIHEKIVEDLIKLLEELLRRLEEATR

SEQ ID NO: 864 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVRDHMVLHEYVNAAGITRIERAIDELLKVSEEILKLSEDASEELLKILREFAK

SEQ ID NO: 865 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKRDHMVLHEYVNAAGITRDTRRVIEEAKRLLKEWRDRNKEVADTLKKLLEDLIRKIR

SEQ ID NO: 866 - protein, 241 aa, Artificial Sequence; identical to SEQ ID NO: 865
  Synthetic

SEQ ID NO: 867 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGRDHMVLHEYVNAAGITLEAVRRVLEELLKVLAEHLETVRELIERLKRVLEEAIEVVERVAR

SEQ ID NO: 868 - protein, 246 aa, Artificial Sequence; identical to SEQ ID NO: 867
  Synthetic

SEQ ID NO: 869 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSRDHMVLHEYVNAAGITLKENTDRLKEVIDRNLADLRDLAEELRAVIERLLEDARR

SEQ ID NO: 870 - protein, 240 aa, Artificial Sequence; identical to SEQ ID NO: 869
  Synthetic

SEQ ID NO: 871 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELRDHMVLHEYVNAAGITDSAKELEKLKRELERLLEESRRKLEKLKRDLERVLEETRR

SEQ ID NO: 872 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLRDHMVLHEYVNAAGITLARDLKEILRRHIEALKELARDLAEVIRKLLEDVKR

SEQ ID NO: 873 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSERDHMVLHEYVNAAGITIEELVRLNNEILERLLKIVRELHKDNIKILEDLLRIIEEVLR

SEQ ID NO: 874 - protein, 243 aa, Artificial Sequence; identical to SEQ ID NO: 873
  Synthetic

SEQ ID NO: 875 - protein, 245 aa, Artificial Sequence
  Synthetic
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGRDHMVLHEYVNAAGITESLRLIRELLKEIEKIVKEIIELLERLNDELRKIIEAILETTKK

SEQ ID NO: 876 - protein, 239 aa, Artificial Sequence
  Synthetic
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRRDHMVLHEYVNAAGITVEELEKLVRDHNRVVEEVVRELVELLSRAVEVIKEVVK

SEQ ID NO: 877 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSRDHMVLHEYVNAAGITLDRILEEYRRLLEEIKRKLEEILRRVEELHRRLRRKLEEIDR

SEQ ID NO: 878 - protein, 243 aa, Artificial Sequence; identical to SEQ ID NO: 877
  Synthetic

SEQ ID NO: 879 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKRDHMVLHEYVNAAGITLEEDSRTNSEVVKRLLDLLREDSKANSEVVKRLLDVLRE

SEQ ID NO: 880 - protein, 240 aa, Artificial Sequence; identical to SEQ ID NO: 879
  Synthetic

SEQ ID NO: 881 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKRDHMVLHEYVNAAGITLRRDVELNLDVAKKLLELLKEDSKLNLDVARELLELLDR

SEQ ID NO: 882 - protein, 240 aa, Artificial Sequence; identical to SEQ ID NO: 881
  Synthetic

SEQ ID NO: 883 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSRRDHMVLHEYVNAAGITLNEITKDLEAKLEKLLRDLNELTKALEEELKRLLDELKKRTD

SEQ ID NO: 884 - protein, 243 aa, Artificial Sequence; identical to SEQ ID NO: 883
  Synthetic

SEQ ID NO: 885 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTERDHMVLHEYVNAAGITADRYREEVRKSKDKLRSILEDYKRKVDELKERLRELIEEVET

SEQ ID NO: 886 - protein, 243 aa, Artificial Sequence; identical to SEQ ID NO: 885
  Synthetic

SEQ ID NO: 887 - protein, 238 aa, Artificial Sequence
  Synthetic
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLRDHMVLHEYVNAAGITLIRRNLRLLEELLRLVREILRTSNEILEEILKDARR

SEQ ID NO: 888 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSERDHMVLHEYVNAAGITRHEDLRRELEKLLRDYKRELEEIERALEEIEKTLKRRADETRR

SEQ ID NO: 889 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDERDHMVLHEYVNAAGITEEEVERVARELEKAHRDLERDIRRVAEELKKLLKKLRDDRR

SEQ ID NO: 890 - protein, 243 aa, Artificial Sequence; identical to SEQ ID NO: 889
  Synthetic

SEQ ID NO: 891 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERDHMVLHEYVNAAGITLEEILKINEELNRKIIKFARENLERNRRVNKKVIEVLREAAR

SEQ ID NO: 892 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGRDHMVLHEYVNAAGITREKLKRNLEDVRRVIEDVKRKSARILEEARRLIEEVERELEKIRK

SEQ ID NO: 893 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLRDHMVLHEYVNAAGITLLEKLARDSAELMRELERILDRYARESEELDRRLAE

SEQ ID NO: 894 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETRDHMVLHEYVNAAGITKIERDAEREYKKLKDELEELTERYRREIRKLKEELKADRK

SEQ ID NO: 895 - protein, 242 aa, Artificial Sequence; identical to SEQ ID NO: 894
  Synthetic

SEQ ID NO: 896 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGRDHMVLHEYVNAAGITLDRLREEHEEVKRRLEEELTRLRETHKKIEKELREALKRVRDRST

SEQ ID NO: 897 - protein, 247 aa, Artificial Sequence; identical to SEQ ID NO: 896
  Synthetic

SEQ ID NO: 898 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLRDHMVLHEYVNAAGITRLREILRENLEALKKTLKRLEDVVREILEDLKRERK

SEQ ID NO: 899 - protein, 238 aa, Artificial Sequence; identical to SEQ ID NO: 898
  Synthetic

SEQ ID NO: 900 - protein, 247 aa, Artificial Sequence
  Synthetic
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDRDHMVLHEYVNAAGITERLLREVIKSHEKLVRTIERLIEESIRVNEELLEVIERLLDRARK

SEQ ID NO: 901 - protein, 247 aa, Artificial Sequence; identical to SEQ ID NO: 900
  Synthetic

SEQ ID NO: 902 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDRDHMVLHEYVNAAGITEKVVDDLKKELERIKREVKRLIEENARTLADIKRAVDEARK

SEQ ID NO: 903 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDRDHMVLHEYVNAAGITEIKRRLKEVIDRYEDELRKLRKEYKEKIDKYERKLEEIERRERT

SEQ ID NO: 904 - protein, 247 aa, Artificial Sequence
  Synthetic
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERRDHMVLHEYVNAAGITAEEMKRVHDDLSRAVEKVVRDVVRVDKELLDELARILRRLEEVIT

SEQ ID NO: 905 - protein, 237 aa, Artificial Sequence
  Synthetic
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERDHMVLHEYVNAAGITIERAIDELLKVSEEILKLSEDASEELLKILREFAK

SEQ ID NO: 906 - protein, 237 aa, Artificial Sequence; identical to SEQ ID NO: 905
  Synthetic

SEQ ID NO: 907 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIRDHMVLHEYVNAAGITDTRRVIEEAKRLLKEWRDRNKEVADTLKKLLEDLIRKIR

SEQ ID NO: 908 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDRDHMVLHEYVNAAGITEAVRRVLEELLKVLAEHLETVRELIERLKRVLEEAIEVVERVAR

SEQ ID NO: 909 - protein, 246 aa, Artificial Sequence; identical to SEQ ID NO: 908
  Synthetic

SEQ ID NO: 910 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSERDHMVLHEYVNAAGITKENTDRLKEVIDRNLADLRDLAEELRAVIERLLEDARR

SEQ ID NO: 911 - protein, 240 aa, Artificial Sequence; identical to SEQ ID NO: 910
  Synthetic

SEQ ID NO: 912 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRDHMVLHEYVNAAGITSAKELEKLKRELERLLEESRRKLEKLKRDLERVLEETRR

SEQ ID NO: 913 - protein, 237 aa, Artificial Sequence
  Synthetic
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLERDHMVLHEYVNAAGITARDLKEILRRHIEALKELARDLAEVIRKLLEDVKR

SEQ ID NO: 914 - protein, 237 aa, Artificial Sequence; identical to SEQ ID NO: 913
  Synthetic

SEQ ID NO: 915 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEERDHMVLHEYVNAAGITEELVRLNNEILERLLKIVRELHKDNIKILEDLLRIIEEVLR

SEQ ID NO: 916 - protein, 243 aa, Artificial Sequence; identical to SEQ ID NO: 915
  Synthetic

SEQ ID NO: 917 - protein, 245 aa, Artificial Sequence
  Synthetic
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSRDHMVLHEYVNAAGITSLRLIRELLKEIEKIVKEIIELLERLNDELRKIIEAILETTKK

SEQ ID NO: 918 - protein, 247 aa, Artificial Sequence
  Synthetic
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARDHMVLHEYVNAAGITRDRLRKLLEDYERAVRRLEDKLRRVRERYEAVLKRIKDKLEETKR

SEQ ID NO: 919 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVRDHMVLHEYVNAAGITDRILEEYRRLLEEIKRKLEEILRRVEELHRRLRRKLEEIDR

SEQ ID NO: 920 - protein, 243 aa, Artificial Sequence; identical to SEQ ID NO: 919
  Synthetic

SEQ ID NO: 921 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDRDHMVLHEYVNAAGITEEDSRTNSEVVKRLLDLLREDSKANSEVVKRLLDVLRE

SEQ ID NO: 922 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDRDHMVLHEYVNAAGITRRDVELNLDVAKKLLELLKEDSKLNLDVARELLELLDR

SEQ ID NO: 923 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSRERDHMVLHEYVNAAGITNEITKDLEAKLEKLLRDLNELTKALEEELKRLLDELKKRTD

SEQ ID NO: 924 - protein, 243 aa, Artificial Sequence; identical to SEQ ID NO: 923
  Synthetic

SEQ ID NO: 925 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEERDHMVLHEYVNAAGITDRYREEVRKSKDKLRSILEDYKRKVDELKERLRELIEEVET

SEQ ID NO: 926 - protein, 243 aa, Artificial Sequence; identical to SEQ ID NO: 925
  Synthetic

SEQ ID NO: 927 - protein, 238 aa, Artificial Sequence
  Synthetic
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTRDHMVLHEYVNAAGITIRRNLRLLEELLRLVREILRTSNEILEEILKDARR

SEQ ID NO: 928 - protein, 238 aa, Artificial Sequence; identical to SEQ ID NO: 927
  Synthetic

SEQ ID NO: 929 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEERDHMVLHEYVNAAGITHEDLRRELEKLLRDYKRELEEIERALEEIEKTLKRRADETRR

SEQ ID NO: 930 - protein, 245 aa, Artificial Sequence; identical to SEQ ID NO: 929
  Synthetic

SEQ ID NO: 931 - protein, 238 aa, Artificial Sequence
  Synthetic
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRRDHMVLHEYVNAAGITLRDDERDLRALEKRIRDIIREDREELERLKERARK

SEQ ID NO: 932 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEERDHMVLHEYVNAAGITEEVERVARELEKAHRDLERDIRRVAEELKKLLKKLRDDRR

SEQ ID NO: 933 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERRDHMVLHEYVNAAGITEEILKINEELNRKIIKFARENLERNRRVNKKVIEVLREAAR

SEQ ID NO: 934 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGARDHMVLHEYVNAAGITEKLKRNLEDVRRVIEDVKRKSARILEEARRLIEEVERELEKIRK

SEQ ID NO: 935 - protein, 247 aa, Artificial Sequence; identical to SEQ ID NO: 934
  Synthetic

SEQ ID NO: 936 - protein, 238 aa, Artificial Sequence
  Synthetic
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERDHMVLHEYVNAAGITLEKLARDSAELMRELERILDRYARESEELDRRLAE

SEQ ID NO: 937 - protein, 238 aa, Artificial Sequence; identical to SEQ ID NO: 936
  Synthetic

SEQ ID NO: 938 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRDHMVLHEYVNAAGITIERDAEREYKKLKDELEELTERYRREIRKLKEELKADRK

SEQ ID NO: 939 - protein, 242 aa, Artificial Sequence; identical to SEQ ID NO: 938
  Synthetic

SEQ ID NO: 940 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKRDHMVLHEYVNAAGITDRLREEHEEVKRRLEEELTRLRETHKKIEKELREALKRVRDRST

SEQ ID NO: 941 - protein, 247 aa, Artificial Sequence; identical to SEQ ID NO: 940
  Synthetic

SEQ ID NO: 942 - protein, 240 aa, Artificial Sequence
  Synthetic
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEERDHMVLHEYVNAAGITEALAKLIKELLEALEEVLRRNKELIRELLRVLDEALK

SEQ ID NO: 943 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGRDHMVLHEYVNAAGITRRMIKRLHEDLERKLKESEDELREIEARLEEKIRRLEEKLERKRR

SEQ ID NO: 944 - protein, 248 aa, Artificial Sequence; identical to SEQ ID NO: 943
  Synthetic

SEQ ID NO: 945 - protein, 238 aa, Artificial Sequence
  Synthetic
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLERDHMVLHEYVNAAGITLREILRENLEALKKTLKRLEDVVREILEDLKRERK

SEQ ID NO: 946 - protein, 238 aa, Artificial Sequence; identical to SEQ ID NO: 945
  Synthetic

SEQ ID NO: 947 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLRDHMVLHEYVNAAGITKVVDDLKKELERIKREVKRLIEENARTLADIKRAVDEARK

SEQ ID NO: 948 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTRDHMVLHEYVNAAGITIKRRLKEVIDRYEDELRKLRKEYKEKIDKYERKLEEIERRERT

SEQ ID NO: 949 - protein, 247 aa, Artificial Sequence
  Synthetic
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGRDHMVLHEYVNAAGITEEMKRVHDDLSRAVEKVVRDVVRVDKELLDELARILRRLEEVIT

SEQ ID NO: 950 - protein, 247 aa, Artificial Sequence; identical to SEQ ID NO: 949
  Synthetic

SEQ ID NO: 951 - protein, 246 aa, Artificial Sequence
  Synthetic
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSRDHMVLHEYVNAAGITRNTRVIKEIIDLLRTVIRIHEKIVEDLIKLLEELLRRLEEATR

SEQ ID NO: 952 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIARDHMVLHEYVNAAGITTRRVIEEAKRLLKEWRDRNKEVADTLKKLLEDLIRKIR

SEQ ID NO: 953 - protein, 241 aa, Artificial Sequence; identical to SEQ ID NO: 952
  Synthetic

SEQ ID NO: 954 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSRDHMVLHEYVNAAGITAVRRVLEELLKVLAEHLETVRELIERLKRVLEEAIEVVERVAR

SEQ ID NO: 955 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVRDHMVLHEYVNAAGITENTDRLKEVIDRNLADLRDLAEELRAVIERLLEDARR

SEQ ID NO: 956 - protein, 240 aa, Artificial Sequence; identical to SEQ ID NO: 955
  Synthetic

SEQ ID NO: 957 - protein, 245 aa, Artificial Sequence
  Synthetic
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGRDHMVLHEYVNAAGITLRLIRELLKEIEKIVKEIIELLERLNDELRKIIEAILETTKK

SEQ ID NO: 958 - protein, 245 aa, Artificial Sequence; identical to SEQ ID NO: 957
  Synthetic

SEQ ID NO: 959 - protein, 239 aa, Artificial Sequence
  Synthetic
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLRDHMVLHEYVNAAGITELEKLVRDHNRVVEEVVRELVELLSRAVEVIKEVVK

SEQ ID NO: 960 - protein, 247 aa, Artificial Sequence
  Synthetic
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARRDHMVLHEYVNAAGITDRLRKLLEDYERAVRRLEDKLRRVRERYEAVLKRIKDKLEETKR

SEQ ID NO: 961 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGRDHMVLHEYVNAAGITRILEEYRRLLEEIKRKLEEILRRVEELHRRLRRKLEEIDR

SEQ ID NO: 962 - protein, 243 aa, Artificial Sequence; identical to SEQ ID NO: 961
  Synthetic

SEQ ID NO: 963 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREARDHMVLHEYVNAAGITEITKDLEAKLEKLLRDLNELTKALEEELKRLLDELKKRTD

SEQ ID NO: 964 - protein, 243 aa, Artificial Sequence; identical to SEQ ID NO: 963
  Synthetic

SEQ ID NO: 965 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRDHMVLHEYVNAAGITRYREEVRKSKDKLRSILEDYKRKVDELKERLRELIEEVET

SEQ ID NO: 966 - protein, 243 aa, Artificial Sequence; identical to SEQ ID NO: 965
  Synthetic

SEQ ID NO: 967 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKRDHMVLHEYVNAAGITEDLRRELEKLLRDYKRELEEIERALEEIEKTLKRRADETRR

SEQ ID NO: 968 - protein, 245 aa, Artificial Sequence; identical to SEQ ID NO: 967
  Synthetic

SEQ ID NO: 969 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIRDHMVLHEYVNAAGITEVERVARELEKAHRDLERDIRRVAEELKKLLKKLRDDRR

SEQ ID NO: 970 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLRDHMVLHEYVNAAGITEILKINEELNRKIIKFARENLERNRRVNKKVIEVLREAAR

SEQ ID NO: 971 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASRDHMVLHEYVNAAGITKLKRNLEDVRRVIEDVKRKSARILEEARRLIEEVERELEKIRK

SEQ ID NO: 972 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRDHMVLHEYVNAAGITERDAEREYKKLKDELEELTERYRREIRKLKEELKADRK

SEQ ID NO: 973 - protein, 242 aa, Artificial Sequence; identical to SEQ ID NO: 972
  Synthetic

SEQ ID NO: 974 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDRDHMVLHEYVNAAGITRLREEHEEVKRRLEEELTRLRETHKKIEKELREALKRVRDRST

SEQ ID NO: 975 - protein, 247 aa, Artificial Sequence; identical to SEQ ID NO: 974
  Synthetic

SEQ ID NO: 976 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVRDHMVLHEYVNAAGITRMIKRLHEDLERKLKESEDELREIEARLEEKIRRLEEKLERKRR

SEQ ID NO: 977 - protein, 248 aa, Artificial Sequence; identical to SEQ ID NO: 976
  Synthetic

SEQ ID NO: 978 - protein, 247 aa, Artificial Sequence
  Synthetic
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDRDHMVLHEYVNAAGITLLREVIKSHEKLVRTIERLIEESIRVNEELLEVIERLLDRARK

SEQ ID NO: 979 - protein, 239 aa, Artificial Sequence
  Synthetic
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTRDHMVLHEYVNAAGITLKKLLDDSARMAEEVKKTLKELLERSEKVAEDVRK

SEQ ID NO: 980 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTRDHMVLHEYVNAAGITKRRLKEVIDRYEDELRKLRKEYKEKIDKYERKLEEIERRERT

SEQ ID NO: 981 - protein, 246 aa, Artificial Sequence
  Synthetic
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSERDHMVLHEYVNAAGITNTRVIKEIIDLLRTVIRIHEKIVEDLIKLLEELLRRLEEATR

SEQ ID NO: 982 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKRDHMVLHEYVNAAGITRRVIEEAKRLLKEWRDRNKEVADTLKKLLEDLIRKIR

SEQ ID NO: 983 - protein, 241 aa, Artificial Sequence; identical to SEQ ID NO: 982
  Synthetic

SEQ ID NO: 984 - protein, 248 aa, Artificial Sequence
  Synthetic
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRRDHMVLHEYVNAAGITERSIESLERLLELILRVLEYSVASLEELLRRLLEVIKRIVDTTK

SEQ ID NO: 985 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSERDHMVLHEYVNAAGITVRRVLEELLKVLAEHLETVRELIERLKRVLEEAIEVVERVAR

SEQ ID NO: 986 - protein, 246 aa, Artificial Sequence; identical to SEQ ID NO: 985
  Synthetic

SEQ ID NO: 987 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVARDHMVLHEYVNAAGITNTDRLKEVIDRNLADLRDLAEELRAVIERLLEDARR

SEQ ID NO: 988 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRRDHMVLHEYVNAAGITKELEKLKRELERLLEESRRKLEKLKRDLERVLEETRR

SEQ ID NO: 989 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRDHMVLHEYVNAAGITLVRLNNEILERLLKIVRELHKDNIKILEDLLRIIEEVLR

SEQ ID NO: 990 - protein, 243 aa, Artificial Sequence; identical to SEQ ID NO: 989
  Synthetic

SEQ ID NO: 991 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDRDHMVLHEYVNAAGITILEEYRRLLEEIKRKLEEILRRVEELHRRLRRKLEEIDR

SEQ ID NO: 992 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNRDHMVLHEYVNAAGITRKLLEDVKKASEDIVREVERIVRELAKRSDEILKKLEDIVEKLRE

SEQ ID NO: 993 - protein, 249 aa, Artificial Sequence; identical to SEQ ID NO: 992
  Synthetic

SEQ ID NO: 994 - protein, 240 aa, Artificial Sequence
  Synthetic
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRDHMVLHEYVNAAGITDSRTNSEVVKRLLDLLREDSKANSEVVKRLLDVLRE

SEQ ID NO: 995 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRDHMVLHEYVNAAGITDVELNLDVAKKLLELLKEDSKLNLDVARELLELLDR

SEQ ID NO: 996 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALRDHMVLHEYVNAAGITITKDLEAKLEKLLRDLNELTKALEEELKRLLDELKKRTD

SEQ ID NO: 997 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRRDHMVLHEYVNAAGITYREEVRKSKDKLRSILEDYKRKVDELKERLRELIEEVET

SEQ ID NO: 998 - protein, 243 aa, Artificial Sequence; identical to SEQ ID NO: 997
  Synthetic

SEQ ID NO: 999 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRDHMVLHEYVNAAGITDLRRELEKLLRDYKRELEEIERALEEIEKTLKRRADETRR

SEQ ID NO: 1000 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRDHMVLHEYVNAAGITVERVARELEKAHRDLERDIRRVAEELKKLLKKLRDDRR

SEQ ID NO: 1001 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARDHMVLHEYVNAAGITILKINEELNRKIIKFARENLERNRRVNKKVIEVLREAAR

SEQ ID NO: 1002 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDRDHMVLHEYVNAAGITRTRYEELRRRLRKRVKDYEDKLREIEKKVRRDAERIEEELERAKK

SEQ ID NO: 1003 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASERDHMVLHEYVNAAGITLKRNLEDVRRVIEDVKRKSARILEEARRLIEEVERELEKIRK

SEQ ID NO: 1004 - protein, 247 aa, Artificial Sequence; identical to SEQ ID NO: 1003
  Synthetic

SEQ ID NO: 1005 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRRDHMVLHEYVNAAGITRDAEREYKKLKDELEELTERYRREIRKLKEELKADRK

SEQ ID NO: 1006 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKRDHMVLHEYVNAAGITLREEHEEVKRRLEEELTRLRETHKKIEKELREALKRVRDRST

SEQ ID NO: 1007 - protein, 247 aa, Artificial Sequence; identical to SEQ ID NO: 1006
  Synthetic

SEQ ID NO: 1008 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDRDHMVLHEYVNAAGITMIKRLHEDLERKLKESEDELREIEARLEEKIRRLEEKLERKRR

SEQ ID NO: 1009 - protein, 248 aa, Artificial Sequence; identical to SEQ ID NO: 1008
  Synthetic

SEQ ID NO: 1010 - protein, 247 aa, Artificial Sequence
  Synthetic
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERDHMVLHEYVNAAGITLREVIKSHEKLVRTIERLIEESIRVNEELLEVIERLLDRARK

SEQ ID NO: 1011 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGRDHMVLHEYVNAAGITRRLKEVIDRYEDELRKLRKEYKEKIDKYERKLEEIERRERT

SEQ ID NO: 1012 - protein, 246 aa, Artificial Sequence; identical to SEQ ID NO: 1011
  Synthetic

SEQ ID NO: 1013 - protein, 247 aa, Artificial Sequence
  Synthetic
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSERDHMVLHEYVNAAGITMKRVHDDLSRAVEKVVRDVVRVDKELLDELARILRRLEEVIT

SEQ ID NO: 1014 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIRDHMVLHEYVNAAGITRVIEEAKRLLKEWRDRNKEVADTLKKLLEDLIRKIR

SEQ ID NO: 1015 - protein, 241 aa, Artificial Sequence; identical to SEQ ID NO: 1014
  Synthetic

SEQ ID NO: 1016 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETRDHMVLHEYVNAAGITRRVLEELLKVLAEHLETVRELIERLKRVLEEAIEVVERVAR

SEQ ID NO: 1017 - protein, 240 aa, Artificial Sequence
  Synthetic
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKRDHMVLHEYVNAAGITTDRLKEVIDRNLADLRDLAEELRAVIERLLEDARR

SEQ ID NO: 1018 - protein, 240 aa, Artificial Sequence; identical to SEQ ID NO: 1017
  Synthetic

SEQ ID NO: 1019 - protein, 241 aa, Artificial Sequence
  Synthetic
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLRDHMVLHEYVNAAGITELEKLKRELERLLEESRRKLEKLKRDLERVLEETRR

SEQ ID NO: 1020 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRRDHMVLHEYVNAAGITVRLNNEILERLLKIVRELHKDNIKILEDLLRIIEEVLR

SEQ ID NO: 1021 - protein, 243 aa, Artificial Sequence; identical to SEQ ID NO: 1020
  Synthetic

SEQ ID NO: 1022 - protein, 247 aa, Artificial Sequence
  Synthetic
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDRDHMVLHEYVNAAGITLRKLLEDYERAVRRLEDKLRRVRERYEAVLKRIKDKLEETKR

SEQ ID NO: 1023 - protein, 247 aa, Artificial Sequence; identical to SEQ ID NO: 1022
  Synthetic

SEQ ID NO: 1024 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDRDHMVLHEYVNAAGITLEEYRRLLEEIKRKLEEILRRVEELHRRLRRKLEEIDR

SEQ ID NO: 1025 - protein, 243 aa, Artificial Sequence; identical to SEQ ID NO: 1024
  Synthetic

SEQ ID NO: 1026 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLRDHMVLHEYVNAAGITKLLEDVKKASEDIVREVERIVRELAKRSDEILKKLEDIVEKLRE

SEQ ID NO: 1027 - protein, 249 aa, Artificial Sequence; identical to SEQ ID NO: 1026
  Synthetic

SEQ ID NO: 1028 - protein, 240 aa, Artificial Sequence
  Synthetic
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRRDHMVLHEYVNAAGITVELNLDVAKKLLELLKEDSKLNLDVARELLELLDR

SEQ ID NO: 1029 - protein, 240 aa, Artificial Sequence; identical to SEQ ID NO: 1028
  Synthetic

SEQ ID NO: 1030 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALERDHMVLHEYVNAAGITTKDLEAKLEKLLRDLNELTKALEEELKRLLDELKKRTD

SEQ ID NO: 1031 - protein, 243 aa, Artificial Sequence; identical to SEQ ID NO: 1030
  Synthetic

SEQ ID NO: 1032 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKRDHMVLHEYVNAAGITREEVRKSKDKLRSILEDYKRKVDELKERLRELIEEVET

SEQ ID NO: 1033 - protein, 241 aa, Artificial Sequence
  Synthetic
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIRDHMVLHEYVNAAGITDIERLLAELEKLNEDVLRENKALLEDLERRVRERKK

SEQ ID NO: 1034 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDHMVLHEYVNAAGITLRRELEKLLRDYKRELEEIERALEEIEKTLKRRADETRR

SEQ ID NO: 1035 - protein, 245 aa, Artificial Sequence; identical to SEQ ID NO: 1034
  Synthetic

SEQ ID NO: 1036 - protein, 243 aa, Artificial Sequence
  Synthetic
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRRDHMVLHEYVNAAGITERVARELEKAHRDLERDIRRVAEELKKLLKKLRDDRR

SEQ ID NO: 1037 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARRDHMVLHEYVNAAGITLKINEELNRKIIKFARENLERNRRVNKKVIEVLREAAR

SEQ ID NO: 1038 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGRDHMVLHEYVNAAGITTRYEELRRRLRKRVKDYEDKLREIEKKVRRDAERIEEELERAKK

SEQ ID NO: 1039 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDRDHMVLHEYVNAAGITKRNLEDVRRVIEDVKRKSARILEEARRLIEEVERELEKIRK

SEQ ID NO: 1040 - protein, 247 aa, Artificial Sequence; identical to SEQ ID NO: 1039
  Synthetic

SEQ ID NO: 1041 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLRDHMVLHEYVNAAGITDAEREYKKLKDELEELTERYRREIRKLKEELKADRK

SEQ ID NO: 1042 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDRDHMVLHEYVNAAGITREEHEEVKRRLEEELTRLRETHKKIEKELREALKRVRDRST

SEQ ID NO: 1043 - protein, 247 aa, Artificial Sequence; identical to SEQ ID NO: 1042
  Synthetic

SEQ ID NO: 1044 - protein, 248 aa, Artificial Sequence
  Synthetic
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPERDHMVLHEYVNAAGITLDENLKMVERLIRELEKVLDDHERKVRRLIEELLEVLDRDAK

SEQ ID NO: 1045 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDERDHMVLHEYVNAAGITIKRLHEDLERKLKESEDELREIEARLEEKIRRLEEKLERKRR

SEQ ID NO: 1046 - protein, 248 aa, Artificial Sequence; identical to SEQ ID NO: 1045
  Synthetic

SEQ ID NO: 1047 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSRDHMVLHEYVNAAGITREKHAEIAKELERLLRENRRRLEELAREAKKVLDELRKRLEDERR

SEQ ID NO: 1048 - protein, 246 aa, Artificial Sequence
  Synthetic
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEARDHMVLHEYVNAAGITRVIKEIIDLLRTVIRIHEKIVEDLIKLLEELLRRLEEATR

SEQ ID NO: 1049 - protein, 241 aa, Artificial Sequence
  Synthetic
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIRDHMVLHEYVNAAGITVIEEAKRLLKEWRDRNKEVADTLKKLLEDLIRKIR

SEQ ID NO: 1050 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETARDHMVLHEYVNAAGITRVLEELLKVLAEHLETVRELIERLKRVLEEAIEVVERVAR

SEQ ID NO: 1051 - protein, 246 aa, Artificial Sequence; identical to SEQ ID NO: 1050
  Synthetic

SEQ ID NO: 1052 - protein, 245 aa, Artificial Sequence
  Synthetic
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKERDHMVLHEYVNAAGITIRELLKEIEKIVKEIIELLERLNDELRKIIEAILETTKK

SEQ ID NO: 1053 - protein, 247 aa, Artificial Sequence
  Synthetic
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGRDHMVLHEYVNAAGITRKLLEDYERAVRRLEDKLRRVRERYEAVLKRIKDKLEETKR

SEQ ID NO: 1054 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDERDHMVLHEYVNAAGITEEYRRLLEEIKRKLEEILRRVEELHRRLRRKLEEIDR

SEQ ID NO: 1055 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDRDHMVLHEYVNAAGITLLEDVKKASEDIVREVERIVRELAKRSDEILKKLEDIVEKLRE

SEQ ID NO: 1056 - protein, 249 aa, Artificial Sequence; identical to SEQ ID NO: 1055
  Synthetic

SEQ ID NO: 1057 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEERDHMVLHEYVNAAGITKDLEAKLEKLLRDLNELTKALEEELKRLLDELKKRTD

SEQ ID NO: 1058 - protein, 243 aa, Artificial Sequence; identical to SEQ ID NO: 1057
  Synthetic

SEQ ID NO: 1059 - protein, 243 aa, Artificial Sequence
  Synthetic
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIRDHMVLHEYVNAAGITEEVRKSKDKLRSILEDYKRKVDELKERLRELIEEVET

SEQ ID NO: 1060 - protein, 243 aa, Artificial Sequence; identical to SEQ ID NO: 1059
  Synthetic

SEQ ID NO: 1061 - protein, 241 aa, Artificial Sequence
  Synthetic
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERDHMVLHEYVNAAGITIERLLAELEKLNEDVLRENKALLEDLERRVRERKK

SEQ ID NO: 1062 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRRDHMVLHEYVNAAGITRRELEKLLRDYKRELEEIERALEEIEKTLKRRADETRR

SEQ ID NO: 1063 - protein, 245 aa, Artificial Sequence; identical to SEQ ID NO: 1062
  Synthetic

SEQ ID NO: 1064 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLRDHMVLHEYVNAAGITKINEELNRKIIKFARENLERNRRVNKKVIEVLREAAR

SEQ ID NO: 1065 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPRDHMVLHEYVNAAGITRYEELRRRLRKRVKDYEDKLREIEKKVRRDAERIEEELERAKK

SEQ ID NO: 1066 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLRDHMVLHEYVNAAGITRNLEDVRRVIEDVKRKSARILEEARRLIEEVERELEKIRK

SEQ ID NO: 1067 - protein, 247 aa, Artificial Sequence; identical to SEQ ID NO: 1066
  Synthetic

SEQ ID NO: 1068 - protein, 242 aa, Artificial Sequence
  Synthetic
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLRRDHMVLHEYVNAAGITAEREYKKLKDELEELTERYRREIRKLKEELKADRK

SEQ ID NO: 1069 - protein, 242 aa, Artificial Sequence; identical to SEQ ID NO: 1068
  Synthetic

SEQ ID NO: 1070 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDERDHMVLHEYVNAAGITEEHEEVKRRLEEELTRLRETHKKIEKELREALKRVRDRST

SEQ ID NO: 1071 - protein, 247 aa, Artificial Sequence; identical to SEQ ID NO: 1070
  Synthetic

SEQ ID NO: 1072 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKRDHMVLHEYVNAAGITKRLHEDLERKLKESEDELREIEARLEEKIRRLEEKLERKRR

SEQ ID NO: 1073 - protein, 248 aa, Artificial Sequence; identical to SEQ ID NO: 1072
  Synthetic

SEQ ID NO: 1074 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSERDHMVLHEYVNAAGITEKHAEIAKELERLLRENRRRLEELAREAKKVLDELRKRLEDERR

SEQ ID NO: 1075 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDRDHMVLHEYVNAAGITLKEVIDRYEDELRKLRKEYKEKIDKYERKLEEIERRERT

SEQ ID NO: 1076 - protein, 245 aa, Artificial Sequence
  Synthetic
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRDHMVLHEYVNAAGITLEDVKRAITELRKNSKDILEEVRKLIDELRKRIKEVED

SEQ ID NO: 1077 - protein, 247 aa, Artificial Sequence
  Synthetic
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVRDHMVLHEYVNAAGITRVHDDLSRAVEKVVRDVVRVDKELLDELARILRRLEEVIT

SEQ ID NO: 1078 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIARDHMVLHEYVNAAGITLNNEILERLLKIVRELHKDNIKILEDLLRIIEEVLR

SEQ ID NO: 1079 - protein, 243 aa, Artificial Sequence; identical to SEQ ID NO: 1078
  Synthetic

SEQ ID NO: 1080 - protein, 245 aa, Artificial Sequence
  Synthetic
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDRDHMVLHEYVNAAGITRELLKEIEKIVKEIIELLERLNDELRKIIEAILETTKK

SEQ ID NO: 1081 - protein, 247 aa, Artificial Sequence
  Synthetic
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTRDHMVLHEYVNAAGITKLLEDYERAVRRLEDKLRRVRERYEAVLKRIKDKLEETKR

SEQ ID NO: 1082 - protein, 247 aa, Artificial Sequence; identical to SEQ ID NO: 1081
  Synthetic

SEQ ID NO: 1083 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVRDHMVLHEYVNAAGITEYRRLLEEIKRKLEEILRRVEELHRRLRRKLEEIDR

SEQ ID NO: 1084 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDERDHMVLHEYVNAAGITLEDVKKASEDIVREVERIVRELAKRSDEILKKLEDIVEKLRE

SEQ ID NO: 1085 - protein, 249 aa, Artificial Sequence; identical to SEQ ID NO: 1084
  Synthetic

SEQ ID NO: 1086 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARDHMVLHEYVNAAGITDLEAKLEKLLRDLNELTKALEEELKRLLDELKKRTD

SEQ ID NO: 1087 - protein, 243 aa, Artificial Sequence; identical to SEQ ID NO: 1086
  Synthetic

SEQ ID NO: 1088 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDRDHMVLHEYVNAAGITRELEKLLRDYKRELEEIERALEEIEKTLKRRADETRR

SEQ ID NO: 1089 - protein, 245 aa, Artificial Sequence; identical to SEQ ID NO: 1088
  Synthetic

SEQ ID NO: 1090 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLRDHMVLHEYVNAAGITINEELNRKIIKFARENLERNRRVNKKVIEVLREAAR

SEQ ID NO: 1091 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDRDHMVLHEYVNAAGITYEELRRRLRKRVKDYEDKLREIEKKVRRDAERIEEELERAKK

SEQ ID NO: 1092 - protein, 250 aa, Artificial Sequence; identical to SEQ ID NO: 1091
  Synthetic

SEQ ID NO: 1093 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRDHMVLHEYVNAAGITNLEDVRRVIEDVKRKSARILEEARRLIEEVERELEKIRK

SEQ ID NO: 1094 - protein, 247 aa, Artificial Sequence; identical to SEQ ID NO: 1093
  Synthetic

SEQ ID NO: 1095 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEARDHMVLHEYVNAAGITEHEEVKRRLEEELTRLRETHKKIEKELREALKRVRDRST

SEQ ID NO: 1096 - protein, 247 aa, Artificial Sequence; identical to SEQ ID NO: 1095
  Synthetic

SEQ ID NO: 1097 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIRDHMVLHEYVNAAGITRLHEDLERKLKESEDELREIEARLEEKIRRLEEKLERKRR

SEQ ID NO: 1098 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESRDHMVLHEYVNAAGITKHAEIAKELERLLRENRRRLEELAREAKKVLDELRKRLEDERR

SEQ ID NO: 1099 - protein, 247 aa, Artificial Sequence
  Synthetic
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVERDHMVLHEYVNAAGITVIKSHEKLVRTIERLIEESIRVNEELLEVIERLLDRARK

SEQ ID NO: 1100 - protein, 243 aa, Artificial Sequence
  Synthetic
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELERDHMVLHEYVNAAGITLKKELERIKREVKRLIEENARTLADIKRAVDEARK

SEQ ID NO: 1101 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKRDHMVLHEYVNAAGITKEVIDRYEDELRKLRKEYKEKIDKYERKLEEIERRERT

SEQ ID NO: 1102 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRRDHMVLHEYVNAAGITLEELLKVLAEHLETVRELIERLKRVLEEAIEVVERVAR

SEQ ID NO: 1103 - protein, 252 aa, Artificial Sequence
  Synthetic
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDRDHMVLHEYVNAAGITRLLDELEEVHKRVKKELEDIIEENRRVVKRVRDELREIKRELDE

SEQ ID NO: 1104 - protein, 243 aa, Artificial Sequence
  Synthetic
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIRDHMVLHEYVNAAGITNNEILERLLKIVRELHKDNIKILEDLLRIIEEVLR

SEQ ID NO: 1105 - protein, 243 aa, Artificial Sequence; identical to SEQ ID NO: 1104
  Synthetic

SEQ ID NO: 1106 - protein, 243 aa, Artificial Sequence
  Synthetic
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVERDHMVLHEYVNAAGITYRRLLEEIKRKLEEILRRVEELHRRLRRKLEEIDR

SEQ ID NO: 1107 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDRDHMVLHEYVNAAGITEDVKKASEDIVREVERIVRELAKRSDEILKKLEDIVEKLRE

SEQ ID NO: 1108 - protein, 249 aa, Artificial Sequence; identical to SEQ ID NO: 1107
  Synthetic

SEQ ID NO: 1109 - protein, 243 aa, Artificial Sequence
  Synthetic
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRDHMVLHEYVNAAGITLEAKLEKLLRDLNELTKALEEELKRLLDELKKRTD

SEQ ID NO: 1110 - protein, 243 aa, Artificial Sequence; identical to SEQ ID NO: 1109
  Synthetic

SEQ ID NO: 1111 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLRDHMVLHEYVNAAGITELEKLLRDYKRELEEIERALEEIEKTLKRRADETRR

SEQ ID NO: 1112 - protein, 244 aa, Artificial Sequence
  Synthetic
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKRDHMVLHEYVNAAGITNEELNRKIIKFARENLERNRRVNKKVIEVLREAAR

SEQ ID NO: 1113 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDERDHMVLHEYVNAAGITEELRRRLRKRVKDYEDKLREIEKKVRRDAERIEEELERAKK

SEQ ID NO: 1114 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERDHMVLHEYVNAAGITHEEVKRRLEEELTRLRETHKKIEKELREALKRVRDRST

SEQ ID NO: 1115 - protein, 247 aa, Artificial Sequence; identical to SEQ ID NO: 1114
  Synthetic

SEQ ID NO: 1116 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIARDHMVLHEYVNAAGITLHEDLERKLKESEDELREIEARLEEKIRRLEEKLERKRR

SEQ ID NO: 1117 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESERDHMVLHEYVNAAGITHAEIAKELERLLRENRRRLEELAREAKKVLDELRKRLEDERR

SEQ ID NO: 1118 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKARDHMVLHEYVNAAGITEVIDRYEDELRKLRKEYKEKIDKYERKLEEIERRERT

SEQ ID NO: 1119 - protein, 247 aa, Artificial Sequence
  Synthetic
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVERDHMVLHEYVNAAGITHDDLSRAVEKVVRDVVRVDKELLDELARILRRLEEVIT

SEQ ID NO: 1120 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRARDHMVLHEYVNAAGITEELLKVLAEHLETVRELIERLKRVLEEAIEVVERVAR

SEQ ID NO: 1121 - protein, 252 aa, Artificial Sequence
  Synthetic
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERDHMVLHEYVNAAGITLLDELEEVHKRVKKELEDIIEENRRVVKRVRDELREIKRELDE

SEQ ID NO: 1122 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVRDHMVLHEYVNAAGITDVKKASEDIVREVERIVRELAKRSDEILKKLEDIVEKLRE

SEQ ID NO: 1123 - protein, 249 aa, Artificial Sequence; identical to SEQ ID NO: 1122
  Synthetic

SEQ ID NO: 1124 - protein, 245 aa, Artificial Sequence
  Synthetic
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTRDHMVLHEYVNAAGITLEKLLRDYKRELEEIERALEEIEKTLKRRADETRR

SEQ ID NO: 1125 - protein, 245 aa, Artificial Sequence; identical to SEQ ID NO: 1124
  Synthetic

SEQ ID NO: 1126 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVRDHMVLHEYVNAAGITELRRRLRKRVKDYEDKLREIEKKVRRDAERIEEELERAKK

SEQ ID NO: 1127 - protein, 250 aa, Artificial Sequence; identical to SEQ ID NO: 1126
  Synthetic

SEQ ID NO: 1128 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKRDHMVLHEYVNAAGITEDVRRVIEDVKRKSARILEEARRLIEEVERELEKIRK

SEQ ID NO: 1129 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRDHMVLHEYVNAAGITEEVKRRLEEELTRLRETHKKIEKELREALKRVRDRST

SEQ ID NO: 1130 - protein, 247 aa, Artificial Sequence; identical to SEQ ID NO: 1129
  Synthetic

SEQ ID NO: 1131 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAERDHMVLHEYVNAAGITHEDLERKLKESEDELREIEARLEEKIRRLEEKLERKRR

SEQ ID NO: 1132 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEERDHMVLHEYVNAAGITAEIAKELERLLRENRRRLEELAREAKKVLDELRKRLEDERR

SEQ ID NO: 1133 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVRDHMVLHEYVNAAGITVIDRYEDELRKLRKEYKEKIDKYERKLEEIERRERT

SEQ ID NO: 1134 - protein, 246 aa, Artificial Sequence
  Synthetic
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELRDHMVLHEYVNAAGITEIIDLLRTVIRIHEKIVEDLIKLLEELLRRLEEATR

SEQ ID NO: 1135 - protein, 246 aa, Artificial Sequence
  Synthetic
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIRDHMVLHEYVNAAGITELLKVLAEHLETVRELIERLKRVLEEAIEVVERVAR

SEQ ID NO: 1136 - protein, 246 aa, Artificial Sequence; identical to SEQ ID NO: 1135
  Synthetic

SEQ ID NO: 1137 - protein, 252 aa, Artificial Sequence
  Synthetic
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERRDHMVLHEYVNAAGITLDELEEVHKRVKKELEDIIEENRRVVKRVRDELREIKRELDE

SEQ ID NO: 1138 - protein, 247 aa, Artificial Sequence
  Synthetic
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDRDHMVLHEYVNAAGITEDYERAVRRLEDKLRRVRERYEAVLKRIKDKLEETKR

SEQ ID NO: 1139 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRDHMVLHEYVNAAGITVKKASEDIVREVERIVRELAKRSDEILKKLEDIVEKLRE

SEQ ID NO: 1140 - protein, 249 aa, Artificial Sequence; identical to SEQ ID NO: 1139
  Synthetic

SEQ ID NO: 1141 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRDHMVLHEYVNAAGITLRRRLRKRVKDYEDKLREIEKKVRRDAERIEEELERAKK

SEQ ID NO: 1142 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKARDHMVLHEYVNAAGITDVRRVIEDVKRKSARILEEARRLIEEVERELEKIRK

SEQ ID NO: 1143 - protein, 247 aa, Artificial Sequence; identical to SEQ ID NO: 1142
  Synthetic

SEQ ID NO: 1144 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRDHMVLHEYVNAAGITEVKRRLEEELTRLRETHKKIEKELREALKRVRDRST

SEQ ID NO: 1145 - protein, 247 aa, Artificial Sequence; identical to SEQ ID NO: 1144
  Synthetic

SEQ ID NO: 1146 - protein, 246 aa, Artificial Sequence
  Synthetic
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVERDHMVLHEYVNAAGITIDRYEDELRKLRKEYKEKIDKYERKLEEIERRERT

SEQ ID NO: 1147 - protein, 252 aa, Artificial Sequence
  Synthetic
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTRDHMVLHEYVNAAGITDELEEVHKRVKKELEDIIEENRRVVKRVRDELREIKRELDE

SEQ ID NO: 1148 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRRDHMVLHEYVNAAGITKKASEDIVREVERIVRELAKRSDEILKKLEDIVEKLRE

SEQ ID NO: 1149 - protein, 249 aa, Artificial Sequence; identical to SEQ ID NO: 1148
  Synthetic

SEQ ID NO: 1150 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRDHMVLHEYVNAAGITRRRLRKRVKDYEDKLREIEKKVRRDAERIEEELERAKK

SEQ ID NO: 1151 - protein, 250 aa, Artificial Sequence; identical to SEQ ID NO: 1150
  Synthetic

SEQ ID NO: 1152 - protein, 247 aa, Artificial Sequence
  Synthetic
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKRDHMVLHEYVNAAGITVRRVIEDVKRKSARILEEARRLIEEVERELEKIRK

SEQ ID NO: 1153 - protein, 247 aa, Artificial Sequence
  Synthetic
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRDHMVLHEYVNAAGITVKRRLEEELTRLRETHKKIEKELREALKRVRDRST

SEQ ID NO: 1154 - protein, 247 aa, Artificial Sequence; identical to SEQ ID NO: 1153
  Synthetic

SEQ ID NO: 1155 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIRDHMVLHEYVNAAGITDLERKLKESEDELREIEARLEEKIRRLEEKLERKRR

SEQ ID NO: 1156 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDHMVLHEYVNAAGITIAKELERLLRENRRRLEELAREAKKVLDELRKRLEDERR

SEQ ID NO: 1157 - protein, 247 aa, Artificial Sequence
  Synthetic
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRDHMVLHEYVNAAGITLSRAVEKVVRDVVRVDKELLDELARILRRLEEVIT

SEQ ID NO: 1158 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRARDHMVLHEYVNAAGITKASEDIVREVERIVRELAKRSDEILKKLEDIVEKLRE

SEQ ID NO: 1159 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRRDHMVLHEYVNAAGITRRLRKRVKDYEDKLREIEKKVRRDAERIEEELERAKK

SEQ ID NO: 1160 - protein, 248 aa, Artificial Sequence
  Synthetic
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERDHMVLHEYVNAAGITLERKLKESEDELREIEARLEEKIRRLEEKLERKRR

SEQ ID NO: 1161 - protein, 248 aa, Artificial Sequence; identical to SEQ ID NO: 1160
  Synthetic

SEQ ID NO: 1162 - protein, 252 aa, Artificial Sequence
  Synthetic
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLRRDHMVLHEYVNAAGITLEEVHKRVKKELEDIIEENRRVVKRVRDELREIKRELDE

SEQ ID NO: 1163 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALRDHMVLHEYVNAAGITASEDIVREVERIVRELAKRSDEILKKLEDIVEKLRE

SEQ ID NO: 1164 - protein, 249 aa, Artificial Sequence; identical to SEQ ID NO: 1163
  Synthetic

SEQ ID NO: 1165 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLRDHMVLHEYVNAAGITRLRKRVKDYEDKLREIEKKVRRDAERIEEELERAKK

SEQ ID NO: 1166 - protein, 250 aa, Artificial Sequence; identical to SEQ ID NO: 1165
  Synthetic

SEQ ID NO: 1167 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDRDHMVLHEYVNAAGITKELERLLRENRRRLEELAREAKKVLDELRKRLEDERR

SEQ ID NO: 1168 - protein, 249 aa, Artificial Sequence
  Synthetic
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALERDHMVLHEYVNAAGITSEDIVREVERIVRELAKRSDEILKKLEDIVEKLRE

SEQ ID NO: 1169 - protein, 249 aa, Artificial Sequence; identical to SEQ ID NO: 1168
  Synthetic

SEQ ID NO: 1170 - protein, 250 aa, Artificial Sequence
  Synthetic
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLERDHMVLHEYVNAAGITLRKRVKDYEDKLREIEKKVRRDAERIEEELERAKK

SEQ ID NO: 1171 - protein, 250 aa, Artificial Sequence; identical to SEQ ID NO: 1170
  Synthetic

SEQ ID NO: 1172 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTRDHMVLHEYVNAAGITELERLLRENRRRLEELAREAKKVLDELRKRLEDERR

SEQ ID NO: 1173 - protein, 252 aa, Artificial Sequence
  Synthetic
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVRDHMVLHEYVNAAGITEVHKRVKKELEDIIEENRRVVKRVRDELREIKRELDE

SEQ ID NO: 1174 - protein, 251 aa, Artificial Sequence
  Synthetic
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTERDHMVLHEYVNAAGITLERLLRENRRRLEELAREAKKVLDELRKRLEDERR

SEQ ID NO: 1175 - protein, 186 aa, Artificial Sequence
  Synthetic
SAEDSIRELLERDERLLEEARKEAKRLNEENERRDHMVLHEYVNAAGITKRLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 1176 - protein, 181 aa, Artificial Sequence
  Synthetic
SRVERLSAEIKKLIDENRRVAEELLRELEKLLKRDHMVLHEYVNAAGITSRKLEELARAGAPEEDIRRLVEESKELIKRLLRDIERTTREINEVIKRVVETIRRTTDEINRRIEELVRKIDRGEAREDMDRLVRENERLLKKVEDDLRKLSEENKRLVDRARERLARLLEENERLVDERRK

SEQ ID NO: 1177 - protein, 182 aa, Artificial Sequence
  Synthetic
RVEDALRKLLDDVRRLVEEAERRLRTSNDKSRRRDHMVLHEYVNAAGITEKLVRDVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 1178 - protein, 183 aa, Artificial Sequence
  Synthetic
KVEKRLTDLLKTVADEVKRVEDELRETVRESKERDHMVLHEYVNAAGITEKTVKDAERRVSEDLVRRIRKVLDENREVNDRVVKEDERILEENERVNRKVVEKIRDILRKIEEVVRRAAEEIRDEEVVKKVEKEIRELLERLKEEADRVRERSKKILTDLKKSSEDVKRESERMLKKLEDEIR

SEQ ID NO: 1179 - protein, 184 aa, Artificial Sequence
  Synthetic
SLEEVIKTVRKLLEEVERRLREVVERAERMLEERDHMVLHEYVNAAGITKDVEKALRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 1180 - protein, 177 aa, Artificial Sequence
  Synthetic
KEEEDLEREVKRLEDKVREDAKKLEEVVKTVEKRDHMVLHEYVNAAGITADRVRRLTERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 1181 - protein, 175 aa, Artificial Sequence
  Synthetic
SELEKVVDDVRRRLDRLLETSEKLLEDATKRLKRDHMVLHEYVNAAGITLERLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 1182 - protein, 180 aa, Artificial Sequence
  Synthetic
SKEEVLREIERLHKETIRRIEEVLREATELHKRRDHMVLHEYVNAAGITREVIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 1183 - protein, 187 aa, Artificial Sequence
  Synthetic
SEKERLKEELEKLSKEIEDILRDDKRSDDELRRRDHMVLHEYVNAAGITNEELKRMLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 1184 - protein, 177 aa, Artificial Sequence
  Synthetic
SAIEKVKEVVERVLETVRDSVRRSHEESKRLIDRDHMVLHEYVNAAGITIERVRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 1185 - protein, 177 aa, Artificial Sequence
  Synthetic
SVLEEVRRRVEELLKTVKESVDRSHERSERLIERDHMVLHEYVNAAGITVERVREKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 1186 - protein, 183 aa, Artificial Sequence
  Synthetic
KDAEDLERRVRELVEENNRVSKRLAEEVTRLVKRDHMVLHEYVNAAGITAKELLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 1187 - protein, 183 aa, Artificial Sequence
  Synthetic
SEIEKLVEDVRKLVEDNLRHSEEVHRRNRRLIERDHMVLHEYVNAAGITVEELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1188 - protein, 181 aa, Artificial Sequence
  Synthetic
EEIERALREMRELSRTHKELVEKILRDIAELAKRDHMVLHEYVNAAGITIDEIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 1189 - protein, 174 aa, Artificial Sequence
  Synthetic
SEIEELEKRIDELLKELRDLSRRIAEEVKRLLERDHMVLHEYVNAAGITLERLKRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 1190 - protein, 174 aa, Artificial Sequence
  Synthetic
REIEEAAKDLDRLLEENKKLVKEVEEELRRLLKRDHMVLHEYVNAAGITLEELRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 1191 - protein, 178 aa, Artificial Sequence
  Synthetic
SEIERIERENDRLNEENKKITEDIERELKRLLERDHMVLHEYVNAAGITLRELRKRNGGREEVLKEVEDRLRRIVEEIRRSDKRLEDIAREVKKRIRESDEELRRVSEEITRRLRKVRDEKTLRELLKRSEELSKENKDRLKKLLDDLREVSKKNKEDLKRLLREVREVARKVKERAN

SEQ ID NO: 1192 - protein, 182 aa, Artificial Sequence
  Synthetic
DEIETVLDEVRRLHEDAKRRLEEMIDEVRKLNERDHMVLHEYVNAAGITLRTVKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 1193 - protein, 174 aa, Artificial Sequence
  Synthetic
EELERILDKVRKVIEEVRKRLRDDLRTVEKVLKRDHMVLHEYVNAAGITLERVEEAARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 1194 - protein, 178 aa, Artificial Sequence
  Synthetic
SSKDEIRRRVEEVVERSDEIVKRSREHVKTVVDRDHMVLHEYVNAAGITVKKLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 1195 - protein, 182 aa, Artificial Sequence
  Synthetic
SDADRVAEELKKLVEDSRRENERVIEESKRLVKRDHMVLHEYVNAAGITVDKLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 1196 - protein, 182 aa, Artificial Sequence
  Synthetic
DEVDELLKRLRKLVDEVRKENDKMVKESKRLVERDHMVLHEYVNAAGITLEELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 1197 - protein, 175 aa, Artificial Sequence
  Synthetic
SEVDEVLREAKRIVDEVHKDNERATEESRRLVKRDHMVLHEYVNAAGITVKEVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1198 - protein, 175 aa, Artificial Sequence
  Synthetic
SEMDDVLKKLAETVKRIIERLKKLTDDSRRLVERDHMVLHEYVNAAGITVRKAEERNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 1199 - protein, 186 aa, Artificial Sequence
  Synthetic
SEVDEVRKTLEDLLRRLDEENKDIIRRNKELLDRDHMVLHEYVNAAGITLDELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1200 - protein, 186 aa, Artificial Sequence
  Synthetic
SRVDEVIERLERLLRELDKINRDMIEDDKRLNTRDHMVLHEYVNAAGITLEELEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 1201 - protein, 176 aa, Artificial Sequence
  Synthetic
REAEEAKEEVEELNRRNKKELDDARRRVDELDKRDHMVLHEYVNAAGITVEELERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 1202 - protein, 179 aa, Artificial Sequence
  Synthetic
REAEEVERKVEELNRRNRKVLDDARKESEEVVRRDHMVLHEYVNAAGITLRELDKRKRDGTSEEVIKRLIDRVRKILEDIRRLVDELIKRNERIVEKLTRIVEELIRRNKKLLEDIRRELVKVDEVLRRLAEDIERSIRELEKVLRELERIHRELIKELKEVLKRLEKDAKEVIERLRT

SEQ ID NO: 1203 - protein, 174 aa, Artificial Sequence
  Synthetic
SEEEVLREAAKTVEKLLDEIRRSLEKVSKRVEDRDHMVLHEYVNAAGITRELLEELRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 1204 - protein, 183 aa, Artificial Sequence
  Synthetic
RVDERLDTVLKRVEETVRENKKKNDELLERSKERDHMVLHEYVNAAGITRREAEKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 1205 - protein, 183 aa, Artificial Sequence
  Synthetic
SVDERLDEVLERVKEDMDRNRRKNDESLREDEERDHMVLHEYVNAAGITEERVRELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 1206 - protein, 174 aa, Artificial Sequence
  Synthetic
SESDEVIRDLARLLDELARHVDDSVRRMDEVVKRDHMVLHEYVNAAGITVKEVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1207 - protein, 172 aa, Artificial Sequence
  Synthetic
SRAETVLKEVTDKIKKLADSSDELLRRNKENIDRDHMVLHEYVNAAGITIEEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 1208 - protein, 176 aa, Artificial Sequence
  Synthetic
SVDEVLKEIEDALRRLKEEVERVLKENEDELRRRDHMVLHEYVNAAGITESLKRGVGESDEVDRVVDEIAKLSAEILEKVKKVVKEIRDSLETVKRRVDDVVRRLKELLDEIKRGSDEKAIRDVAKEIRDRLKELEEEIEEVTRRNLKLLADVEEEIRRVHEKTRRLLETVLRRAT

SEQ ID NO: 1209 - protein, 186 aa, Artificial Sequence
  Synthetic
SEVDEIIKELERLLAEIARENERIIRESRKLADRDHMVLHEYVNAAGITVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 1210 - protein, 181 aa, Artificial Sequence
  Synthetic
SEVDDVLRRLEELIKTLEDINAKSLEDIKKLIDRDHMVLHEYVNAAGITIRELREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 1211 - protein, 181 aa, Artificial Sequence; identical to SEQ ID NO: 1210
  Synthetic

SEQ ID NO: 1212 - protein, 234 aa, Artificial Sequence
  Synthetic
SAKETIRKLIEENKDIIRKLAEKLKRLLEESERRDHMVLHEYVNAAGITERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLEEKIRKIKRELDDLSARLREKIERTRK

SEQ ID NO: 1213 - protein, 244 aa, Artificial Sequence
  Synthetic
SAEETLRRITEESKRVLEEITKKYEDLERESRERDHMVLHEYVNAAGITEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 1214 - protein, 238 aa, Artificial Sequence
  Synthetic
SEAEKIREALETNLRLLEELIKRLKEILDTHNERDHMVLHEYVNAAGITLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1215 - protein, 238 aa, Artificial Sequence; identical to SEQ ID NO: 1214
  Synthetic

SEQ ID NO: 1216 - protein, 242 aa, Artificial Sequence
  Synthetic
SEKERLMRLLDKLKDLNRRLVERIKELLDKALERDHMVLHEYVNAAGITKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 1217 - protein, 242 aa, Artificial Sequence; identical to SEQ ID NO: 1216
  Synthetic

SEQ ID NO: 1218 - protein, 247 aa, Artificial Sequence
  Synthetic
SEAEDLEELIKELAELLKDVIRKLEKINRRLVKRDHMVLHEYVNAAGITEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 1219 - protein, 240 aa, Artificial Sequence
  Synthetic
SDKEEIKRRVEKTARDLETEHDKIKKRLEDTVRRDHMVLHEYVNAAGITLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1220 - protein, 240 aa, Artificial Sequence; identical to SEQ ID NO: 1219
  Synthetic

SEQ ID NO: 1221 - protein, 248 aa, Artificial Sequence
  Synthetic
DEEERVKKLLTDLRRLLRKLHEESKKLLDELRKRDHMVLHEYVNAAGITERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 1222 - protein, 238 aa, Artificial Sequence
  Synthetic
DADELLRRLAEEVERVIREAEDLLRRWKETIKKRDHMVLHEYVNAAGITEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 1223 - protein, 238 aa, Artificial Sequence; identical to SEQ ID NO: 1222
  Synthetic

SEQ ID NO: 1224 - protein, 231 aa, Artificial Sequence
  Synthetic
DKAEVLREALKLLKDLLEELIKIHEESLKRILDRDHMVLHEYVNAAGITKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 1225 - protein, 236 aa, Artificial Sequence
  Synthetic
STREKAKKVLDTLRADNEDMKRVVEKILRALKRRDHMVLHEYVNAAGITKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1226 - protein, 236 aa, Artificial Sequence; identical to SEQ ID NO: 1225
  Synthetic

SEQ ID NO: 1227 - protein, 247 aa, Artificial Sequence
  Synthetic
SKAEKLLKDLREALEKVKRRYEELERRLDEVLKRDHMVLHEYVNAAGITLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 1228 - protein, 246 aa, Artificial Sequence
  Synthetic
KEIEETLKELEDLNREMVETNRRVLEETRRLNKRDHMVLHEYVNAAGITLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 1229 - protein, 231 aa, Artificial Sequence
  Synthetic
SKEEEVEKVLRKWEEILRRLIEENKRANDKIRRRDHMVLHEYVNAAGITKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1230 - protein, 245 aa, Artificial Sequence
  Synthetic
DEDELIRKLLEDLKDIVRKILELIERDLRDIERRDHMVLHEYVNAAGITKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKNSKDILEEVRKLIDELRKRIKEVED

SEQ ID NO: 1231 - protein, 231 aa, Artificial Sequence
  Synthetic
SKDEELARLLEELVERWRKIVEDLERDHRRLVKRDHMVLHEYVNAAGITVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1232 - protein, 238 aa, Artificial Sequence
  Synthetic
SEIEDVIRRLRKILEDLERVSEKLLREIKKILDRDHMVLHEYVNAAGITLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 1233 - protein, 238 aa, Artificial Sequence; identical to SEQ ID NO: 1232
  Synthetic

SEQ ID NO: 1234 - protein, 246 aa, Artificial Sequence
  Synthetic
SREEIVATLEDLARKILEVVKKLAKEIEDAWRERDHMVLHEYVNAAGITREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRIHEKIVEDLIKLLEELLRRLEEATR

SEQ ID NO: 1235 - protein, 237 aa, Artificial Sequence
  Synthetic
KEKEDALKKLEDLARKSREDLERVLRKHKKILDRDHMVLHEYVNAAGITVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1236 - protein, 229 aa, Artificial Sequence
  Synthetic
SKEERLREVAEKHKKDLEDIVKRVDEAAKETARRDHMVLHEYVNAAGITLDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1237 - protein, 241 aa, Artificial Sequence
  Synthetic
SEKELLKEILDRIRELLEDDNRLLKRIVDEIRKRDHMVLHEYVNAAGITKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 1238 - protein, 240 aa, Artificial Sequence
  Synthetic
DREKSVRDIEEDLKRVLDKLRRRVETSKEELKKRDHMVLHEYVNAAGITRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1239 - protein, 252 aa, Artificial Sequence
  Synthetic
SLEEITKRLLELVEENLARHEEILRELLELAKRRDHMVLHEYVNAAGITEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 1240 - protein, 237 aa, Artificial Sequence
  Synthetic
REDEVLRDIERLLREIEEKIRRILEESTAELRKRDHMVLHEYVNAAGITKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1241 - protein, 237 aa, Artificial Sequence; identical to SEQ ID NO: 1240
  Synthetic

SEQ ID NO: 1242 - protein, 243 aa, Artificial Sequence
  Synthetic
SEAERLADEVRKAVKKSEEDNETLVREVEKAVRRDHMVLHEYVNAAGITMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1243 - protein, 243 aa, Artificial Sequence; identical to SEQ ID NO: 1242
  Synthetic

SEQ ID NO: 1244 - protein, 245 aa, Artificial Sequence
  Synthetic
SEKDEVTRRIRELLKEAEETNREAIERIKRLLDRDHMVLHEYVNAAGITLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1245 - protein, 239 aa, Artificial Sequence
  Synthetic
SAEDLVRRVKDLVDKLEDKLRKVVRTNERLWEERDHMVLHEYVNAAGITDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 1246 - protein, 232 aa, Artificial Sequence
  Synthetic
SEKELVDDIRRILEEILRLLRSLLEEVIRLLEERDHMVLHEYVNAAGITRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRVLDLVDEVVKRVEDLVERVKEKIDT

SEQ ID NO: 1247 - protein, 243 aa, Artificial Sequence
  Synthetic
SRVEELKKLIEDILRISREVVERIARVAEDIHRRDHMVLHEYVNAAGITLRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 1248 - protein, 243 aa, Artificial Sequence; identical to SEQ ID NO: 1247
  Synthetic

SEQ ID NO: 1249 - protein, 244 aa, Artificial Sequence
  Synthetic
DEDRRLEDAVAKLRKEHADIMKKLDDIMRELDERDHMVLHEYVNAAGITKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKALRVIEEILEDLARVNKKAVDAIDELAK

SEQ ID NO: 1250 - protein, 240 aa, Artificial Sequence
  Synthetic
DKDKRLEELLKRLKELNDKTFEELERILEELKRRDHMVLHEYVNAAGITRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1251 - protein, 240 aa, Artificial Sequence
  Synthetic
SKEETLKRLLDELEKRNRETVERLERLLKELEDRDHMVLHEYVNAAGITERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1252 - protein, 240 aa, Artificial Sequence; identical to SEQ ID NO: 1251
  Synthetic

SEQ ID NO: 1253 - protein, 243 aa, Artificial Sequence
  Synthetic
DEEETLRRLLERKVELAKEYLDVSKEVIDRTTKRDHMVLHEYVNAAGITVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 1254 - protein, 243 aa, Artificial Sequence
  Synthetic
SEAERTKESLKKVLKALVDLNRELLRKLEENMRRDHMVLHEYVNAAGITLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1255 - protein, 243 aa, Artificial Sequence; identical to SEQ ID NO: 1254
  Synthetic

SEQ ID NO: 1256 - protein, 239 aa, Artificial Sequence
  Synthetic
SEVEDILRRLAELNKRLIDKLRELIDRIARLNERDHMVLHEYVNAAGITADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDRTAESLKHLEDVIRELEKKTEDSLRHMEERRK

SEQ ID NO: 1257 - protein, 239 aa, Artificial Sequence; identical to SEQ ID NO: 1256
  Synthetic

SEQ ID NO: 1258 - protein, 186 aa, Artificial Sequence
  Synthetic
SAEDSIRELLERDERLLEEARKEAKRLNEENERLRDHMVLHEYVNAAGITRLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 1259 - protein, 182 aa, Artificial Sequence
  Synthetic
DEAEKLLKELRDLLEESRKDLERLLKELEDLLEERDHMVLHEYVNAAGITKRIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 1260 - protein, 173 aa, Artificial Sequence
  Synthetic
SLEELLEEARKTVERLIRESERVLRESEERVRRLRDHMVLHEYVNAAGITEVIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 1261 - protein, 175 aa, Artificial Sequence
  Synthetic
SELEKVVDDVRRRLDRLLETSEKLLEDATKRLKDRDHMVLHEYVNAAGITERLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 1262 - protein, 180 aa, Artificial Sequence
  Synthetic
SKEEVLREIERLHKETIRRIEEVLREATELHKRLRDHMVLHEYVNAAGITEVIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 1263 - protein, 180 aa, Artificial Sequence
  Synthetic
SKEEVLDEMRRLHETTKRDIRRVLKEIEELHERTRDHMVLHEYVNAAGITRVIEDIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 1264 - protein, 178 aa, Artificial Sequence
  Synthetic
DDLERVLKEIKKAADKIREDNKRTADKIRKRVKERDHMVLHEYVNAAGITKEIKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 1265 - protein, 181 aa, Artificial Sequence
  Synthetic
DEEETLEDVLRELEERVEKLLRDLTRDLERVEKERDHMVLHEYVNAAGITKRIEELLKRIEDDEKLRRLKEEVRKLVEESRERNKRHHKEVREVLERIRELLERLEKELRRALEEIRDKIRKDGATDEILRKIEELLRRAEEVIRDLERKVRKLERDIRENIKKNHREVREILRKIEEDVR

SEQ ID NO: 1266 - protein, 179 aa, Artificial Sequence
  Synthetic
SSKEVADELRKKAEKVLDELRKIIRELERKNEDSRDHMVLHEYVNAAGITRVLRDLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 1267 - protein, 183 aa, Artificial Sequence
  Synthetic
SEIEKLVEDVRKLVEDNLRHSEEVHRRNRRLIEERDHMVLHEYVNAAGITEELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1268 - protein, 177 aa, Artificial Sequence
  Synthetic
SEAEKVVEELKKLLREVEKKIRDHTEDVKRILEERDHMVLHEYVNAAGITKELKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1269 - protein, 182 aa, Artificial Sequence
  Synthetic
DEIETVLDEVRRLHEDAKRRLEEMIDEVRKLNEERDHMVLHEYVNAAGITRTVKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 1270 - protein, 178 aa, Artificial Sequence
  Synthetic
SSKDEIRRRVEEVVERSDEIVKRSREHVKTVVDERDHMVLHEYVNAAGITKKLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 1271 - protein, 182 aa, Artificial Sequence
  Synthetic
SDADRVAEELKKLVEDSRRENERVIEESKRLVKERDHMVLHEYVNAAGITDKLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 1272 - protein, 182 aa, Artificial Sequence
  Synthetic
DEVDELLKRLRKLVDEVRKENDKMVKESKRLVEDRDHMVLHEYVNAAGITEELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 1273 - protein, 175 aa, Artificial Sequence
  Synthetic
SEVDEVLREAKRIVDEVHKDNERATEESRRLVKKRDHMVLHEYVNAAGITKEVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1274 - protein, 178 aa, Artificial Sequence
  Synthetic
SEEEKLKEVKDRIREVLRKLEEHTDKVKKEVEKVRDHMVLHEYVNAAGITAMLERLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 1275 - protein, 186 aa, Artificial Sequence
  Synthetic
SEVDEVRKTLEDLLRRLDEENKDIIRRNKELLDDRDHMVLHEYVNAAGITDELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1276 - protein, 179 aa, Artificial Sequence
  Synthetic
REDERLEEIARKIKKVVDELVERNKKLTEDNHESRDHMVLHEYVNAAGITEVAKRAIERIRSDKKVVDEVKKLLEDAKKHSKEVIDELRRLNEESKRSSEDTIRRMRKLLRELEETVKAKKGDVEDIERKVEDIIRRLEDLSRRNEEKVRRISEEIKKLSKDNERTIKEIIKEIEERVK

SEQ ID NO: 1277 - protein, 185 aa, Artificial Sequence
  Synthetic
DDIERLKREIERLLKEAEKISRDNEERSKELLDRRDHMVLHEYVNAAGITEELKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 1278 - protein, 176 aa, Artificial Sequence
  Synthetic
REAEEAKEEVEELNRRNKKELDDARRRVDELDKRRDHMVLHEYVNAAGITEELERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 1279 - protein, 179 aa, Artificial Sequence
  Synthetic
DEAEKAKRDSEKVVEDNRKMLEDSTRRAERLNEERDHMVLHEYVNAAGITREIDETKRRGTDDEVVKDLIRRVEELLERSRKKLEDLTRDNERVLDESRRRLEKLIRDNERIVKDLTDRVVRVDEVLKRLKEEHRRLIEELEEVLRRNEEIIRRSIEDLERVLDRNRRELEDVIRRLKE

SEQ ID NO: 1280 - protein, 174 aa, Artificial Sequence
  Synthetic
SEEEVLREAAKTVEKLLDEIRRSLEKVSKRVEDSRDHMVLHEYVNAAGITELLEELRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 1281 - protein, 182 aa, Artificial Sequence
  Synthetic
SELEKTLEDLKRHSEENKKKLEEDLRDMERNLKERDHMVLHEYVNAAGITKDLERRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 1282 - protein, 186 aa, Artificial Sequence
  Synthetic
SEIEKLIEELRRELEKVKDELERSIEEMDRELDDRDHMVLHEYVNAAGITREVTERTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 1283 - protein, 179 aa, Artificial Sequence
  Synthetic
RLEDEVRKMEKEVREEVKRLEDESRKVLEESRRNRDHMVLHEYVNAAGITERIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1284 - protein, 183 aa, Artificial Sequence
  Synthetic
RVDERLDTVLKRVEETVRENKKKNDELLERSKENRDHMVLHEYVNAAGITREAEKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 1285 - protein, 172 aa, Artificial Sequence
  Synthetic
SRAETVLKEVTDKIKKLADSSDELLRRNKENIDERDHMVLHEYVNAAGITEEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 1286 - protein, 174 aa, Artificial Sequence
  Synthetic
KEVEDAVKELEDLLRANEDKTRSIVEDMRASNKDRDHMVLHEYVNAAGITDDLRRAGVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 1287 - protein, 181 aa, Artificial Sequence
  Synthetic
SEVDDVLRRLEELIKTLEDINAKSLEDIKKLIDDRDHMVLHEYVNAAGITRELREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 1288 - protein, 245 aa, Artificial Sequence
  Synthetic
TEEEVLRKVEKLIKDLLDVLRDLLRASEEVVREARDHMVLHEYVNAAGITELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 1289 - protein, 238 aa, Artificial Sequence
  Synthetic
SKEDKARELEKRLRDNLKKLEEVVRELAEVLKRNRDHMVLHEYVNAAGITRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 1290 - protein, 243 aa, Artificial Sequence
  Synthetic
KREDILKKLEDIIRDIIDKLRRILEKVKRLNEDIRDHMVLHEYVNAAGITDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 1291 - protein, 244 aa, Artificial Sequence
  Synthetic
SAEETLRRITEESKRVLEEITKKYEDLERESREVRDHMVLHEYVNAAGITDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 1292 - protein, 250 aa, Artificial Sequence
  Synthetic
STEEILKRVKEILDELAKELRDIIRESLRTIEELRDHMVLHEYVNAAGITELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 1293 - protein, 242 aa, Artificial Sequence
  Synthetic
SEKERLMRLLDKLKDLNRRLVERIKELLDKALELRDHMVLHEYVNAAGITELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 1294 - protein, 240 aa, Artificial Sequence
  Synthetic
SDKEEIKRRVEKTARDLETEHDKIKKRLEDTVRDRDHMVLHEYVNAAGITRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1295 - protein, 240 aa, Artificial Sequence; identical to SEQ ID NO: 1294
  Synthetic

SEQ ID NO: 1296 - protein, 248 aa, Artificial Sequence
  Synthetic
DEDRIIEEIARLLEELLRELLELIKKLIETNRRLRDHMVLHEYVNAAGITELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 1297 - protein, 236 aa, Artificial Sequence
  Synthetic
STREKAKKVLDTLRADNEDMKRVVEKILRALKRTRDHMVLHEYVNAAGITRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1298 - protein, 231 aa, Artificial Sequence
  Synthetic
SKEEEVEKVLRKWEEILRRLIEENKRANDKIRRERDHMVLHEYVNAAGITEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1299 - protein, 247 aa, Artificial Sequence
  Synthetic
RDRDVLRKVKAEIEELVARIEKVSRDALSEVKRLRDHMVLHEYVNAAGITSLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 1300 - protein, 237 aa, Artificial Sequence
  Synthetic
KEKEDALKKLEDLARKSREDLERVLRKHKKILDKRDHMVLHEYVNAAGITDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1301 - protein, 240 aa, Artificial Sequence
  Synthetic
DREKSVRDIEEDLKRVLDKLRRRVETSKEELKKVRDHMVLHEYVNAAGITDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1302 - protein, 240 aa, Artificial Sequence; identical to SEQ ID NO: 1301
  Synthetic

SEQ ID NO: 1303 - protein, 241 aa, Artificial Sequence
  Synthetic
SAEEAVEKLVRIARAIVKINEDLSREVVRILREIRDHMVLHEYVNAAGITEVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 1304 - protein, 237 aa, Artificial Sequence
  Synthetic
REDEVLRDIERLLREIEEKIRRILEESTAELRKVRDHMVLHEYVNAAGITAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1305 - protein, 237 aa, Artificial Sequence; identical to SEQ ID NO: 1304
  Synthetic

SEQ ID NO: 1306 - protein, 243 aa, Artificial Sequence
  Synthetic
SEAERLADEVRKAVKKSEEDNETLVREVEKAVRERDHMVLHEYVNAAGITKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1307 - protein, 243 aa, Artificial Sequence; identical to SEQ ID NO: 1306
  Synthetic

SEQ ID NO: 1308 - protein, 239 aa, Artificial Sequence
  Synthetic
SAEDLVRRVKDLVDKLEDKLRKVVRTNERLWEEIRDHMVLHEYVNAAGITALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 1309 - protein, 249 aa, Artificial Sequence
  Synthetic
DAEEVVKRLADVLRENDETIRKVVEDLVRIAEENRDHMVLHEYVNAAGITRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1310 - protein, 249 aa, Artificial Sequence; identical to SEQ ID NO: 1309
  Synthetic

SEQ ID NO: 1311 - protein, 240 aa, Artificial Sequence
  Synthetic
DKDKRLEELLKRLKELNDKTFEELERILEELKRARDHMVLHEYVNAAGITARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1312 - protein, 240 aa, Artificial Sequence; identical to SEQ ID NO: 1311
  Synthetic

SEQ ID NO: 1313 - protein, 240 aa, Artificial Sequence
  Synthetic
SKEETLKRLLDELEKRNRETVERLERLLKELEDRRDHMVLHEYVNAAGITRKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1314 - protein, 243 aa, Artificial Sequence
  Synthetic
DEEETLRRLLERKVELAKEYLDVSKEVIDRTTKLRDHMVLHEYVNAAGITELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 1315 - protein, 243 aa, Artificial Sequence; identical to SEQ ID NO: 1314
  Synthetic

SEQ ID NO: 1316 - protein, 243 aa, Artificial Sequence
  Synthetic
SEAERTKESLKKVLKALVDLNRELLRKLEENMRERDHMVLHEYVNAAGITDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1317 - protein, 243 aa, Artificial Sequence; identical to SEQ ID NO: 1316
  Synthetic

SEQ ID NO: 1318 - protein, 186 aa, Artificial Sequence
  Synthetic
SAEDSIRELLERDERLLEEARKEAKRLNEENERLLRDHMVLHEYVNAAGITLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 1319 - protein, 178 aa, Artificial Sequence
  Synthetic
DEVEKLLRDLEELDRDIERKVRELLKRNKEVLDDIRDHMVLHEYVNAAGITEVADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 1320 - protein, 182 aa, Artificial Sequence
  Synthetic
DEAEKLLKELRDLLEESRKDLERLLKELEDLLEESRDHMVLHEYVNAAGITRIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 1321 - protein, 174 aa, Artificial Sequence
  Synthetic
SRDEKIRDILRRVLKEVRDSTKKVEEDLEDVHRRTRDHMVLHEYVNAAGITRVRDEGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 1322 - protein, 173 aa, Artificial Sequence
  Synthetic
SLEELLEEARKTVERLIRESERVLRESEERVRRLIRDHMVLHEYVNAAGITVIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 1323 - protein, 179 aa, Artificial Sequence
  Synthetic
STREDARRLVERVRKEVKRLLKKNSDLLREVTERVRDHMVLHEYVNAAGITEAKRLKDSDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 1324 - protein, 175 aa, Artificial Sequence
  Synthetic
SELEKVVDDVRRRLDRLLETSEKLLEDATKRLKDSRDHMVLHEYVNAAGITRLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 1325 - protein, 174 aa, Artificial Sequence
  Synthetic
SELEKVVKEVADLLRRNLEKSKRVLEEVRRRLEENRDHMVLHEYVNAAGITRILELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 1326 - protein, 180 aa, Artificial Sequence
  Synthetic
SKEEVLDEMRRLHETTKRDIRRVLKEIEELHERTLRDHMVLHEYVNAAGITVIEDIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 1327 - protein, 187 aa, Artificial Sequence
  Synthetic
DEEEELRKRLEKLSKEVRELLRRDEEEDRRLNRELRDHMVLHEYVNAAGITEVEDLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 1328 - protein, 171 aa, Artificial Sequence
  Synthetic
SEKEKVIKEARELLERLRKRLKDVNDDVTRLLDELRDHMVLHEYVNAAGITRLEEEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 1329 - protein, 177 aa, Artificial Sequence
  Synthetic
SVIERVEEEMEKVIRDSERVTKEVEDRAREVHERSRDHMVLHEYVNAAGITELRRAGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 1330 - protein, 183 aa, Artificial Sequence
  Synthetic
SEIEKLVEDVRKLVEDNLRHSEEVHRRNRRLIEENRDHMVLHEYVNAAGITELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1331 - protein, 181 aa, Artificial Sequence
  Synthetic
EEIERALREMRELSRTHKELVEKILRDIAELAKTHRDHMVLHEYVNAAGITEIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 1332 - protein, 174 aa, Artificial Sequence
  Synthetic
REIEEAAKDLDRLLEENKKLVKEVEEELRRLLKENRDHMVLHEYVNAAGITELRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 1333 - protein, 177 aa, Artificial Sequence
  Synthetic
SEAEKVVEELKKLLREVEKKIRDHTEDVKRILEELRDHMVLHEYVNAAGITELKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1334 - protein, 178 aa, Artificial Sequence
  Synthetic
SKVEKLEEEIARLVERSRRLVEELKKEVTKVKEKVRDHMVLHEYVNAAGITKLRDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 1335 - protein, 182 aa, Artificial Sequence
  Synthetic
DEVDELLKRLRKLVDEVRKENDKMVKESKRLVEDLRDHMVLHEYVNAAGITELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 1336 - protein, 186 aa, Artificial Sequence
  Synthetic
SEVDEVRKTLEDLLRRLDEENKDIIRRNKELLDDLRDHMVLHEYVNAAGITELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1337 - protein, 183 aa, Artificial Sequence
  Synthetic
SEVDEVLERIKRLLERLAEHSDKVVRDIEKLLDDNRDHMVLHEYVNAAGITRLEEMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 1338 - protein, 179 aa, Artificial Sequence
  Synthetic
KDEETLKRLLEKAKEVVDRLKDENEKVTRDNHESVRDHMVLHEYVNAAGITVARDAIRRVREAKEVVDTAEKLLRDNHEHSRDTVKKARELNETSRRHSERIVEKIEEILEEVERTLRENRGDVRELAKKVEKAIRELEELSRENREAVKRISDEIKRLSDENAKDSERIIKEIDDRVR

SEQ ID NO: 1339 - protein, 185 aa, Artificial Sequence
  Synthetic
DDIERLKREIERLLKEAEKISRDNEERSKELLDRLRDHMVLHEYVNAAGITELKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 1340 - protein, 184 aa, Artificial Sequence
  Synthetic
ELIKKARKDVEEVRERSERLVDELRKRNKKLADESRDHMVLHEYVNAAGITEIEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1341 - protein, 186 aa, Artificial Sequence
  Synthetic
KEVEDLERRVKEILDRMKRLIDENRKKIEKSIRELRDHMVLHEYVNAAGITELKDLKREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 1342 - protein, 186 aa, Artificial Sequence
  Synthetic
KEVEDLERTVRTILKRMRELITRNEEEIRRSIEELRDHMVLHEYVNAAGITEMKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 1343 - protein, 185 aa, Artificial Sequence
  Synthetic
SAEELLRTIEKRIEDNHRRLEEILEEIARLIEDMLRDHMVLHEYVNAAGITVLDRVRRAGVPEEVLERVRRELERLKKELEELRRRSEEKVKELKRRLEEIRRKLEEEHRDLRRKLEELRRDLGDKEEVVKKLVEDVERELERSLREAEDLLRRVEEVIRTSKKESKDVLEKIERLLRDLERRTR

SEQ ID NO: 1344 - protein, 182 aa, Artificial Sequence
  Synthetic
SELEKTLEDLKRHSEENKKKLEEDLRDMERNLKENRDHMVLHEYVNAAGITDLERRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 1345 - protein, 179 aa, Artificial Sequence
  Synthetic
RLEDEVRKMEKEVREEVKRLEDESRKVLEESRRNLRDHMVLHEYVNAAGITRIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1346 - protein, 183 aa, Artificial Sequence
  Synthetic
SIREKIRELEERLEEVLRRIEENSERVLREAERVLRDHMVLHEYVNAAGITALEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 1347 - protein, 174 aa, Artificial Sequence
  Synthetic
SESDEVIRDLARLLDELARHVDDSVRRMDEVVKRSRDHMVLHEYVNAAGITEVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1348 - protein, 174 aa, Artificial Sequence
  Synthetic
SESDDVIRKLRELLEELRTHVEKSIRDLRKILEDSRDHMVLHEYVNAAGITEVRKKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 1349 - protein, 172 aa, Artificial Sequence
  Synthetic
SRAETVLKEVTDKIKKLADSSDELLRRNKENIDELRDHMVLHEYVNAAGITEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 1350 - protein, 178 aa, Artificial Sequence
  Synthetic
SEAEKAKETIDRLADRVRKLLEEIKRSLDDSRRKSRDHMVLHEYVNAAGITEVDAAKRGSVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 1351 - protein, 178 aa, Artificial Sequence; identical to SEQ ID NO: 1350
  Synthetic

SEQ ID NO: 1352 - protein, 179 aa, Artificial Sequence
  Synthetic
SEVEELIKRLAKVLKELVDKVRKVIEDTKELLERLRDHMVLHEYVNAAGITEAKDQPIDDEELKEILDRLRKTLEELEEELKKALEDDREEAKRLVDDARRVLKELEEEVREIRERRGESEELDRRIEKVLKEIEEKIREVIKEWERVHREVEELLKRLIDENRKVLDEIRKLLEEKSK

SEQ ID NO: 1353 - protein, 182 aa, Artificial Sequence
  Synthetic
SELEEIEKKVRELTKRHRELVERVRKTVKELIETNRDHMVLHEYVNAAGITEVRDLERRGEPKEDLKARLEDIIRRLAEDIERVKRETDKLLEELARIIEEVEKEMRETNKELDKEIKDGGLDDKALEEAKRVLAENNEVIKDIKRALDELLKELEKSVRESEERLRRLLEEVKRVIEEVAT

SEQ ID NO: 1354 - protein, 177 aa, Artificial Sequence
  Synthetic
SSEERLRAVIEDLKRLAEESRKRHKELIDELAKAVRDHMVLHEYVNAAGITVVDDIRRGVSEELLKRIEEVLDEIRKELEENIKRIRKVLDELRRTSEENIARIEKVLRELEDLVRKGGSDADTIIEEVKRVLEELARSTEEVEKRVRDAIEELERSSEELARRIKEVLKRLEEETR

SEQ ID NO: 1355 - protein, 184 aa, Artificial Sequence
  Synthetic
DEIRKVVKEITDLLKASNDKNRKVVEEIRDLLRKSRDHMVLHEYVNAAGITDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1356 - protein, 176 aa, Artificial Sequence
  Synthetic
STAETVAEEVERVLKHSDDLIKEVEDVNRRVEEEIRDHMVLHEYVNAAGITEVRKGVKGEILAEIEKRLADNSEKVREVAERAKKLLEENTARVKDILRESRKLVKDLLDEVRGTGSEEAAREIIKRLREVNKRTKEKLDELIKHSEEVLERVKRLIDELRKHSEEVLEDLRRRAK

SEQ ID NO: 1357 - protein, 186 aa, Artificial Sequence
  Synthetic
SEVDEIIKELERLLAEIARENERIIRESRKLADEVRDHMVLHEYVNAAGITRLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 1358 - protein, 185 aa, Artificial Sequence
  Synthetic
SEIDEVLTRLRKISKDLNETSDRVNERARKIIDDIRDHMVLHEYVNAAGITRLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLLEELKRELEKSTRSVKALVDELRERVR

SEQ ID NO: 1359 - protein, 177 aa, Artificial Sequence
  Synthetic
SEDEDLDRVAEKLAREHKKSVEEIKRVLKSADEESRDHMVLHEYVNAAGITEVEEARRGNIDEELVERLKKKIEDILRTLEERHKKLIKELREILKRLSDESRRLAEETEKVLEDLERKGVDEEVLKKLAEIVRRVKEENRKVNEEVEKRLRELEEENKKVIEDLKSTVEELVERLR

SEQ ID NO: 1360 - protein, 185 aa, Artificial Sequence
  Synthetic
SSVEELLERLRRISEENKRRIEKLLREVEKVLRELRDHMVLHEYVNAAGITKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 1361 - protein, 238 aa, Artificial Sequence
  Synthetic
EEDERLTKRVEEIKRENRELLRRLEEEVKELERKSRDHMVLHEYVNAAGITKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1362 - protein, 238 aa, Artificial Sequence
  Synthetic
SKEDKARELEKRLRDNLKKLEEVVRELAEVLKRNLRDHMVLHEYVNAAGITLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 1363 - protein, 243 aa, Artificial Sequence
  Synthetic
KREDILKKLEDIIRDIIDKLRRILEKVKRLNEDIIRDHMVLHEYVNAAGITLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 1364 - protein, 247 aa, Artificial Sequence
  Synthetic
SEKEELLKLIKRVIELLKRVLEEHLRLVEDVIRRLRDHMVLHEYVNAAGITDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 1365 - protein, 238 aa, Artificial Sequence
  Synthetic
SEAEKIREALETNLRLLEELIKRLKEILDTHNELLRDHMVLHEYVNAAGITLLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1366 - protein, 247 aa, Artificial Sequence
  Synthetic
SEAEDLEELIKELAELLKDVIRKLEKINRRLVKILRDHMVLHEYVNAAGITELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 1367 - protein, 240 aa, Artificial Sequence
  Synthetic
SDKEEIKRRVEKTARDLETEHDKIKKRLEDTVRDIRDHMVLHEYVNAAGITKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1368 - protein, 240 aa, Artificial Sequence; identical to SEQ ID NO: 1367
  Synthetic

SEQ ID NO: 1369 - protein, 248 aa, Artificial Sequence
  Synthetic
DEDRIIEEIARLLEELLRELLELIKKLIETNRRLNRDHMVLHEYVNAAGITLLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 1370 - protein, 251 aa, Artificial Sequence
  Synthetic
DEEEKIRTTLDLLRKLLKVLREILEELIRSNKELNRDHMVLHEYVNAAGITLLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELERLLRENRRRLEELAREAKKVLDELRKRLEDERR

SEQ ID NO: 1371 - protein, 238 aa, Artificial Sequence
  Synthetic
DADELLRRLAEEVERVIREAEDLLRRWKETIKKVLRDHMVLHEYVNAAGITVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 1372 - protein, 231 aa, Artificial Sequence
  Synthetic
DKAEVLREALKLLKDLLEELIKIHEESLKRILDLIRDHMVLHEYVNAAGITLLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 1373 - protein, 236 aa, Artificial Sequence
  Synthetic
STREKAKKVLDTLRADNEDMKRVVEKILRALKRTNRDHMVLHEYVNAAGITILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1374 - protein, 247 aa, Artificial Sequence
  Synthetic
SKAEKLLKDLREALEKVKRRYEELERRLDEVLKEHRDHMVLHEYVNAAGITRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 1375 - protein, 247 aa, Artificial Sequence; identical to SEQ ID NO: 1374
  Synthetic

SEQ ID NO: 1376 - protein, 231 aa, Artificial Sequence
  Synthetic
SKEEEVEKVLRKWEEILRRLIEENKRANDKIRREYRDHMVLHEYVNAAGITVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1377 - protein, 231 aa, Artificial Sequence; identical to SEQ ID NO: 1376
  Synthetic

SEQ ID NO: 1378 - protein, 231 aa, Artificial Sequence
  Synthetic
SKDEELARLLEELVERWRKIVEDLERDHRRLVKEIRDHMVLHEYVNAAGITRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1379 - protein, 231 aa, Artificial Sequence; identical to SEQ ID NO: 1378
  Synthetic

SEQ ID NO: 1380 - protein, 237 aa, Artificial Sequence
  Synthetic
KEKEDALKKLEDLARKSREDLERVLRKHKKILDKIRDHMVLHEYVNAAGITDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1381 - protein, 237 aa, Artificial Sequence; identical to SEQ ID NO: 1380
  Synthetic

SEQ ID NO: 1382 - protein, 229 aa, Artificial Sequence
  Synthetic
SKEERLREVAEKHKKDLEDIVKRVDEAAKETARRLRDHMVLHEYVNAAGITDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1383 - protein, 229 aa, Artificial Sequence; identical to SEQ ID NO: 1382
  Synthetic

SEQ ID NO: 1384 - protein, 241 aa, Artificial Sequence
  Synthetic
SEKELLKEILDRIRELLEDDNRLLKRIVDEIRKLLRDHMVLHEYVNAAGITLLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 1385 - protein, 241 aa, Artificial Sequence; identical to SEQ ID NO: 1384
  Synthetic

SEQ ID NO: 1386 - protein, 246 aa, Artificial Sequence
  Synthetic
SEREELLERIKEILKRVKDKLDEDLKRLKEILEKLRDHMVLHEYVNAAGITEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 1387 - protein, 240 aa, Artificial Sequence
  Synthetic
DREKSVRDIEEDLKRVLDKLRRRVETSKEELKKVLRDHMVLHEYVNAAGITVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1388 - protein, 243 aa, Artificial Sequence
  Synthetic
SEAERLADEVRKAVKKSEEDNETLVREVEKAVRELRDHMVLHEYVNAAGITRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1389 - protein, 245 aa, Artificial Sequence
  Synthetic
SEKDEVTRRIRELLKEAEETNREAIERIKRLLDRVRDHMVLHEYVNAAGITRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1390 - protein, 245 aa, Artificial Sequence; identical to SEQ ID NO: 1389
  Synthetic

SEQ ID NO: 1391 - protein, 249 aa, Artificial Sequence
  Synthetic
DAEEVVKRLADVLRENDETIRKVVEDLVRIAEENDRDHMVLHEYVNAAGITIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1392 - protein, 240 aa, Artificial Sequence
  Synthetic
SKEETLKRLLDELEKRNRETVERLERLLKELEDRNRDHMVLHEYVNAAGITKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1393 - protein, 240 aa, Artificial Sequence; identical to SEQ ID NO: 1392
  Synthetic

SEQ ID NO: 1394 - protein, 243 aa, Artificial Sequence
  Synthetic
SEAERTKESLKKVLKALVDLNRELLRKLEENMRELRDHMVLHEYVNAAGITKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1395 - protein, 186 aa, Artificial Sequence
  Synthetic
SAEDSIRELLERDERLLEEARKEAKRLNEENERLLERDHMVLHEYVNAAGITLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 1396 - protein, 178 aa, Artificial Sequence
  Synthetic
DEVEKLLRDLEELDRDIERKVRELLKRNKEVLDDIERDHMVLHEYVNAAGITVADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 1397 - protein, 182 aa, Artificial Sequence
  Synthetic
DEAEKLLKELRDLLEESRKDLERLLKELEDLLEESKRDHMVLHEYVNAAGITIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 1398 - protein, 182 aa, Artificial Sequence
  Synthetic
RVEDALRKLLDDVRRLVEEAERRLRTSNDKSRRLVERDHMVLHEYVNAAGITVRDVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 1399 - protein, 184 aa, Artificial Sequence
  Synthetic
SLEEVIKTVRKLLEEVERRLREVVERAERMLEEVRRRDHMVLHEYVNAAGITEKALRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 1400 - protein, 177 aa, Artificial Sequence
  Synthetic
ELREDVERVVDEIRRLVEENVRRIDEVAKDIKRLADRDHMVLHEYVNAAGITIRRLKEEGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 1401 - protein, 174 aa, Artificial Sequence
  Synthetic
SEDETIRRIVRTVHEESRKSTEDVRREVERVLRESERDHMVLHEYVNAAGITVEETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 1402 - protein, 174 aa, Artificial Sequence
  Synthetic
SRDEKIRDILRRVLKEVRDSTKKVEEDLEDVHRRTERDHMVLHEYVNAAGITVRDEGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 1403 - protein, 170 aa, Artificial Sequence
  Synthetic
SEVEDVVRKVEKLVRDLIKHVEENVRRVEEVVRKLIRDHMVLHEYVNAAGITLAKEPGSEDLLRKLEKVLKEIDDKLKELEDRLRDMVRRSRESSEENERRLKRVEDEVRRNGISEEVEKVLREVVKEVEKVNRESREVTRRVLEEAKEMLERVKKIVKEVIEKVRRVVK

SEQ ID NO: 1404 - protein, 173 aa, Artificial Sequence
  Synthetic
SLEELLEEARKTVERLIRESERVLRESEERVRRLIERDHMVLHEYVNAAGITIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 1405 - protein, 174 aa, Artificial Sequence
  Synthetic
SELEKVVKEVADLLRRNLEKSKRVLEEVRRRLEENLRDHMVLHEYVNAAGITILELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 1406 - protein, 180 aa, Artificial Sequence
  Synthetic
STEEVLDEIRKLHKTLTEDIKRVLREIEELHRRTIERDHMVLHEYVNAAGITIDDVRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 1407 - protein, 180 aa, Artificial Sequence
  Synthetic
SKEEVLREIERLHKETIRRIEEVLREATELHKRLTERDHMVLHEYVNAAGITIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 1408 - protein, 178 aa, Artificial Sequence
  Synthetic
DDLERVLKEIKKAADKIREDNKRTADKIRKRVKELDRDHMVLHEYVNAAGITIKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 1409 - protein, 187 aa, Artificial Sequence
  Synthetic
SEKETVRDELRKLVETIRKLLEEDKESDKRLADRIRRDHMVLHEYVNAAGITLEKVLEELRKKVSEDELRKLRKRIEDLRRRDEELNKRSREKLEDLNERNKDSLRRIEDELRKLVEEAREVEKRDNDEERLRKLLERLERVIRDLLRKIEENNKRLRKAIKELLDELRKINKELREVIKKLLDDAR

SEQ ID NO: 1410 - protein, 175 aa, Artificial Sequence
  Synthetic
SEEDELRRLLKEVNERVERLLDEIRKELEKIAEELRRDHMVLHEYVNAAGITVEENRVDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 1411 - protein, 171 aa, Artificial Sequence
  Synthetic
SEKEKVIKEARELLERLRKRLKDVNDDVTRLLDELRRDHMVLHEYVNAAGITLEEEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 1412 - protein, 177 aa, Artificial Sequence
  Synthetic
SAIEKVKEVVERVLETVRDSVRRSHEESKRLIDKVRRDHMVLHEYVNAAGITVRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 1413 - protein, 177 aa, Artificial Sequence
  Synthetic
SVLEEVRRRVEELLKTVKESVDRSHERSERLIEEVRRDHMVLHEYVNAAGITVREKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 1414 - protein, 183 aa, Artificial Sequence
  Synthetic
KDAEDLERRVRELVEENNRVSKRLAEEVTRLVKENERDHMVLHEYVNAAGITLLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 1415 - protein, 183 aa, Artificial Sequence
  Synthetic
SEIEKLVEDVRKLVEDNLRHSEEVHRRNRRLIEENERDHMVLHEYVNAAGITLRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1416 - protein, 181 aa, Artificial Sequence
  Synthetic
EEIERALREMRELSRTHKELVEKILRDIAELAKTHERDHMVLHEYVNAAGITIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 1417 - protein, 174 aa, Artificial Sequence
  Synthetic
SEIEELEKRIDELLKELRDLSRRIAEEVKRLLEELKRDHMVLHEYVNAAGITLKRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 1418 - protein, 174 aa, Artificial Sequence
  Synthetic
DELRDVKRELDRLLRENEEIVERIAETVRRLLEELKRDHMVLHEYVNAAGITLRKRGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 1419 - protein, 174 aa, Artificial Sequence
  Synthetic
DEEEDLERRIKKLLDENRELLKRIAEELRRLLEELRRDHMVLHEYVNAAGITLKDRGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 1420 - protein, 174 aa, Artificial Sequence
  Synthetic
REIEEAAKDLDRLLEENKKLVKEVEEELRRLLKENRRDHMVLHEYVNAAGITLRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 1421 - protein, 177 aa, Artificial Sequence
  Synthetic
SEAEKVVEELKKLLREVEKKIRDHTEDVKRILEELERDHMVLHEYVNAAGITLKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1422 - protein, 182 aa, Artificial Sequence
  Synthetic
DELEEVVRRVRELSRTVKEELREVIERVRELSERVKRDHMVLHEYVNAAGITVMKRVRDSGLDKSKLEKLEDESRRVLDKSREILRKNEEDNRRLNKELEEILKKNEDDNEDVRRKVDEVTRKGKDAEEVLREVEKVVEDSRRSAKDALKRVEDRVRESDKSVRELLEENRKVVEDIKRRVD

SEQ ID NO: 1423 - protein, 174 aa, Artificial Sequence
  Synthetic
EELERILDKVRKVIEEVRKRLRDDLRTVEKVLKETERDHMVLHEYVNAAGITVEEAARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 1424 - protein, 178 aa, Artificial Sequence
  Synthetic
SSKDEIRRRVEEVVERSDEIVKRSREHVKTVVDELDRDHMVLHEYVNAAGITLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 1425 - protein, 178 aa, Artificial Sequence
  Synthetic
SKVEKLEEEIARLVERSRRLVEELKKEVTKVKEKVDRDHMVLHEYVNAAGITLRDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 1426 - protein, 182 aa, Artificial Sequence
  Synthetic
SDADRVAEELKKLVEDSRRENERVIEESKRLVKENERDHMVLHEYVNAAGITLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 1427 - protein, 182 aa, Artificial Sequence
  Synthetic
DEVREVAERLRRLVDESRKRNEEVIKESEALVDRVRRDHMVLHEYVNAAGITLEKDIRRLKDKKTVEKIIREVLKKIDELLKRVERTNREISKENKRLLDEVRKTNEEISRRLKKLLEDIRRRNVDVETIERVVRELLEENKEVLRKTEEMVKRSTETNKRLLERSKEVADRLRERIKEAAK

SEQ ID NO: 1428 - protein, 175 aa, Artificial Sequence
  Synthetic
SEVDEVLREAKRIVDEVHKDNERATEESRRLVKKVHRDHMVLHEYVNAAGITVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1429 - protein, 175 aa, Artificial Sequence
  Synthetic
SEMDDVLKKLAETVKRIIERLKKLTDDSRRLVEEVHRDHMVLHEYVNAAGITAEERNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 1430 - protein, 178 aa, Artificial Sequence
  Synthetic
SEEEKLKEVKDRIREVLRKLEEHTDKVKKEVEKVLRRDHMVLHEYVNAAGITLERLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 1431 - protein, 186 aa, Artificial Sequence
  Synthetic
SRVDEVIERLERLLRELDKINRDMIEDDKRLNTELNRDHMVLHEYVNAAGITLEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 1432 - protein, 183 aa, Artificial Sequence
  Synthetic
SEVDEVLERIKRLLERLAEHSDKVVRDIEKLLDDNRRDHMVLHEYVNAAGITLEEMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 1433 - protein, 184 aa, Artificial Sequence
  Synthetic
ELIKKARKDVEEVRERSERLVDELRKRNKKLADESRRDHMVLHEYVNAAGITIEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1434 - protein, 186 aa, Artificial Sequence
  Synthetic
KEVEDLERTVRTILKRMRELITRNEEEIRRSIEELKRDHMVLHEYVNAAGITMKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 1435 - protein, 176 aa, Artificial Sequence
  Synthetic
REAEEAKEEVEELNRRNKKELDDARRRVDELDKRNKRDHMVLHEYVNAAGITLERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 1436 - protein, 186 aa, Artificial Sequence
  Synthetic
SEIEKLIEELRRELEKVKDELERSIEEMDRELDDVRRDHMVLHEYVNAAGITVTERTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 1437 - protein, 179 aa, Artificial Sequence
  Synthetic
RLEDEVRKMEKEVREEVKRLEDESRKVLEESRRNLDRDHMVLHEYVNAAGITIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1438 - protein, 183 aa, Artificial Sequence
  Synthetic
SIREKIRELEERLEEVLRRIEENSERVLREAERVLKRDHMVLHEYVNAAGITLEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 1439 - protein, 182 aa, Artificial Sequence
  Synthetic
SIEDLVRELKKKVDEVAEDLRRKVREALERSRENIDRDHMVLHEYVNAAGITVDKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 1440 - protein, 179 aa, Artificial Sequence
  Synthetic
SKAEEVEELVKKLLAEVKKSLDDVRRTVEKLLREVRRDHMVLHEYVNAAGITLKDLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 1441 - protein, 177 aa, Artificial Sequence
  Synthetic
SAADEVVERMKELVATVKRENDEVVKELKKLVKELERDHMVLHEYVNAAGITLARRVGKDKREVVEEVRRTSKELVERNEETAKRVDDLVRRLVEENRRSVTEVEELVKELVKELRRGSGSEDLVREVEKRVRDIVEESRKLAEETRKAVEDIIEKSKRIAEDTLEKNKEMVERLER

SEQ ID NO: 1442 - protein, 174 aa, Artificial Sequence
  Synthetic
SESDEVIRDLARLLDELARHVDDSVRRMDEVVKRSTRDHMVLHEYVNAAGITVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1443 - protein, 174 aa, Artificial Sequence
  Synthetic
KEVEDAVKELEDLLRANEDKTRSIVEDMRASNKDLERDHMVLHEYVNAAGITLRRAGVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 1444 - protein, 184 aa, Artificial Sequence
  Synthetic
DEIRKVVKEITDLLKASNDKNRKVVEEIRDLLRKSKRDHMVLHEYVNAAGITLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1445 - protein, 186 aa, Artificial Sequence
  Synthetic
SRVEEIIEDLRRLLEEIRKENEDSIRRSKELLDRVKRDHMVLHEYVNAAGITIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 1446 - protein, 186 aa, Artificial Sequence; identical to SEQ ID NO: 1445
  Synthetic

SEQ ID NO: 1447 - protein, 181 aa, Artificial Sequence
  Synthetic
SEVDDVLRRLEELIKTLEDINAKSLEDIKKLIDDLARDHMVLHEYVNAAGITLREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 1448 - protein, 183 aa, Artificial Sequence
  Synthetic
SKLEEVEKAVRKVIEDSRRVNEEVNRRSEEVVRELERDHMVLHEYVNAAGITARRVLKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 1449 - protein, 238 aa, Artificial Sequence
  Synthetic
EEDERLTKRVEEIKRENRELLRRLEEEVKELERKSERDHMVLHEYVNAAGITLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1450 - protein, 245 aa, Artificial Sequence
  Synthetic
TEEEVLRKVEKLIKDLLDVLRDLLRASEEVVREALRRDHMVLHEYVNAAGITSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 1451 - protein, 234 aa, Artificial Sequence
  Synthetic
SAKETIRKLIEENKDIIRKLAEKLKRLLEESERIAERDHMVLHEYVNAAGITLRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLEEKIRKIKRELDDLSARLREKIERTRK

SEQ ID NO: 1452 - protein, 238 aa, Artificial Sequence
  Synthetic
SKEDKARELEKRLRDNLKKLEEVVRELAEVLKRNLERDHMVLHEYVNAAGITLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 1453 - protein, 244 aa, Artificial Sequence
  Synthetic
SAEETLRRITEESKRVLEEITKKYEDLERESREVLRRDHMVLHEYVNAAGITLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 1454 - protein, 250 aa, Artificial Sequence
  Synthetic
STEEILKRVKEILDELAKELRDIIRESLRTIEELLDRDHMVLHEYVNAAGITVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 1455 - protein, 238 aa, Artificial Sequence
  Synthetic
SEAEKIREALETNLRLLEELIKRLKEILDTHNELLRRDHMVLHEYVNAAGITLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1456 - protein, 238 aa, Artificial Sequence; identical to SEQ ID NO: 1455
  Synthetic

SEQ ID NO: 1457 - protein, 242 aa, Artificial Sequence
  Synthetic
SEKERLMRLLDKLKDLNRRLVERIKELLDKALELHKRDHMVLHEYVNAAGITVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 1458 - protein, 242 aa, Artificial Sequence; identical to SEQ ID NO: 1457
  Synthetic

SEQ ID NO: 1459 - protein, 247 aa, Artificial Sequence
  Synthetic
SEAEDLEELIKELAELLKDVIRKLEKINRRLVKILERDHMVLHEYVNAAGITLRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 1460 - protein, 247 aa, Artificial Sequence; identical to SEQ ID NO: 1459
  Synthetic

SEQ ID NO: 1461 - protein, 240 aa, Artificial Sequence
  Synthetic
SDKEEIKRRVEKTARDLETEHDKIKKRLEDTVRDIKRDHMVLHEYVNAAGITIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1462 - protein, 240 aa, Artificial Sequence; identical to SEQ ID NO: 1461
  Synthetic

SEQ ID NO: 1463 - protein, 248 aa, Artificial Sequence
  Synthetic
DEDRIIEEIARLLEELLRELLELIKKLIETNRRLNERDHMVLHEYVNAAGITLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 1464 - protein, 238 aa, Artificial Sequence
  Synthetic
DADELLRRLAEEVERVIREAEDLLRRWKETIKKVLDRDHMVLHEYVNAAGITIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 1465 - protein, 231 aa, Artificial Sequence
  Synthetic
DKAEVLREALKLLKDLLEELIKIHEESLKRILDLIDRDHMVLHEYVNAAGITLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 1466 - protein, 247 aa, Artificial Sequence
  Synthetic
SKAEKLLKDLREALEKVKRRYEELERRLDEVLKEHERDHMVLHEYVNAAGITIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 1467 - protein, 239 aa, Artificial Sequence
  Synthetic
SERELIERWLELHKEILRLIRELVERLLKLHREILDRDHMVLHEYVNAAGITARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 1468 - protein, 246 aa, Artificial Sequence
  Synthetic
KEIEETLKELEDLNREMVETNRRVLEETRRLNKETVRDHMVLHEYVNAAGITLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 1469 - protein, 231 aa, Artificial Sequence
  Synthetic
SKEEEVEKVLRKWEEILRRLIEENKRANDKIRREYERDHMVLHEYVNAAGITAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1470 - protein, 231 aa, Artificial Sequence; identical to SEQ ID NO: 1469
  Synthetic

SEQ ID NO: 1471 - protein, 247 aa, Artificial Sequence
  Synthetic
RDRDVLRKVKAEIEELVARIEKVSRDALSEVKRLLDRDHMVLHEYVNAAGITLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 1472 - protein, 231 aa, Artificial Sequence
  Synthetic
SKDEELARLLEELVERWRKIVEDLERDHRRLVKEIRRDHMVLHEYVNAAGITIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1473 - protein, 231 aa, Artificial Sequence; identical to SEQ ID NO: 1472
  Synthetic

SEQ ID NO: 1474 - protein, 238 aa, Artificial Sequence
  Synthetic
SEIEDVIRRLRKILEDLERVSEKLLREIKKILDEARRDHMVLHEYVNAAGITAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 1475 - protein, 229 aa, Artificial Sequence
  Synthetic
SKEERLREVAEKHKKDLEDIVKRVDEAAKETARRLERDHMVLHEYVNAAGITLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1476 - protein, 229 aa, Artificial Sequence; identical to SEQ ID NO: 1475
  Synthetic

SEQ ID NO: 1477 - protein, 241 aa, Artificial Sequence
  Synthetic
SEKELLKEILDRIRELLEDDNRLLKRIVDEIRKLLERDHMVLHEYVNAAGITLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 1478 - protein, 241 aa, Artificial Sequence; identical to SEQ ID NO: 1477
  Synthetic

SEQ ID NO: 1479 - protein, 240 aa, Artificial Sequence
  Synthetic
DREKSVRDIEEDLKRVLDKLRRRVETSKEELKKVLKRDHMVLHEYVNAAGITVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1480 - protein, 240 aa, Artificial Sequence; identical to SEQ ID NO: 1479
  Synthetic

SEQ ID NO: 1481 - protein, 252 aa, Artificial Sequence
  Synthetic
SLEEITKRLLELVEENLARHEEILRELLELAKRLAKRDHMVLHEYVNAAGITLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 1482 - protein, 252 aa, Artificial Sequence; identical to SEQ ID NO: 1481
  Synthetic

SEQ ID NO: 1483 - protein, 241 aa, Artificial Sequence
  Synthetic
SAEEAVEKLVRIARAIVKINEDLSREVVRILREIVRRDHMVLHEYVNAAGITVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 1484 - protein, 237 aa, Artificial Sequence
  Synthetic
REDEVLRDIERLLREIEEKIRRILEESTAELRKVEERDHMVLHEYVNAAGITKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1485 - protein, 237 aa, Artificial Sequence; identical to SEQ ID NO: 1484
  Synthetic

SEQ ID NO: 1486 - protein, 237 aa, Artificial Sequence
  Synthetic
SREDLLRSLAELIETILRKSSELLDRLLKLVREHSERDHMVLHEYVNAAGITLKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKAKNDKILRDVEEVLRRHLEELARILKDVKKVLDEARK

SEQ ID NO: 1487 - protein, 243 aa, Artificial Sequence
  Synthetic
SEAERLADEVRKAVKKSEEDNETLVREVEKAVRELKRDHMVLHEYVNAAGITLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1488 - protein, 243 aa, Artificial Sequence; identical to SEQ ID NO: 1487
  Synthetic

SEQ ID NO: 1489 - protein, 245 aa, Artificial Sequence
  Synthetic
SEKDEVTRRIRELLKEAEETNREAIERIKRLLDRVRRDHMVLHEYVNAAGITLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1490 - protein, 247 aa, Artificial Sequence
  Synthetic
DEERLAEELERVLDRNRKLLEEALRELRRVIEENRKRDHMVLHEYVNAAGITLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 1491 - protein, 243 aa, Artificial Sequence
  Synthetic
SRVEELKKLIEDILRISREVVERIARVAEDIHRINRRDHMVLHEYVNAAGITVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 1492 - protein, 243 aa, Artificial Sequence; identical to SEQ ID NO: 1491
  Synthetic

SEQ ID NO: 1493 - protein, 249 aa, Artificial Sequence
  Synthetic
DAEEVVKRLADVLRENDETIRKVVEDLVRIAEENDRRDHMVLHEYVNAAGITVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1494 - protein, 249 aa, Artificial Sequence; identical to SEQ ID NO: 1493
  Synthetic

SEQ ID NO: 1495 - protein, 240 aa, Artificial Sequence
  Synthetic
DKDKRLEELLKRLKELNDKTFEELERILEELKRANERDHMVLHEYVNAAGITIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1496 - protein, 240 aa, Artificial Sequence
  Synthetic
SKEETLKRLLDELEKRNRETVERLERLLKELEDRNRRDHMVLHEYVNAAGITIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1497 - protein, 240 aa, Artificial Sequence; identical to SEQ ID NO: 1496
  Synthetic

SEQ ID NO: 1498 - protein, 243 aa, Artificial Sequence
  Synthetic
DEEETLRRLLERKVELAKEYLDVSKEVIDRTTKLLDRDHMVLHEYVNAAGITLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 1499 - protein, 243 aa, Artificial Sequence; identical to SEQ ID NO: 1498
  Synthetic

SEQ ID NO: 1500 - protein, 243 aa, Artificial Sequence
  Synthetic
SEAERTKESLKKVLKALVDLNRELLRKLEENMRELTRDHMVLHEYVNAAGITVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1501 - protein, 178 aa, Artificial Sequence
  Synthetic
DEVEKLLRDLEELDRDIERKVRELLKRNKEVLDDIERRDHMVLHEYVNAAGITADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 1502 - protein, 182 aa, Artificial Sequence
  Synthetic
DEAEKLLKELRDLLEESRKDLERLLKELEDLLEESKRRDHMVLHEYVNAAGITKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 1503 - protein, 181 aa, Artificial Sequence
  Synthetic
SEVERVLEDLRRLVRDVEEKLRRIIERDRRLVEEVERRDHMVLHEYVNAAGITLEELKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 1504 - protein, 174 aa, Artificial Sequence
  Synthetic
SEDETIRRIVRTVHEESRKSTEDVRREVERVLRESEERDHMVLHEYVNAAGITEETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 1505 - protein, 174 aa, Artificial Sequence
  Synthetic
SELEKVVKEVADLLRRNLEKSKRVLEEVRRRLEENLRRDHMVLHEYVNAAGITLELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 1506 - protein, 178 aa, Artificial Sequence
  Synthetic
DDLERVLKEIKKAADKIREDNKRTADKIRKRVKELDDRDHMVLHEYVNAAGITKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 1507 - protein, 181 aa, Artificial Sequence
  Synthetic
DEEETLEDVLRELEERVEKLLRDLTRDLERVEKEHKERDHMVLHEYVNAAGITEELLKRIEDDEKLRRLKEEVRKLVEESRERNKRHHKEVREVLERIRELLERLEKELRRALEEIRDKIRKDGATDEILRKIEELLRRAEEVIRDLERKVRKLERDIRENIKKNHREVREILRKIEEDVR

SEQ ID NO: 1508 - protein, 175 aa, Artificial Sequence
  Synthetic
SEEDELRRLLKEVNERVERLLDEIRKELEKIAEELRDRDHMVLHEYVNAAGITEENRVDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 1509 - protein, 177 aa, Artificial Sequence
  Synthetic
SAIEKVKEVVERVLETVRDSVRRSHEESKRLIDKVRKRDHMVLHEYVNAAGITRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 1510 - protein, 183 aa, Artificial Sequence
  Synthetic
KDAEDLERRVRELVEENNRVSKRLAEEVTRLVKENEDRDHMVLHEYVNAAGITLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 1511 - protein, 183 aa, Artificial Sequence
  Synthetic
SEIEKLVEDVRKLVEDNLRHSEEVHRRNRRLIEENERRDHMVLHEYVNAAGITRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1512 - protein, 177 aa, Artificial Sequence
  Synthetic
REIEELRKEIETLIRENEELNRRSKETSEELIRRLKKRDHMVLHEYVNAAGITRDRGAPEEDVRRAEERVKKLIEDNKRHSDEVAKTDKKLNEDSERHTRRVEERLRELLDRLSRSDKDEVVRRVAEEARRLSKRNKDAIREVNETSRRLATRDAKHTRDVLREIKRLADEIRERTR

SEQ ID NO: 1513 - protein, 174 aa, Artificial Sequence
  Synthetic
REIEEAAKDLDRLLEENKKLVKEVEEELRRLLKENRDRDHMVLHEYVNAAGITRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 1514 - protein, 182 aa, Artificial Sequence
  Synthetic
DEIETVLDEVRRLHEDAKRRLEEMIDEVRKLNEESVRRDHMVLHEYVNAAGITKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 1515 - protein, 182 aa, Artificial Sequence
  Synthetic
DELEEVVRRVRELSRTVKEELREVIERVRELSERVKKRDHMVLHEYVNAAGITMKRVRDSGLDKSKLEKLEDESRRVLDKSREILRKNEEDNRRLNKELEEILKKNEDDNEDVRRKVDEVTRKGKDAEEVLREVEKVVEDSRRSAKDALKRVEDRVRESDKSVRELLEENRKVVEDIKRRVD

SEQ ID NO: 1516 - protein, 182 aa, Artificial Sequence
  Synthetic
SDADRVAEELKKLVEDSRRENERVIEESKRLVKENEDRDHMVLHEYVNAAGITRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 1517 - protein, 175 aa, Artificial Sequence
  Synthetic
SEVDEVLREAKRIVDEVHKDNERATEESRRLVKKVHERDHMVLHEYVNAAGITKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1518 - protein, 186 aa, Artificial Sequence
  Synthetic
SRVDEVIERLERLLRELDKINRDMIEDDKRLNTELNKRDHMVLHEYVNAAGITEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 1519 - protein, 185 aa, Artificial Sequence
  Synthetic
DDIERLKREIERLLKEAEKISRDNEERSKELLDRLRKRDHMVLHEYVNAAGITKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 1520 - protein, 184 aa, Artificial Sequence
  Synthetic
ELIKKARKDVEEVRERSERLVDELRKRNKKLADESRRRDHMVLHEYVNAAGITEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1521 - protein, 186 aa, Artificial Sequence
  Synthetic
KEVEDLERTVRTILKRMRELITRNEEEIRRSIEELKKRDHMVLHEYVNAAGITKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 1522 - protein, 179 aa, Artificial Sequence
  Synthetic
RLEDEVRKMEKEVREEVKRLEDESRKVLEESRRNLDKRDHMVLHEYVNAAGITKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1523 - protein, 183 aa, Artificial Sequence
  Synthetic
SVDERLDEVLERVKEDMDRNRRKNDESLREDEENVRRRDHMVLHEYVNAAGITRELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 1524 - protein, 183 aa, Artificial Sequence
  Synthetic
SIREKIRELEERLEEVLRRIEENSERVLREAERVLKERDHMVLHEYVNAAGITEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 1525 - protein, 182 aa, Artificial Sequence
  Synthetic
SIEDLVRELKKKVDEVAEDLRRKVREALERSRENIDRRDHMVLHEYVNAAGITDKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 1526 - protein, 179 aa, Artificial Sequence
  Synthetic
SKAEEVEELVKKLLAEVKKSLDDVRRTVEKLLREVRKRDHMVLHEYVNAAGITKDLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 1527 - protein, 174 aa, Artificial Sequence
  Synthetic
SESDEVIRDLARLLDELARHVDDSVRRMDEVVKRSTRRDHMVLHEYVNAAGITEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1528 - protein, 174 aa, Artificial Sequence; identical to SEQ ID NO: 1527
  Synthetic

SEQ ID NO: 1529 - protein, 174 aa, Artificial Sequence
  Synthetic
SESDDVIRKLRELLEELRTHVEKSIRDLRKILEDSTRRDHMVLHEYVNAAGITRKKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 1530 - protein, 177 aa, Artificial Sequence
  Synthetic
DEVRELLERNRRLLEEIKKTVKDLIRANEELLKRIEDRDHMVLHEYVNAAGITEKGLSDDETIREAKERLKASLEDVKRRVEEVKRLLEKSLEEVETIIREAEKRNRDSLREMERRGSSEELEELRRVVEESDETIKRLLEEAKESVDRSLDRIRKLLEDVRRSVERSAKRIDEKRK

SEQ ID NO: 1531 - protein, 184 aa, Artificial Sequence
  Synthetic
DEIRKVVKEITDLLKASNDKNRKVVEEIRDLLRKSKKRDHMVLHEYVNAAGITRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1532 - protein, 238 aa, Artificial Sequence
  Synthetic
EEDERLTKRVEEIKRENRELLRRLEEEVKELERKSEKRDHMVLHEYVNAAGITDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1533 - protein, 247 aa, Artificial Sequence
  Synthetic
SEKEELLKLIKRVIELLKRVLEEHLRLVEDVIRRLKERDHMVLHEYVNAAGITKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 1534 - protein, 238 aa, Artificial Sequence
  Synthetic
SEAEKIREALETNLRLLEELIKRLKEILDTHNELLRRRDHMVLHEYVNAAGITEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1535 - protein, 248 aa, Artificial Sequence
  Synthetic
SAEEELEKLVRKVEEDLKRLEEESERIKKEIKDTLRARDHMVLHEYVNAAGITRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKVHEESLRKLLTLAAKVLEVLRKITK

SEQ ID NO: 1536 - protein, 240 aa, Artificial Sequence
  Synthetic
SDKEEIKRRVEKTARDLETEHDKIKKRLEDTVRDIKRRDHMVLHEYVNAAGITEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1537 - protein, 248 aa, Artificial Sequence
  Synthetic
DEEERVKKLLTDLRRLLRKLHEESKKLLDELRKKLRERDHMVLHEYVNAAGITREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 1538 - protein, 236 aa, Artificial Sequence
  Synthetic
STREKAKKVLDTLRADNEDMKRVVEKILRALKRTNERRDHMVLHEYVNAAGITKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1539 - protein, 247 aa, Artificial Sequence
  Synthetic
SKAEKLLKDLREALEKVKRRYEELERRLDEVLKEHEERDHMVLHEYVNAAGITEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 1540 - protein, 231 aa, Artificial Sequence
  Synthetic
SKEEEVEKVLRKWEEILRRLIEENKRANDKIRREYEERDHMVLHEYVNAAGITERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1541 - protein, 231 aa, Artificial Sequence; identical to SEQ ID NO: 1540
  Synthetic

SEQ ID NO: 1542 - protein, 247 aa, Artificial Sequence
  Synthetic
RDRDVLRKVKAEIEELVARIEKVSRDALSEVKRLLDERDHMVLHEYVNAAGITRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 1543 - protein, 231 aa, Artificial Sequence
  Synthetic
SKDEELARLLEELVERWRKIVEDLERDHRRLVKEIRERDHMVLHEYVNAAGITRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1544 - protein, 238 aa, Artificial Sequence
  Synthetic
SEIEDVIRRLRKILEDLERVSEKLLREIKKILDEARRRDHMVLHEYVNAAGITVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 1545 - protein, 246 aa, Artificial Sequence
  Synthetic
SREEIVATLEDLARKILEVVKKLAKEIEDAWREIERARDHMVLHEYVNAAGITDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRIHEKIVEDLIKLLEELLRRLEEATR

SEQ ID NO: 1546 - protein, 237 aa, Artificial Sequence
  Synthetic
KEKEDALKKLEDLARKSREDLERVLRKHKKILDKIEERDHMVLHEYVNAAGITLRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1547 - protein, 237 aa, Artificial Sequence; identical to SEQ ID NO: 1546
  Synthetic

SEQ ID NO: 1548 - protein, 229 aa, Artificial Sequence
  Synthetic
SKEERLREVAEKHKKDLEDIVKRVDEAAKETARRLEERDHMVLHEYVNAAGITEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1549 - protein, 241 aa, Artificial Sequence
  Synthetic
SEKELLKEILDRIRELLEDDNRLLKRIVDEIRKLLEERDHMVLHEYVNAAGITDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 1550 - protein, 246 aa, Artificial Sequence
  Synthetic
SEREELLERIKEILKRVKDKLDEDLKRLKEILEKLKERDHMVLHEYVNAAGITREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 1551 - protein, 240 aa, Artificial Sequence
  Synthetic
DREKSVRDIEEDLKRVLDKLRRRVETSKEELKKVLKARDHMVLHEYVNAAGITRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1552 - protein, 240 aa, Artificial Sequence; identical to SEQ ID NO: 1551
  Synthetic

SEQ ID NO: 1553 - protein, 237 aa, Artificial Sequence
  Synthetic
REDEVLRDIERLLREIEEKIRRILEESTAELRKVEEERDHMVLHEYVNAAGITEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1554 - protein, 237 aa, Artificial Sequence; identical to SEQ ID NO: 1553
  Synthetic

SEQ ID NO: 1555 - protein, 243 aa, Artificial Sequence
  Synthetic
SEAERLADEVRKAVKKSEEDNETLVREVEKAVRELKKRDHMVLHEYVNAAGITVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1556 - protein, 243 aa, Artificial Sequence; identical to SEQ ID NO: 1555
  Synthetic

SEQ ID NO: 1557 - protein, 245 aa, Artificial Sequence
  Synthetic
SEKDEVTRRIRELLKEAEETNREAIERIKRLLDRVRERDHMVLHEYVNAAGITKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1558 - protein, 245 aa, Artificial Sequence; identical to SEQ ID NO: 1557
  Synthetic

SEQ ID NO: 1559 - protein, 243 aa, Artificial Sequence
  Synthetic
SRVEELKKLIEDILRISREVVERIARVAEDIHRINRRRDHMVLHEYVNAAGITEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 1560 - protein, 249 aa, Artificial Sequence
  Synthetic
DAEEVVKRLADVLRENDETIRKVVEDLVRIAEENDRLRDHMVLHEYVNAAGITELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1561 - protein, 249 aa, Artificial Sequence; identical to SEQ ID NO: 1560
  Synthetic

SEQ ID NO: 1562 - protein, 240 aa, Artificial Sequence
  Synthetic
DKDKRLEELLKRLKELNDKTFEELERILEELKRANEARDHMVLHEYVNAAGITEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1563 - protein, 240 aa, Artificial Sequence; identical to SEQ ID NO: 1562
  Synthetic

SEQ ID NO: 1564 - protein, 240 aa, Artificial Sequence
  Synthetic
SKEETLKRLLDELEKRNRETVERLERLLKELEDRNRARDHMVLHEYVNAAGITEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1565 - protein, 240 aa, Artificial Sequence; identical to SEQ ID NO: 1564
  Synthetic

SEQ ID NO: 1566 - protein, 243 aa, Artificial Sequence
  Synthetic
SEAERTKESLKKVLKALVDLNRELLRKLEENMRELTKRDHMVLHEYVNAAGITREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1567 - protein, 241 aa, Artificial Sequence
  Synthetic
SADEALEELVRRLLEVLKTVLERTKELSRDDLRVVKERDHMVLHEYVNAAGITRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERLLEELKRRVERLLEDIERLLAELEKLNEDVLRENKALLEDLERRVRERKK

SEQ ID NO: 1568 - protein, 186 aa, Artificial Sequence
  Synthetic
SAEDSIRELLERDERLLEEARKEAKRLNEENERLLERIRDHMVLHEYVNAAGITDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 1569 - protein, 177 aa, Artificial Sequence
  Synthetic
ELREDVERVVDEIRRLVEENVRRIDEVAKDIKRLADDNRDHMVLHEYVNAAGITRLKEEGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 1570 - protein, 174 aa, Artificial Sequence
  Synthetic
SEDETIRRIVRTVHEESRKSTEDVRREVERVLRESEEVRDHMVLHEYVNAAGITETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 1571 - protein, 180 aa, Artificial Sequence
  Synthetic
SKEEVLREIERLHKETIRRIEEVLREATELHKRLTETNRDHMVLHEYVNAAGITDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 1572 - protein, 187 aa, Artificial Sequence
  Synthetic
DEEEELRKRLEKLSKEVRELLRRDEEEDRRLNRELEELRDHMVLHEYVNAAGITDLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 1573 - protein, 181 aa, Artificial Sequence
  Synthetic
DEERKLEKSLKDVEDTHRRLLEKNDEDLKELRKRVEDMRDHMVLHEYVNAAGITEKLKRIEDDETLKRLRKRVKELLDEIRRRLERLEREVDKRLEEIKERNDRHHEEAKKELKRIRDKIRRDGADEKILREVEDLLRKVAEDLKRSNDEVKELAERLEETIRDLLRRIEEILKEIEERVR

SEQ ID NO: 1574 - protein, 175 aa, Artificial Sequence
  Synthetic
SEKEDLERELEEVRRRVEESLRKNEEDVKRVRDELKKLRDHMVLHEYVNAAGITRANVDKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 1575 - protein, 177 aa, Artificial Sequence
  Synthetic
SAIEKVKEVVERVLETVRDSVRRSHEESKRLIDKVRKRRDHMVLHEYVNAAGITRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 1576 - protein, 177 aa, Artificial Sequence
  Synthetic
SVLEEVRRRVEELLKTVKESVDRSHERSERLIEEVRESRDHMVLHEYVNAAGITEKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 1577 - protein, 178 aa, Artificial Sequence
  Synthetic
SSIERVEKEVRRLLRESDESLKRVMEEAKELIKSVRESRDHMVLHEYVNAAGITERTGDEREDLRRVLEELRKLIEDNRREDKRSEDELRKLIRDNKEENDRARREAEKLLEDLSRGRSEEEVERVLEEVRRIIEKLKEDDKRSLERIERIVRRNNELNKESVDRIRKIIKEMEERAD

SEQ ID NO: 1578 - protein, 177 aa, Artificial Sequence
  Synthetic
SVIERVEEEMEKVIRDSERVTKEVEDRAREVHERSEKRRDHMVLHEYVNAAGITRAGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 1579 - protein, 179 aa, Artificial Sequence
  Synthetic
SSKEVADELRKKAEKVLDELRKIIRELERKNEDSLRRTRDHMVLHEYVNAAGITDLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 1580 - protein, 183 aa, Artificial Sequence
  Synthetic
KDAEDLERRVRELVEENNRVSKRLAEEVTRLVKENEDKRDHMVLHEYVNAAGITDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 1581 - protein, 174 aa, Artificial Sequence
  Synthetic
SEIEELEKRIDELLKELRDLSRRIAEEVKRLLEELKKLRDHMVLHEYVNAAGITRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 1582 - protein, 174 aa, Artificial Sequence
  Synthetic
DELRDVKRELDRLLRENEEIVERIAETVRRLLEELKKLRDHMVLHEYVNAAGITKRGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 1583 - protein, 174 aa, Artificial Sequence
  Synthetic
DEEEDLERRIKKLLDENRELLKRIAEELRRLLEELRRLRDHMVLHEYVNAAGITDRGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 1584 - protein, 174 aa, Artificial Sequence
  Synthetic
REIEEAAKDLDRLLEENKKLVKEVEEELRRLLKENRDLRDHMVLHEYVNAAGITRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 1585 - protein, 177 aa, Artificial Sequence
  Synthetic
SEAEKVVEELKKLLREVEKKIRDHTEDVKRILEELERRRDHMVLHEYVNAAGITDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1586 - protein, 182 aa, Artificial Sequence
  Synthetic
DEIETVLDEVRRLHEDAKRRLEEMIDEVRKLNEESVRERDHMVLHEYVNAAGITEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 1587 - protein, 178 aa, Artificial Sequence
  Synthetic
SKVEKLEEEIARLVERSRRLVEELKKEVTKVKEKVDEIRDHMVLHEYVNAAGITDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 1588 - protein, 186 aa, Artificial Sequence
  Synthetic
SEVDEVRKTLEDLLRRLDEENKDIIRRNKELLDDLDRKRDHMVLHEYVNAAGITKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1589 - protein, 184 aa, Artificial Sequence
  Synthetic
ELIKKARKDVEEVRERSERLVDELRKRNKKLADESRRLRDHMVLHEYVNAAGITDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1590 - protein, 186 aa, Artificial Sequence
  Synthetic
KEVEDLERRVKEILDRMKRLIDENRKKIEKSIRELERLRDHMVLHEYVNAAGITDLKREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 1591 - protein, 176 aa, Artificial Sequence
  Synthetic
REAEEAKEEVEELNRRNKKELDDARRRVDELDKRNKDRRDHMVLHEYVNAAGITRVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 1592 - protein, 182 aa, Artificial Sequence
  Synthetic
SELEKTLEDLKRHSEENKKKLEEDLRDMERNLKENKDRRDHMVLHEYVNAAGITRRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 1593 - protein, 179 aa, Artificial Sequence
  Synthetic
RLEDEVRKMEKEVREEVKRLEDESRKVLEESRRNLDKLRDHMVLHEYVNAAGITDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1594 - protein, 183 aa, Artificial Sequence
  Synthetic
RVDERLDTVLKRVEETVRENKKKNDELLERSKENIDRLRDHMVLHEYVNAAGITKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 1595 - protein, 183 aa, Artificial Sequence
  Synthetic
SVDERLDEVLERVKEDMDRNRRKNDESLREDEENVRRNRDHMVLHEYVNAAGITELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 1596 - protein, 183 aa, Artificial Sequence
  Synthetic
SIREKIRELEERLEEVLRRIEENSERVLREAERVLKEIRDHMVLHEYVNAAGITEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 1597 - protein, 182 aa, Artificial Sequence
  Synthetic
SIEDLVRELKKKVDEVAEDLRRKVREALERSRENIDRLRDHMVLHEYVNAAGITKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 1598 - protein, 172 aa, Artificial Sequence
  Synthetic
SRAETVLKEVTDKIKKLADSSDELLRRNKENIDELKKSRDHMVLHEYVNAAGITKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 1599 - protein, 174 aa, Artificial Sequence
  Synthetic
DEEEDLERAIKKLLDENRELLKRIAEELRRLLEELRRLRDHMVLHEYVNAAGITDRGVPEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 1600 - protein, 184 aa, Artificial Sequence
  Synthetic
DEIRKVVKEITDLLKASNDKNRKVVEEIRDLLRKSKKLRDHMVLHEYVNAAGITRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1601 - protein, 177 aa, Artificial Sequence
  Synthetic
SKEDRLREELKKLLARLAEEIERLKRALEESNKDLKRTRDHMVLHEYVNAAGITRGGVSEELLRELERSTAENKERAKELLKRHEDLVRKVEKELADLLRRLEEIVARVDEALKRGISEEELDKLLKEARDLIREIEKRLEELLKRVEKLTEDAKRDLERSNREHKELADRIKETAR

SEQ ID NO: 1602 - protein, 243 aa, Artificial Sequence
  Synthetic
KREDILKKLEDIIRDIIDKLRRILEKVKRLNEDIIREIRDHMVLHEYVNAAGITRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 1603 - protein, 244 aa, Artificial Sequence
  Synthetic
SAEETLRRITEESKRVLEEITKKYEDLERESREVLRKLRDHMVLHEYVNAAGITKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 1604 - protein, 242 aa, Artificial Sequence
  Synthetic
SEKERLMRLLDKLKDLNRRLVERIKELLDKALELHKKLRDHMVLHEYVNAAGITRGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 1605 - protein, 242 aa, Artificial Sequence; identical to SEQ ID NO: 1604
  Synthetic

SEQ ID NO: 1606 - protein, 240 aa, Artificial Sequence
  Synthetic
SDKEEIKRRVEKTARDLETEHDKIKKRLEDTVRDIKRERDHMVLHEYVNAAGITKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1607 - protein, 248 aa, Artificial Sequence
  Synthetic
DEDRIIEEIARLLEELLRELLELIKKLIETNRRLNEEHRDHMVLHEYVNAAGITRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 1608 - protein, 248 aa, Artificial Sequence; identical to SEQ ID NO: 1607
  Synthetic

SEQ ID NO: 1609 - protein, 238 aa, Artificial Sequence
  Synthetic
DADELLRRLAEEVERVIREAEDLLRRWKETIKKVLDDLRDHMVLHEYVNAAGITELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 1610 - protein, 231 aa, Artificial Sequence
  Synthetic
DKAEVLREALKLLKDLLEELIKIHEESLKRILDLIDTLRDHMVLHEYVNAAGITRSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 1611 - protein, 236 aa, Artificial Sequence
  Synthetic
STREKAKKVLDTLRADNEDMKRVVEKILRALKRTNERARDHMVLHEYVNAAGITEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1612 - protein, 247 aa, Artificial Sequence
  Synthetic
RDRDVLRKVKAEIEELVARIEKVSRDALSEVKRLLDENRDHMVLHEYVNAAGITKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 1613 - protein, 231 aa, Artificial Sequence
  Synthetic
SKDEELARLLEELVERWRKIVEDLERDHRRLVKEIRELRDHMVLHEYVNAAGITKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1614 - protein, 229 aa, Artificial Sequence
  Synthetic
SKEERLREVAEKHKKDLEDIVKRVDEAAKETARRLEEIRDHMVLHEYVNAAGITKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1615 - protein, 229 aa, Artificial Sequence; identical to SEQ ID NO: 1614
  Synthetic

SEQ ID NO: 1616 - protein, 246 aa, Artificial Sequence
  Synthetic
SEREELLERIKEILKRVKDKLDEDLKRLKEILEKLKEKRDHMVLHEYVNAAGITEKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 1617 - protein, 240 aa, Artificial Sequence
  Synthetic
DREKSVRDIEEDLKRVLDKLRRRVETSKEELKKVLKADRDHMVLHEYVNAAGITELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1618 - protein, 240 aa, Artificial Sequence; identical to SEQ ID NO: 1617
  Synthetic

SEQ ID NO: 1619 - protein, 241 aa, Artificial Sequence
  Synthetic
SAEEAVEKLVRIARAIVKINEDLSREVVRILREIVRLNRDHMVLHEYVNAAGITVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 1620 - protein, 237 aa, Artificial Sequence
  Synthetic
REDEVLRDIERLLREIEEKIRRILEESTAELRKVEEEVRDHMVLHEYVNAAGITDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1621 - protein, 243 aa, Artificial Sequence
  Synthetic
SEAERLADEVRKAVKKSEEDNETLVREVEKAVRELKKNRDHMVLHEYVNAAGITDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1622 - protein, 245 aa, Artificial Sequence
  Synthetic
SEKDEVTRRIRELLKEAEETNREAIERIKRLLDRVREARDHMVLHEYVNAAGITKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1623 - protein, 243 aa, Artificial Sequence
  Synthetic
SRVEELKKLIEDILRISREVVERIARVAEDIHRINRRVRDHMVLHEYVNAAGITEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 1624 - protein, 249 aa, Artificial Sequence
  Synthetic
DAEEVVKRLADVLRENDETIRKVVEDLVRIAEENDRLWRDHMVLHEYVNAAGITLLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1625 - protein, 240 aa, Artificial Sequence
  Synthetic
DKDKRLEELLKRLKELNDKTFEELERILEELKRANEASRDHMVLHEYVNAAGITGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1626 - protein, 240 aa, Artificial Sequence
  Synthetic
SKEETLKRLLDELEKRNRETVERLERLLKELEDRNRASRDHMVLHEYVNAAGITESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1627 - protein, 240 aa, Artificial Sequence; identical to SEQ ID NO: 1626
  Synthetic

SEQ ID NO: 1628 - protein, 243 aa, Artificial Sequence
  Synthetic
DEEETLRRLLERKVELAKEYLDVSKEVIDRTTKLLDEYRDHMVLHEYVNAAGITRGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 1629 - protein, 243 aa, Artificial Sequence
  Synthetic
SEAERTKESLKKVLKALVDLNRELLRKLEENMRELTKLRDHMVLHEYVNAAGITEGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1630 - protein, 186 aa, Artificial Sequence
  Synthetic
SAEDSIRELLERDERLLEEARKEAKRLNEENERLLERIERDHMVLHEYVNAAGITIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 1631 - protein, 182 aa, Artificial Sequence
  Synthetic
DEAEKLLKELRDLLEESRKDLERLLKELEDLLEESKRDLRDHMVLHEYVNAAGITTVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 1632 - protein, 182 aa, Artificial Sequence
  Synthetic
RVEDALRKLLDDVRRLVEEAERRLRTSNDKSRRLVEEAKRDHMVLHEYVNAAGITVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 1633 - protein, 183 aa, Artificial Sequence
  Synthetic
KVEKRLTDLLKTVADEVKRVEDELRETVRESKEVVDKSRRDHMVLHEYVNAAGITAERRVSEDLVRRIRKVLDENREVNDRVVKEDERILEENERVNRKVVEKIRDILRKIEEVVRRAAEEIRDEEVVKKVEKEIRELLERLKEEADRVRERSKKILTDLKKSSEDVKRESERMLKKLEDEIR

SEQ ID NO: 1634 - protein, 184 aa, Artificial Sequence
  Synthetic
SLEEVIKTVRKLLEEVERRLREVVERAERMLEEVRRRTRRDHMVLHEYVNAAGITLRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 1635 - protein, 184 aa, Artificial Sequence
  Synthetic
KLDEVIEEIRKLLRRMEEELRRSVEEIDKLLREVRELLRRDHMVLHEYVNAAGITLKKRGVPEEVKERLDRLVETLRRLSEETLKELDKLVREVKELSKESLKRLRELVERLRRELEEIKKRGEDEKLVEDLKRRAEEVIRELREIVKRNTEIAREVVERAKRIVEKNEKLLKDVVEEAKKIVK

SEQ ID NO: 1636 - protein, 181 aa, Artificial Sequence
  Synthetic
SEVERVLEDLRRLVRDVEEKLRRIIERDRRLVEEVERENRDHMVLHEYVNAAGITELKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 1637 - protein, 177 aa, Artificial Sequence
  Synthetic
KEEEDLEREVKRLEDKVREDAKKLEEVVKTVEKLVRDDARDHMVLHEYVNAAGITLTERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 1638 - protein, 180 aa, Artificial Sequence
  Synthetic
STEEVLDEIRKLHKTLTEDIKRVLREIEELHRRTIEENKRDHMVLHEYVNAAGITVRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 1639 - protein, 180 aa, Artificial Sequence
  Synthetic
SKEEVLDEMRRLHETTKRDIRRVLKEIEELHERTLRENKRDHMVLHEYVNAAGITIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 1640 - protein, 187 aa, Artificial Sequence
  Synthetic
SEKERLKEELEKLSKEIEDILRDDKRSDDELRRRLRELLRDHMVLHEYVNAAGITMLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 1641 - protein, 187 aa, Artificial Sequence
  Synthetic
DEEEELRKRLEKLSKEVRELLRRDEEEDRRLNRELEELLRDHMVLHEYVNAAGITLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 1642 - protein, 171 aa, Artificial Sequence
  Synthetic
SEKEKVIKEARELLERLRKRLKDVNDDVTRLLDELRKENRDHMVLHEYVNAAGITEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 1643 - protein, 177 aa, Artificial Sequence
  Synthetic
SAIEKVKEVVERVLETVRDSVRRSHEESKRLIDKVRKRLRDHMVLHEYVNAAGITKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 1644 - protein, 179 aa, Artificial Sequence
  Synthetic
SSKEVADELRKKAEKVLDELRKIIRELERKNEDSLRRTERDHMVLHEYVNAAGITLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 1645 - protein, 174 aa, Artificial Sequence
  Synthetic
SEIEELEKRIDELLKELRDLSRRIAEEVKRLLEELKKLSRDHMVLHEYVNAAGITKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 1646 - protein, 182 aa, Artificial Sequence
  Synthetic
SDADRVAEELKKLVEDSRRENERVIEESKRLVKENEDRNRDHMVLHEYVNAAGITILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 1647 - protein, 178 aa, Artificial Sequence
  Synthetic
SEEEKLKEVKDRIREVLRKLEEHTDKVKKEVEKVLRDIRRDHMVLHEYVNAAGITLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 1648 - protein, 183 aa, Artificial Sequence
  Synthetic
SEVDEVLERIKRLLERLAEHSDKVVRDIEKLLDDNRKENRDHMVLHEYVNAAGITMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 1649 - protein, 179 aa, Artificial Sequence
  Synthetic
KDEETLKRLLEKAKEVVDRLKDENEKVTRDNHESVKKAKRDHMVLHEYVNAAGITAIRRVREAKEVVDTAEKLLRDNHEHSRDTVKKARELNETSRRHSERIVEKIEEILEEVERTLRENRGDVRELAKKVEKAIRELEELSRENREAVKRISDEIKRLSDENAKDSERIIKEIDDRVR

SEQ ID NO: 1650 - protein, 179 aa, Artificial Sequence
  Synthetic
REDERLEEIARKIKKVVDELVERNKKLTEDNHESVRRAERDHMVLHEYVNAAGITAIERIRSDKKVVDEVKKLLEDAKKHSKEVIDELRRLNEESKRSSEDTIRRMRKLLRELEETVKAKKGDVEDIERKVEDIIRRLEDLSRRNEEKVRRISEEIKKLSKDNERTIKEIIKEIEERVK

SEQ ID NO: 1651 - protein, 184 aa, Artificial Sequence
  Synthetic
ELIKKARKDVEEVRERSERLVDELRKRNKKLADESRRLIRDHMVLHEYVNAAGITLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1652 - protein, 179 aa, Artificial Sequence
  Synthetic
RLEDEVRKMEKEVREEVKRLEDESRKVLEESRRNLDKLRRDHMVLHEYVNAAGITLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1653 - protein, 179 aa, Artificial Sequence
  Synthetic
SKAEEVEELVKKLLAEVKKSLDDVRRTVEKLLREVRKSLRDHMVLHEYVNAAGITLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 1654 - protein, 174 aa, Artificial Sequence
  Synthetic
SESDEVIRDLARLLDELARHVDDSVRRMDEVVKRSTREARDHMVLHEYVNAAGITKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1655 - protein, 174 aa, Artificial Sequence; identical to SEQ ID NO: 1654
  Synthetic

SEQ ID NO: 1656 - protein, 174 aa, Artificial Sequence
  Synthetic
SESDDVIRKLRELLEELRTHVEKSIRDLRKILEDSTRHARDHMVLHEYVNAAGITKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 1657 - protein, 186 aa, Artificial Sequence
  Synthetic
SRVEEIIEDLRRLLEEIRKENEDSIRRSKELLDRVKEINRDHMVLHEYVNAAGITEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 1658 - protein, 186 aa, Artificial Sequence
  Synthetic
SEVDEIIKELERLLAEIARENERIIRESRKLADEVRKRNRDHMVLHEYVNAAGITAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 1659 - protein, 185 aa, Artificial Sequence
  Synthetic
SSVEELLERLRRISEENKRRIEKLLREVEKVLRELKDRHRDHMVLHEYVNAAGITEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 1660 - protein, 180 aa, Artificial Sequence
  Synthetic
SELEEVLRRIEALVRKAHKENEDVLREIERLVRTAHRLNRDHMVLHEYVNAAGITGGREDKDKVEEALRRLRELYRRLEEENRRILREIEELVKELEKRNREILKELEDLVADAERKGSDGSEAVRRLKEILERLKEEVRRSLEELRKEVERLKKEVEDSLRELKKSLEEWVKSLEEATR

SEQ ID NO: 1661 - protein, 238 aa, Artificial Sequence
  Synthetic
EEDERLTKRVEEIKRENRELLRRLEEEVKELERKSEKIVRDHMVLHEYVNAAGITGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1662 - protein, 244 aa, Artificial Sequence
  Synthetic
SAEETLRRITEESKRVLEEITKKYEDLERESREVLRKLRRDHMVLHEYVNAAGITGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 1663 - protein, 244 aa, Artificial Sequence; identical to SEQ ID NO: 1662
  Synthetic

SEQ ID NO: 1664 - protein, 250 aa, Artificial Sequence
  Synthetic
STEEILKRVKEILDELAKELRDIIRESLRTIEELLDELRRDHMVLHEYVNAAGITIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 1665 - protein, 238 aa, Artificial Sequence
  Synthetic
SEAEKIREALETNLRLLEELIKRLKEILDTHNELLRRVIRDHMVLHEYVNAAGITGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1666 - protein, 248 aa, Artificial Sequence
  Synthetic
SAEEELEKLVRKVEEDLKRLEEESERIKKEIKDTLRAIRRDHMVLHEYVNAAGITLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKVHEESLRKLLTLAAKVLEVLRKITK

SEQ ID NO: 1667 - protein, 240 aa, Artificial Sequence
  Synthetic
SDKEEIKRRVEKTARDLETEHDKIKKRLEDTVRDIKRELRDHMVLHEYVNAAGITTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1668 - protein, 248 aa, Artificial Sequence
  Synthetic
DEEERVKKLLTDLRRLLRKLHEESKKLLDELRKKLRELRRDHMVLHEYVNAAGITAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 1669 - protein, 248 aa, Artificial Sequence
  Synthetic
DEDRIIEEIARLLEELLRELLELIKKLIETNRRLNEEHERDHMVLHEYVNAAGITLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 1670 - protein, 238 aa, Artificial Sequence
  Synthetic
DADELLRRLAEEVERVIREAEDLLRRWKETIKKVLDDLKRDHMVLHEYVNAAGITLTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 1671 - protein, 238 aa, Artificial Sequence; identical to SEQ ID NO: 1670
  Synthetic

SEQ ID NO: 1672 - protein, 236 aa, Artificial Sequence
  Synthetic
STREKAKKVLDTLRADNEDMKRVVEKILRALKRTNERAERDHMVLHEYVNAAGITVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1673 - protein, 236 aa, Artificial Sequence; identical to SEQ ID NO: 1672
  Synthetic

SEQ ID NO: 1674 - protein, 247 aa, Artificial Sequence
  Synthetic
SKAEKLLKDLREALEKVKRRYEELERRLDEVLKEHEEIVRDHMVLHEYVNAAGITGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 1675 - protein, 247 aa, Artificial Sequence; identical to SEQ ID NO: 1674
  Synthetic

SEQ ID NO: 1676 - protein, 231 aa, Artificial Sequence
  Synthetic
SKEEEVEKVLRKWEEILRRLIEENKRANDKIRREYEELVRDHMVLHEYVNAAGITLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1677 - protein, 247 aa, Artificial Sequence
  Synthetic
RDRDVLRKVKAEIEELVARIEKVSRDALSEVKRLLDENRRDHMVLHEYVNAAGITIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 1678 - protein, 237 aa, Artificial Sequence
  Synthetic
KEKEDALKKLEDLARKSREDLERVLRKHKKILDKIEELLRDHMVLHEYVNAAGITKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1679 - protein, 229 aa, Artificial Sequence
  Synthetic
SKEERLREVAEKHKKDLEDIVKRVDEAAKETARRLEEILRDHMVLHEYVNAAGITGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1680 - protein, 241 aa, Artificial Sequence
  Synthetic
SEKELLKEILDRIRELLEDDNRLLKRIVDEIRKLLEEWLRDHMVLHEYVNAAGITIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 1681 - protein, 241 aa, Artificial Sequence; identical to SEQ ID NO: 1680
  Synthetic

SEQ ID NO: 1682 - protein, 240 aa, Artificial Sequence
  Synthetic
DREKSVRDIEEDLKRVLDKLRRRVETSKEELKKVLKADKRDHMVLHEYVNAAGITLDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1683 - protein, 240 aa, Artificial Sequence; identical to SEQ ID NO: 1682
  Synthetic

SEQ ID NO: 1684 - protein, 237 aa, Artificial Sequence
  Synthetic
REDEVLRDIERLLREIEEKIRRILEESTAELRKVEEEVKRDHMVLHEYVNAAGITVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1685 - protein, 237 aa, Artificial Sequence; identical to SEQ ID NO: 1684
  Synthetic

SEQ ID NO: 1686 - protein, 243 aa, Artificial Sequence
  Synthetic
SEAERLADEVRKAVKKSEEDNETLVREVEKAVRELKKNNRDHMVLHEYVNAAGITLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1687 - protein, 243 aa, Artificial Sequence; identical to SEQ ID NO: 1686
  Synthetic

SEQ ID NO: 1688 - protein, 245 aa, Artificial Sequence
  Synthetic
SEKDEVTRRIRELLKEAEETNREAIERIKRLLDRVREAVRDHMVLHEYVNAAGITVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1689 - protein, 243 aa, Artificial Sequence
  Synthetic
SRVEELKKLIEDILRISREVVERIARVAEDIHRINRRVLRDHMVLHEYVNAAGITILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 1690 - protein, 249 aa, Artificial Sequence
  Synthetic
DAEEVVKRLADVLRENDETIRKVVEDLVRIAEENDRLWKRDHMVLHEYVNAAGITLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1691 - protein, 240 aa, Artificial Sequence
  Synthetic
DKDKRLEELLKRLKELNDKTFEELERILEELKRANEASLRDHMVLHEYVNAAGITGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1692 - protein, 240 aa, Artificial Sequence
  Synthetic
SKEETLKRLLDELEKRNRETVERLERLLKELEDRNRASLRDHMVLHEYVNAAGITSGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1693 - protein, 240 aa, Artificial Sequence; identical to SEQ ID NO: 1692
  Synthetic

SEQ ID NO: 1694 - protein, 243 aa, Artificial Sequence
  Synthetic
DEEETLRRLLERKVELAKEYLDVSKEVIDRTTKLLDEYLRDHMVLHEYVNAAGITGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 1695 - protein, 243 aa, Artificial Sequence
  Synthetic
SEAERTKESLKKVLKALVDLNRELLRKLEENMRELTKLNRDHMVLHEYVNAAGITGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1696 - protein, 243 aa, Artificial Sequence; identical to SEQ ID NO: 1695
  Synthetic

SEQ ID NO: 1697 - protein, 178 aa, Artificial Sequence
  Synthetic
DEVEKLLRDLEELDRDIERKVRELLKRNKEVLDDIEREVRRDHMVLHEYVNAAGITIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 1698 - protein, 181 aa, Artificial Sequence
  Synthetic
SEVERVLEDLRRLVRDVEEKLRRIIERDRRLVEEVERENRRDHMVLHEYVNAAGITLKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 1699 - protein, 174 aa, Artificial Sequence
  Synthetic
SEDETIRRIVRTVHEESRKSTEDVRREVERVLRESEEVVKRDHMVLHEYVNAAGITGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 1700 - protein, 174 aa, Artificial Sequence
  Synthetic
SRDEKIRDILRRVLKEVRDSTKKVEEDLEDVHRRTEEELRRDHMVLHEYVNAAGITGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 1701 - protein, 174 aa, Artificial Sequence
  Synthetic
SELEKVVKEVADLLRRNLEKSKRVLEEVRRRLEENLRESERDHMVLHEYVNAAGITVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 1702 - protein, 180 aa, Artificial Sequence
  Synthetic
STEEVLDEIRKLHKTLTEDIKRVLREIEELHRRTIEENKERDHMVLHEYVNAAGITRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 1703 - protein, 180 aa, Artificial Sequence
  Synthetic
SKEEVLREIERLHKETIRRIEEVLREATELHKRLTETNKRRDHMVLHEYVNAAGITRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 1704 - protein, 180 aa, Artificial Sequence
  Synthetic
SKEEVLDEMRRLHETTKRDIRRVLKEIEELHERTLRENKRRDHMVLHEYVNAAGITKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 1705 - protein, 187 aa, Artificial Sequence
  Synthetic
SEKETVRDELRKLVETIRKLLEEDKESDKRLADRIRELNERDHMVLHEYVNAAGITLEELRKKVSEDELRKLRKRIEDLRRRDEELNKRSREKLEDLNERNKDSLRRIEDELRKLVEEAREVEKRDNDEERLRKLLERLERVIRDLLRKIEENNKRLRKAIKELLDELRKINKELREVIKKLLDDAR

SEQ ID NO: 1706 - protein, 187 aa, Artificial Sequence
  Synthetic
SEKERLKEELEKLSKEIEDILRDDKRSDDELRRRLRELLERDHMVLHEYVNAAGITLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 1707 - protein, 187 aa, Artificial Sequence
  Synthetic
DEEEELRKRLEKLSKEVRELLRRDEEEDRRLNRELEELLKRDHMVLHEYVNAAGITLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 1708 - protein, 175 aa, Artificial Sequence
  Synthetic
SEKEDLERELEEVRRRVEESLRKNEEDVKRVRDELKKLLDRDHMVLHEYVNAAGITNVDKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 1709 - protein, 177 aa, Artificial Sequence
  Synthetic
SVIERVEEEMEKVIRDSERVTKEVEDRAREVHERSEKRIRRDHMVLHEYVNAAGITGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 1710 - protein, 179 aa, Artificial Sequence
  Synthetic
SSKEVADELRKKAEKVLDELRKIIRELERKNEDSLRRTEERDHMVLHEYVNAAGITVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 1711 - protein, 183 aa, Artificial Sequence
  Synthetic
SEIEKLVEDVRKLVEDNLRHSEEVHRRNRRLIEENERKIDRDHMVLHEYVNAAGITAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1712 - protein, 174 aa, Artificial Sequence
  Synthetic
SEIEELEKRIDELLKELRDLSRRIAEEVKRLLEELKKLSKRDHMVLHEYVNAAGITGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 1713 - protein, 174 aa, Artificial Sequence
  Synthetic
DELRDVKRELDRLLRENEEIVERIAETVRRLLEELKKLTKRDHMVLHEYVNAAGITGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 1714 - protein, 174 aa, Artificial Sequence
  Synthetic
DEEEDLERRIKKLLDENRELLKRIAEELRRLLEELRRLTERDHMVLHEYVNAAGITGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 1715 - protein, 174 aa, Artificial Sequence
  Synthetic
REIEEAAKDLDRLLEENKKLVKEVEEELRRLLKENRDLVKRDHMVLHEYVNAAGITGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 1716 - protein, 177 aa, Artificial Sequence
  Synthetic
SEAEKVVEELKKLLREVEKKIRDHTEDVKRILEELERRLRRDHMVLHEYVNAAGITNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1717 - protein, 174 aa, Artificial Sequence
  Synthetic
EELERILDKVRKVIEEVRKRLRDDLRTVEKVLKETEEVLRRDHMVLHEYVNAAGITARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 1718 - protein, 178 aa, Artificial Sequence
  Synthetic
SSKDEIRRRVEEVVERSDEIVKRSREHVKTVVDELDRVVKRDHMVLHEYVNAAGITRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 1719 - protein, 178 aa, Artificial Sequence
  Synthetic
SKVEKLEEEIARLVERSRRLVEELKKEVTKVKEKVDEIVERDHMVLHEYVNAAGITKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 1720 - protein, 182 aa, Artificial Sequence
  Synthetic
SDADRVAEELKKLVEDSRRENERVIEESKRLVKENEDRNRRDHMVLHEYVNAAGITLEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 1721 - protein, 175 aa, Artificial Sequence
  Synthetic
SEVDEVLREAKRIVDEVHKDNERATEESRRLVKKVHEENERDHMVLHEYVNAAGITNIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1722 - protein, 175 aa, Artificial Sequence
  Synthetic
SEMDDVLKKLAETVKRIIERLKKLTDDSRRLVEEVHRRNDRDHMVLHEYVNAAGITNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 1723 - protein, 178 aa, Artificial Sequence
  Synthetic
SEEEKLKEVKDRIREVLRKLEEHTDKVKKEVEKVLRDIRRRDHMVLHEYVNAAGITRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 1724 - protein, 186 aa, Artificial Sequence
  Synthetic
SEVDEVRKTLEDLLRRLDEENKDIIRRNKELLDDLDRKVRRDHMVLHEYVNAAGITLEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1725 - protein, 186 aa, Artificial Sequence
  Synthetic
SRVDEVIERLERLLRELDKINRDMIEDDKRLNTELNKENKRDHMVLHEYVNAAGITRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 1726 - protein, 186 aa, Artificial Sequence
  Synthetic
DEIRELEERVRRILDELRRLVERNREVIERSIRELEKLLDRDHMVLHEYVNAAGITTRRGGDDKKTMLDDVRRLLREAEDHSRRSSETAKRIHRENEEHSKDSSRKVRKLIEELRELAKKVEKEITDERVKEAIKELVKDVDRVMREVDRANRELTKTSKKVLEDVDRTNRRLVKEVRDVVERARK

SEQ ID NO: 1727 - protein, 186 aa, Artificial Sequence
  Synthetic
KEVEDLERTVRTILKRMRELITRNEEEIRRSIEELKKLLKRDHMVLHEYVNAAGITKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 1728 - protein, 178 aa, Artificial Sequence
  Synthetic
KAAEEIRKKVEDYKRESEKILEEVEDHSRRSKETLKRLLDRDHMVLHEYVNAAGITKRRPRTEEIAKRAEEAVRRAAERIKKVIDDVERHIRENAKELKRLLEEDREASRRLEDEIDKEVKAREVADELKKRLKRANEESERVLRELAERNKTALEEAERVLRRLKEEIEKVLRKLKK

SEQ ID NO: 1729 - protein, 176 aa, Artificial Sequence
  Synthetic
REAEEAKEEVEELNRRNKKELDDARRRVDELDKRNKDRLKRDHMVLHEYVNAAGITKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 1730 - protein, 179 aa, Artificial Sequence
  Synthetic
DEAEKAKRDSEKVVEDNRKMLEDSTRRAERLNEENKKELKRDHMVLHEYVNAAGITKRRGTDDEVVKDLIRRVEELLERSRKKLEDLTRDNERVLDESRRRLEKLIRDNERIVKDLTDRVVRVDEVLKRLKEEHRRLIEELEEVLRRNEEIIRRSIEDLERVLDRNRRELEDVIRRLKE

SEQ ID NO: 1731 - protein, 174 aa, Artificial Sequence
  Synthetic
SEEEVLREAAKTVEKLLDEIRRSLEKVSKRVEDSNRELKERDHMVLHEYVNAAGITRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 1732 - protein, 182 aa, Artificial Sequence
  Synthetic
SELEKTLEDLKRHSEENKKKLEEDLRDMERNLKENKDRLKRDHMVLHEYVNAAGITFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 1733 - protein, 186 aa, Artificial Sequence
  Synthetic
SEIEKLIEELRRELEKVKDELERSIEEMDRELDDVRRDSKRDHMVLHEYVNAAGITTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 1734 - protein, 179 aa, Artificial Sequence
  Synthetic
RLEDEVRKMEKEVREEVKRLEDESRKVLEESRRNLDKLRERDHMVLHEYVNAAGITRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1735 - protein, 174 aa, Artificial Sequence
  Synthetic
SESDEVIRDLARLLDELARHVDDSVRRMDEVVKRSTREADRDHMVLHEYVNAAGITPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1736 - protein, 174 aa, Artificial Sequence
  Synthetic
SESDDVIRKLRELLEELRTHVEKSIRDLRKILEDSTRHAKRDHMVLHEYVNAAGITPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 1737 - protein, 172 aa, Artificial Sequence
  Synthetic
SRAETVLKEVTDKIKKLADSSDELLRRNKENIDELKKSSERDHMVLHEYVNAAGITSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 1738 - protein, 177 aa, Artificial Sequence
  Synthetic
DEVRELLERNRRLLEEIKKTVKDLIRANEELLKRIEDDAKRDHMVLHEYVNAAGITLSDDETIREAKERLKASLEDVKRRVEEVKRLLEKSLEEVETIIREAEKRNRDSLREMERRGSSEELEELRRVVEESDETIKRLLEEAKESVDRSLDRIRKLLEDVRRSVERSAKRIDEKRK

SEQ ID NO: 1739 - protein, 180 aa, Artificial Sequence
  Synthetic
STEEVLDEIRKLHKTLTEDIKRVLREIEELHRRTIEENKERDHMVLHEYVNAAGITRTKDTPNVEKLLKDLEKSAKENIEHNERTLREDDRVLKEIRRRATELLKANEEMLRRIEEVARKGGVDAEELLRESKEAIKEVKRVLEELRKESKRVVDETRKLSEENLEHSERVLRKVEEDLR

SEQ ID NO: 1740 - protein, 188 aa, Artificial Sequence
  Synthetic
SEIEKILKEIEDLARRDEEVSKKIVEDIRRLAKEVEDTSRRDHMVLHEYVNAAGITLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD

SEQ ID NO: 1741 - protein, 186 aa, Artificial Sequence
  Synthetic
SEAERLEARARELLRANEELMDDLRAKAEELLKRNDRLVKRDHMVLHEYVNAAGITKRRGEPKEEVARKIEEILRRLEETLRRIKEESDRLDEELKRELERVKRESEELDRELRKLIEDVERRGSGSKRLEELLRRLNEEHKRISDELRKLLDEALEAHRELSRRLEEELERLLREIERLVEEVTR

SEQ ID NO: 1742 - protein, 184 aa, Artificial Sequence
  Synthetic
DDLERAREEVADLIRKHEEKTRRILEESRRLNERHRELSARDHMVLHEYVNAAGITIKRERGKDELRRKVEDLEARVEDLIRRLEEHLRRVHDKDRRLIEDLRRHLKRVVEELKRLIDELRRGVPKEELDRIEEELKRLIDTLREKNREVEKRARDSNRDLKRTNDEIAKEVRELIKKLREDLK

SEQ ID NO: 1743 - protein, 174 aa, Artificial Sequence
  Synthetic
DEEEDLERAIKKLLDENRELLKRIAEELRRLLEELRRLTERDHMVLHEYVNAAGITGVPEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 1744 - protein, 184 aa, Artificial Sequence
  Synthetic
DEIRKVVKEITDLLKASNDKNRKVVEEIRDLLRKSKKLADRDHMVLHEYVNAAGITIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1745 - protein, 184 aa, Artificial Sequence; identical to SEQ ID NO: 1744
  Synthetic

SEQ ID NO: 1746 - protein, 176 aa, Artificial Sequence
  Synthetic
STAETVEKKVEEVIRENEKSMRESEEKVDRSTKRIEDVLRRDHMVLHEYVNAAGITVKGERVKEVLEENRRLLEEAKKLVDEVLETNKKLLEDDKRLNEEVSKTLKKLLEEIKSVDTREDATRVIEEAKRILDEARKLNEETIRRSEELVRRIERVIEEIIKRSEKLLEDVARESK

SEQ ID NO: 1747 - protein, 186 aa, Artificial Sequence
  Synthetic
SRVEEIIEDLRRLLEEIRKENEDSIRRSKELLDRVKEINDRDHMVLHEYVNAAGITVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 1748 - protein, 186 aa, Artificial Sequence; identical to SEQ ID NO: 1747
  Synthetic

SEQ ID NO: 1749 - protein, 180 aa, Artificial Sequence
  Synthetic
REVEEMIKELEELLKDLKEKNERASKRNRELVRRLEEENKRDHMVLHEYVNAAGITVRSGEDEEVLREVLKRLEEVLERVRALNERVLEAIEKSLEEVKASNEAVKRRLKELLEEAERGVDSEKLKELRDVIAEVAKRIDELDEYTRESIRRAKKEIERLNRETKKVIEEVVKRIEEERK

SEQ ID NO: 1750 - protein, 181 aa, Artificial Sequence
  Synthetic
SEVDDVLRRLEELIKTLEDINAKSLEDIKKLIDDLAKILERDHMVLHEYVNAAGITKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 1751 - protein, 183 aa, Artificial Sequence
  Synthetic
SKLEEVEKAVRKVIEDSRRVNEEVNRRSEEVVRELEKVHRRDHMVLHEYVNAAGITLKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 1752 - protein, 180 aa, Artificial Sequence
  Synthetic
DEVEDVLRKIEKILDDHRKRIEKNSRDMARIIDEHRRKVERDHMVLHEYVNAAGITVDRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 1753 - protein, 185 aa, Artificial Sequence
  Synthetic
SSVEELLERLRRISEENKRRIEKLLREVEKVLRELKDRHRRDHMVLHEYVNAAGITIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 1754 - protein, 238 aa, Artificial Sequence
  Synthetic
EEDERLTKRVEEIKRENRELLRRLEEEVKELERKSEKIVRRDHMVLHEYVNAAGITKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1755 - protein, 238 aa, Artificial Sequence
  Synthetic
SKEDKARELEKRLRDNLKKLEEVVRELAEVLKRNLEKLRRRDHMVLHEYVNAAGITRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 1756 - protein, 244 aa, Artificial Sequence
  Synthetic
SAEETLRRITEESKRVLEEITKKYEDLERESREVLRKLRERDHMVLHEYVNAAGITGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 1757 - protein, 244 aa, Artificial Sequence; identical to SEQ ID NO: 1756
  Synthetic

SEQ ID NO: 1758 - protein, 247 aa, Artificial Sequence
  Synthetic
SEKEELLKLIKRVIELLKRVLEEHLRLVEDVIRRLKELLDRDHMVLHEYVNAAGITLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 1759 - protein, 247 aa, Artificial Sequence; identical to SEQ ID NO: 1758
  Synthetic

SEQ ID NO: 1760 - protein, 238 aa, Artificial Sequence
  Synthetic
SEAEKIREALETNLRLLEELIKRLKEILDTHNELLRRVIERDHMVLHEYVNAAGITGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1761 - protein, 238 aa, Artificial Sequence; identical to SEQ ID NO: 1760
  Synthetic

SEQ ID NO: 1762 - protein, 242 aa, Artificial Sequence
  Synthetic
SEKERLMRLLDKLKDLNRRLVERIKELLDKALELHKKLVKRDHMVLHEYVNAAGITGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 1763 - protein, 242 aa, Artificial Sequence; identical to SEQ ID NO: 1762
  Synthetic

SEQ ID NO: 1764 - protein, 247 aa, Artificial Sequence
  Synthetic
SEAEDLEELIKELAELLKDVIRKLEKINRRLVKILEDIIRRDHMVLHEYVNAAGITTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 1765 - protein, 240 aa, Artificial Sequence
  Synthetic
SDKEEIKRRVEKTARDLETEHDKIKKRLEDTVRDIKRELDRDHMVLHEYVNAAGITLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1766 - protein, 240 aa, Artificial Sequence; identical to SEQ ID NO: 1765
  Synthetic

SEQ ID NO: 1767 - protein, 248 aa, Artificial Sequence
  Synthetic
DEEERVKKLLTDLRRLLRKLHEESKKLLDELRKKLRELRRRDHMVLHEYVNAAGITEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 1768 - protein, 248 aa, Artificial Sequence
  Synthetic
DEDRIIEEIARLLEELLRELLELIKKLIETNRRLNEEHERRDHMVLHEYVNAAGITVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 1769 - protein, 238 aa, Artificial Sequence
  Synthetic
DADELLRRLAEEVERVIREAEDLLRRWKETIKKVLDDLKRRDHMVLHEYVNAAGITTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 1770 - protein, 236 aa, Artificial Sequence
  Synthetic
STREKAKKVLDTLRADNEDMKRVVEKILRALKRTNERAEKRDHMVLHEYVNAAGITGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1771 - protein, 236 aa, Artificial Sequence; identical to SEQ ID NO: 1770
  Synthetic

SEQ ID NO: 1772 - protein, 247 aa, Artificial Sequence
  Synthetic
SKAEKLLKDLREALEKVKRRYEELERRLDEVLKEHEEIVKRDHMVLHEYVNAAGITGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 1773 - protein, 247 aa, Artificial Sequence; identical to SEQ ID NO: 1772
  Synthetic

SEQ ID NO: 1774 - protein, 243 aa, Artificial Sequence
  Synthetic
DLERVVEDIVDKAKRLLDKNLEVLKRIVDEVLRLLERLLRRDHMVLHEYVNAAGITVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKVVDDLKKELERIKREVKRLIEENARTLADIKRAVDEARK

SEQ ID NO: 1775 - protein, 239 aa, Artificial Sequence
  Synthetic
SERELIERWLELHKEILRLIRELVERLLKLHREILDTIKKRDHMVLHEYVNAAGITGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 1776 - protein, 246 aa, Artificial Sequence
  Synthetic
KEIEETLKELEDLNREMVETNRRVLEETRRLNKETVDRVKRDHMVLHEYVNAAGITVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 1777 - protein, 231 aa, Artificial Sequence
  Synthetic
SKEEEVEKVLRKWEEILRRLIEENKRANDKIRREYEELVKRDHMVLHEYVNAAGITGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1778 - protein, 247 aa, Artificial Sequence
  Synthetic
RDRDVLRKVKAEIEELVARIEKVSRDALSEVKRLLDENRKRDHMVLHEYVNAAGITRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 1779 - protein, 231 aa, Artificial Sequence
  Synthetic
SKDEELARLLEELVERWRKIVEDLERDHRRLVKEIRELVERDHMVLHEYVNAAGITGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1780 - protein, 231 aa, Artificial Sequence; identical to SEQ ID NO: 1779
  Synthetic

SEQ ID NO: 1781 - protein, 238 aa, Artificial Sequence
  Synthetic
SEIEDVIRRLRKILEDLERVSEKLLREIKKILDEARRLNERDHMVLHEYVNAAGITFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 1782 - protein, 237 aa, Artificial Sequence
  Synthetic
KEKEDALKKLEDLARKSREDLERVLRKHKKILDKIEELLKRDHMVLHEYVNAAGITTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1783 - protein, 237 aa, Artificial Sequence; identical to SEQ ID NO: 1782
  Synthetic

SEQ ID NO: 1784 - protein, 229 aa, Artificial Sequence
  Synthetic
SKEERLREVAEKHKKDLEDIVKRVDEAAKETARRLEEILKRDHMVLHEYVNAAGITPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1785 - protein, 246 aa, Artificial Sequence
  Synthetic
SEREELLERIKEILKRVKDKLDEDLKRLKEILEKLKEKADRDHMVLHEYVNAAGITLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 1786 - protein, 246 aa, Artificial Sequence; identical to SEQ ID NO: 1785
  Synthetic

SEQ ID NO: 1787 - protein, 240 aa, Artificial Sequence
  Synthetic
DREKSVRDIEEDLKRVLDKLRRRVETSKEELKKVLKADKERDHMVLHEYVNAAGITDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1788 - protein, 240 aa, Artificial Sequence; identical to SEQ ID NO: 1787
  Synthetic

SEQ ID NO: 1789 - protein, 237 aa, Artificial Sequence
  Synthetic
REDEVLRDIERLLREIEEKIRRILEESTAELRKVEEEVKRRDHMVLHEYVNAAGITERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1790 - protein, 243 aa, Artificial Sequence
  Synthetic
SEAERLADEVRKAVKKSEEDNETLVREVEKAVRELKKNNKRDHMVLHEYVNAAGITLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1791 - protein, 243 aa, Artificial Sequence; identical to SEQ ID NO: 1790
  Synthetic

SEQ ID NO: 1792 - protein, 245 aa, Artificial Sequence
  Synthetic
SEKDEVTRRIRELLKEAEETNREAIERIKRLLDRVREAVERDHMVLHEYVNAAGITLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1793 - protein, 245 aa, Artificial Sequence; identical to SEQ ID NO: 1792
  Synthetic

SEQ ID NO: 1794 - protein, 232 aa, Artificial Sequence
  Synthetic
SEKELVDDIRRILEEILRLLRSLLEEVIRLLEENEKLVRRRDHMVLHEYVNAAGITDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRVLDLVDEVVKRVEDLVERVKEKIDT

SEQ ID NO: 1795 - protein, 247 aa, Artificial Sequence
  Synthetic
DEERLAEELERVLDRNRKLLEEALRELRRVIEENRKSVKRRDHMVLHEYVNAAGITRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 1796 - protein, 240 aa, Artificial Sequence
  Synthetic
DKDKRLEELLKRLKELNDKTFEELERILEELKRANEASLRRDHMVLHEYVNAAGITNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1797 - protein, 240 aa, Artificial Sequence
  Synthetic
SKEETLKRLLDELEKRNRETVERLERLLKELEDRNRASLERDHMVLHEYVNAAGITGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1798 - protein, 240 aa, Artificial Sequence; identical to SEQ ID NO: 1797
  Synthetic

SEQ ID NO: 1799 - protein, 243 aa, Artificial Sequence
  Synthetic
DEEETLRRLLERKVELAKEYLDVSKEVIDRTTKLLDEYLKRDHMVLHEYVNAAGITDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 1800 - protein, 243 aa, Artificial Sequence
  Synthetic
SEAERTKESLKKVLKALVDLNRELLRKLEENMRELTKLNERDHMVLHEYVNAAGITGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1801 - protein, 182 aa, Artificial Sequence
  Synthetic
DEAEKLLKELRDLLEESRKDLERLLKELEDLLEESKRDLERRDHMVLHEYVNAAGITERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 1802 - protein, 184 aa, Artificial Sequence
  Synthetic
SLEEVIKTVRKLLEEVERRLREVVERAERMLEEVRRRTREVRDHMVLHEYVNAAGITDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 1803 - protein, 181 aa, Artificial Sequence
  Synthetic
SLDEVVKRLEDLLREVEEKSKESSKRMEDLNREVNERLRRSRDHMVLHEYVNAAGITDAGRDDKIRRTLERLSEDTKRKSDKTNEDLKRLSDETRERSKRLNEELRRLVEEVRRRLEDLRRKGSPVEEIKKLADKVVTELEKLVEDDRRLAEESFERARKIVEEDERLARESVDRARRLVD

SEQ ID NO: 1804 - protein, 181 aa, Artificial Sequence
  Synthetic
SEVERVLEDLRRLVRDVEEKLRRIIERDRRLVEEVERENRKRDHMVLHEYVNAAGITKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 1805 - protein, 177 aa, Artificial Sequence
  Synthetic
KEEEDLEREVKRLEDKVREDAKKLEEVVKTVEKLVRDDARRRDHMVLHEYVNAAGITERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 1806 - protein, 174 aa, Artificial Sequence
  Synthetic
SEDETIRRIVRTVHEESRKSTEDVRREVERVLRESEEVVKKRDHMVLHEYVNAAGITISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 1807 - protein, 174 aa, Artificial Sequence
  Synthetic
SRDEKIRDILRRVLKEVRDSTKKVEEDLEDVHRRTEEELRKRDHMVLHEYVNAAGITASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 1808 - protein, 179 aa, Artificial Sequence
  Synthetic
STREDARRLVERVRKEVKRLLKKNSDLLREVTERVKTLNERRDHMVLHEYVNAAGITDSDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 1809 - protein, 174 aa, Artificial Sequence
  Synthetic
SELEKVVKEVADLLRRNLEKSKRVLEEVRRRLEENLRESEKRDHMVLHEYVNAAGITREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 1810 - protein, 178 aa, Artificial Sequence
  Synthetic
DDLERVLKEIKKAADKIREDNKRTADKIRKRVKELDDETRDRDHMVLHEYVNAAGITRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 1811 - protein, 187 aa, Artificial Sequence
  Synthetic
DEEEELRKRLEKLSKEVRELLRRDEEEDRRLNRELEELLKDRDHMVLHEYVNAAGITRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 1812 - protein, 177 aa, Artificial Sequence
  Synthetic
SVLEEVRRRVEELLKTVKESVDRSHERSERLIEEVRESLKERDHMVLHEYVNAAGITIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 1813 - protein, 178 aa, Artificial Sequence
  Synthetic
SSIERVEKEVRRLLRESDESLKRVMEEAKELIKSVRESTKRRDHMVLHEYVNAAGITGDEREDLRRVLEELRKLIEDNRREDKRSEDELRKLIRDNKEENDRARREAEKLLEDLSRGRSEEEVERVLEEVRRIIEKLKEDDKRSLERIERIVRRNNELNKESVDRIRKIIKEMEERAD

SEQ ID NO: 1814 - protein, 183 aa, Artificial Sequence
  Synthetic
KDAEDLERRVRELVEENNRVSKRLAEEVTRLVKENEDKVRERDHMVLHEYVNAAGITRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 1815 - protein, 183 aa, Artificial Sequence
  Synthetic
SEIEKLVEDVRKLVEDNLRHSEEVHRRNRRLIEENERKIDERDHMVLHEYVNAAGITERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1816 - protein, 177 aa, Artificial Sequence
  Synthetic
REIEELRKEIETLIRENEELNRRSKETSEELIRRLKKLNRDRDHMVLHEYVNAAGITAPEEDVRRAEERVKKLIEDNKRHSDEVAKTDKKLNEDSERHTRRVEERLRELLDRLSRSDKDEVVRRVAEEARRLSKRNKDAIREVNETSRRLATRDAKHTRDVLREIKRLADEIRERTR

SEQ ID NO: 1817 - protein, 181 aa, Artificial Sequence
  Synthetic
EEIERALREMRELSRTHKELVEKILRDIAELAKTHERINEDRDHMVLHEYVNAAGITRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 1818 - protein, 174 aa, Artificial Sequence
  Synthetic
SEIEELEKRIDELLKELRDLSRRIAEEVKRLLEELKKLSKDRDHMVLHEYVNAAGITVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 1819 - protein, 174 aa, Artificial Sequence
  Synthetic
DELRDVKRELDRLLRENEEIVERIAETVRRLLEELKKLTKERDHMVLHEYVNAAGITVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 1820 - protein, 174 aa, Artificial Sequence
  Synthetic
DEEEDLERRIKKLLDENRELLKRIAEELRRLLEELRRLTEERDHMVLHEYVNAAGITVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 1821 - protein, 174 aa, Artificial Sequence
  Synthetic
REIEEAAKDLDRLLEENKKLVKEVEEELRRLLKENRDLVKERDHMVLHEYVNAAGITVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 1822 - protein, 177 aa, Artificial Sequence
  Synthetic
SEAEKVVEELKKLLREVEKKIRDHTEDVKRILEELERRLRKRDHMVLHEYVNAAGITSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1823 - protein, 182 aa, Artificial Sequence
  Synthetic
DEIETVLDEVRRLHEDAKRRLEEMIDEVRKLNEESVRELARRDHMVLHEYVNAAGITERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 1824 - protein, 177 aa, Artificial Sequence
  Synthetic
DEVEDILRKVEEIVKKSITDARRLLKEAREIVEESIKTAEERDHMVLHEYVNAAGITKRTTDEEKKKKLEEESRRVLEKTKRDLDRTKDDNRKALEKIRKRVKETEEENREVVDRVRKAGVDKRVLEKIKKVVDDSVRVNREVLKRVEEVLEESKRVNEKVEEDVRRVHEEVRKEIK

SEQ ID NO: 1825 - protein, 175 aa, Artificial Sequence
  Synthetic
SEVDEVLREAKRIVDEVHKDNERATEESRRLVKKVHEENEERDHMVLHEYVNAAGITIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1826 - protein, 175 aa, Artificial Sequence
  Synthetic
SEMDDVLKKLAETVKRIIERLKKLTDDSRRLVEEVHRRNDKRDHMVLHEYVNAAGITIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 1827 - protein, 186 aa, Artificial Sequence
  Synthetic
SEVDEVRKTLEDLLRRLDEENKDIIRRNKELLDDLDRKVRERDHMVLHEYVNAAGITEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1828 - protein, 183 aa, Artificial Sequence
  Synthetic
SEVDEVLERIKRLLERLAEHSDKVVRDIEKLLDDNRKENERRDHMVLHEYVNAAGITRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 1829 - protein, 185 aa, Artificial Sequence
  Synthetic
DDIERLKREIERLLKEAEKISRDNEERSKELLDRLRKLSEDRDHMVLHEYVNAAGITDKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 1830 - protein, 184 aa, Artificial Sequence
  Synthetic
ELIKKARKDVEEVRERSERLVDELRKRNKKLADESRRLIDKRDHMVLHEYVNAAGITRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1831 - protein, 186 aa, Artificial Sequence
  Synthetic
KEVEDLERRVKEILDRMKRLIDENRKKIEKSIRELERLIDERDHMVLHEYVNAAGITREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 1832 - protein, 186 aa, Artificial Sequence
  Synthetic
KEVEDLERTVRTILKRMRELITRNEEEIRRSIEELKKLLKERDHMVLHEYVNAAGITKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 1833 - protein, 176 aa, Artificial Sequence
  Synthetic
REAEEAKEEVEELNRRNKKELDDARRRVDELDKRNKDRLKERDHMVLHEYVNAAGITEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 1834 - protein, 174 aa, Artificial Sequence
  Synthetic
SEEEVLREAAKTVEKLLDEIRRSLEKVSKRVEDSNRELKESRDHMVLHEYVNAAGITKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 1835 - protein, 182 aa, Artificial Sequence
  Synthetic
SELEKTLEDLKRHSEENKKKLEEDLRDMERNLKENKDRLKKRDHMVLHEYVNAAGITREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 1836 - protein, 186 aa, Artificial Sequence
  Synthetic
SEIEKLIEELRRELEKVKDELERSIEEMDRELDDVRRDSKRRDHMVLHEYVNAAGITKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 1837 - protein, 179 aa, Artificial Sequence
  Synthetic
RLEDEVRKMEKEVREEVKRLEDESRKVLEESRRNLDKLREERDHMVLHEYVNAAGITRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1838 - protein, 183 aa, Artificial Sequence
  Synthetic
RVDERLDTVLKRVEETVRENKKKNDELLERSKENIDRLKKRRDHMVLHEYVNAAGITREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 1839 - protein, 183 aa, Artificial Sequence
  Synthetic
SIEDEIRKLKEDIKRVLDKVRRDNERLKERLDKVLEDIRRSRDHMVLHEYVNAAGITDKPVDERLVRKVEEAVKRLKEHNEDSTRRVEEVIRRLKEESEESVRKTEKVARDLERELDEVLTRGGEERVREVIEKLKETLERLKREDKEVADRAEKLLREAEEHNKRSLDESRRVLEELDEEIR

SEQ ID NO: 1840 - protein, 172 aa, Artificial Sequence
  Synthetic
DEVEKVLEEIKRALDDLRKKVEESKREIKEALKAVEKHTRDRDHMVLHEYVNAAGITKSKDTERVRKLVEELSEENERSLREVRRVAEELLEINERVLEEVERVVEALLDLVRRGGSERVVEEVRRVLEELRRRLEKVTEDSRRAIERLAREDARVSKKSIDVNKKLDDDVR

SEQ ID NO: 1841 - protein, 174 aa, Artificial Sequence
  Synthetic
SESDEVIRDLARLLDELARHVDDSVRRMDEVVKRSTREADERDHMVLHEYVNAAGITGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1842 - protein, 174 aa, Artificial Sequence
  Synthetic
KEVEDAVKELEDLLRANEDKTRSIVEDMRASNKDLEDHSRARDHMVLHEYVNAAGITVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 1843 - protein, 184 aa, Artificial Sequence
  Synthetic
DEIRKVVKEITDLLKASNDKNRKVVEEIRDLLRKSKKLADERDHMVLHEYVNAAGITDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1844 - protein, 176 aa, Artificial Sequence
  Synthetic
STAETVAEEVERVLKHSDDLIKEVEDVNRRVEEEIKRVIRERDHMVLHEYVNAAGITKGEILAEIEKRLADNSEKVREVAERAKKLLEENTARVKDILRESRKLVKDLLDEVRGTGSEEAAREIIKRLREVNKRTKEKLDELIKHSEEVLERVKRLIDELRKHSEEVLEDLRRRAK

SEQ ID NO: 1845 - protein, 186 aa, Artificial Sequence
  Synthetic
SRVEEIIEDLRRLLEEIRKENEDSIRRSKELLDRVKEINDTRDHMVLHEYVNAAGITREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 1846 - protein, 186 aa, Artificial Sequence
  Synthetic
SEVDEIIKELERLLAEIARENERIIRESRKLADEVRKRNEDRDHMVLHEYVNAAGITRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 1847 - protein, 181 aa, Artificial Sequence
  Synthetic
SEVDDVLRRLEELIKTLEDINAKSLEDIKKLIDDLAKILEDRDHMVLHEYVNAAGITKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 1848 - protein, 183 aa, Artificial Sequence
  Synthetic
SKLEEVEKAVRKVIEDSRRVNEEVNRRSEEVVRELEKVHRERDHMVLHEYVNAAGITKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 1849 - protein, 173 aa, Artificial Sequence
  Synthetic
SAEEVKEELKRIATKLKEEIKENIRRLEESVEKIAKELAENRDHMVLHEYVNAAGITDERIVKTVEDIARRVVEDNERIMEEDKDVVRRLVERNEEIVRRVDETVKKIVELIDRGEPGEELVERLRRVVEEVRERLKDSSRELRKINEDSRKAVEDSSAEVAKVVEELERRDT

SEQ ID NO: 1850 - protein, 183 aa, Artificial Sequence
  Synthetic
SDVDRVLEEIRKLLEDLKRHSEKVSEENEDLLRANTELNKRRDHMVLHEYVNAAGITERGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLRRLNEELDRSLERAERTIRELAK

SEQ ID NO: 1851 - protein, 180 aa, Artificial Sequence
  Synthetic
DEVEDVLRKIEKILDDHRKRIEKNSRDMARIIDEHRRKVEERDHMVLHEYVNAAGITDRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 1852 - protein, 185 aa, Artificial Sequence
  Synthetic
SSVEELLERLRRISEENKRRIEKLLREVEKVLRELKDRHRKRDHMVLHEYVNAAGITKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 1853 - protein, 238 aa, Artificial Sequence
  Synthetic
EEDERLTKRVEEIKRENRELLRRLEEEVKELERKSEKIVRDRDHMVLHEYVNAAGITGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1854 - protein, 244 aa, Artificial Sequence
  Synthetic
SAEETLRRITEESKRVLEEITKKYEDLERESREVLRKLREDRDHMVLHEYVNAAGITDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 1855 - protein, 250 aa, Artificial Sequence
  Synthetic
STEEILKRVKEILDELAKELRDIIRESLRTIEELLDELRRIRDHMVLHEYVNAAGITDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 1856 - protein, 238 aa, Artificial Sequence
  Synthetic
SEAEKIREALETNLRLLEELIKRLKEILDTHNELLRRVIETRDHMVLHEYVNAAGITLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1857 - protein, 247 aa, Artificial Sequence
  Synthetic
SEAEDLEELIKELAELLKDVIRKLEKINRRLVKILEDIIRRRDHMVLHEYVNAAGITVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 1858 - protein, 240 aa, Artificial Sequence
  Synthetic
SDKEEIKRRVEKTARDLETEHDKIKKRLEDTVRDIKRELDERDHMVLHEYVNAAGITREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1859 - protein, 238 aa, Artificial Sequence
  Synthetic
DADELLRRLAEEVERVIREAEDLLRRWKETIKKVLDDLKRLRDHMVLHEYVNAAGITKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 1860 - protein, 236 aa, Artificial Sequence
  Synthetic
STREKAKKVLDTLRADNEDMKRVVEKILRALKRTNERAEKLRDHMVLHEYVNAAGITVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 1861 - protein, 236 aa, Artificial Sequence; identical to SEQ ID NO: 1860
  Synthetic

SEQ ID NO: 1862 - protein, 239 aa, Artificial Sequence
  Synthetic
SERELIERWLELHKEILRLIRELVERLLKLHREILDTIKKLRDHMVLHEYVNAAGITLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 1863 - protein, 246 aa, Artificial Sequence
  Synthetic
KEIEETLKELEDLNREMVETNRRVLEETRRLNKETVDRVKARDHMVLHEYVNAAGITRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 1864 - protein, 231 aa, Artificial Sequence
  Synthetic
SKEEEVEKVLRKWEEILRRLIEENKRANDKIRREYEELVKERDHMVLHEYVNAAGITVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1865 - protein, 231 aa, Artificial Sequence
  Synthetic
SKDEELARLLEELVERWRKIVEDLERDHRRLVKEIRELVERRDHMVLHEYVNAAGITIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1866 - protein, 237 aa, Artificial Sequence
  Synthetic
KEKEDALKKLEDLARKSREDLERVLRKHKKILDKIEELLKRRDHMVLHEYVNAAGITGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1867 - protein, 237 aa, Artificial Sequence; identical to SEQ ID NO: 1866
  Synthetic

SEQ ID NO: 1868 - protein, 229 aa, Artificial Sequence
  Synthetic
SKEERLREVAEKHKKDLEDIVKRVDEAAKETARRLEEILKRRDHMVLHEYVNAAGITDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1869 - protein, 241 aa, Artificial Sequence
  Synthetic
SEKELLKEILDRIRELLEDDNRLLKRIVDEIRKLLEEWLRVRDHMVLHEYVNAAGITAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 1870 - protein, 246 aa, Artificial Sequence
  Synthetic
SEREELLERIKEILKRVKDKLDEDLKRLKEILEKLKEKADRRDHMVLHEYVNAAGITERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 1871 - protein, 240 aa, Artificial Sequence
  Synthetic
DREKSVRDIEEDLKRVLDKLRRRVETSKEELKKVLKADKENRDHMVLHEYVNAAGITRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 1872 - protein, 241 aa, Artificial Sequence
  Synthetic
SAEEAVEKLVRIARAIVKINEDLSREVVRILREIVRLNEETRDHMVLHEYVNAAGITDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 1873 - protein, 237 aa, Artificial Sequence
  Synthetic
REDEVLRDIERLLREIEEKIRRILEESTAELRKVEEEVKRIRDHMVLHEYVNAAGITRKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1874 - protein, 237 aa, Artificial Sequence; identical to SEQ ID NO: 1873
  Synthetic

SEQ ID NO: 1875 - protein, 243 aa, Artificial Sequence
  Synthetic
SEAERLADEVRKAVKKSEEDNETLVREVEKAVRELKKNNKTRDHMVLHEYVNAAGITRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1876 - protein, 243 aa, Artificial Sequence; identical to SEQ ID NO: 1875
  Synthetic

SEQ ID NO: 1877 - protein, 245 aa, Artificial Sequence
  Synthetic
SEKDEVTRRIRELLKEAEETNREAIERIKRLLDRVREAVEERDHMVLHEYVNAAGITDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1878 - protein, 245 aa, Artificial Sequence; identical to SEQ ID NO: 1877
  Synthetic

SEQ ID NO: 1879 - protein, 249 aa, Artificial Sequence
  Synthetic
DAEEVVKRLADVLRENDETIRKVVEDLVRIAEENDRLWKKLRDHMVLHEYVNAAGITRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1880 - protein, 240 aa, Artificial Sequence
  Synthetic
DKDKRLEELLKRLKELNDKTFEELERILEELKRANEASLRERDHMVLHEYVNAAGITLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1881 - protein, 240 aa, Artificial Sequence
  Synthetic
SKEETLKRLLDELEKRNRETVERLERLLKELEDRNRASLEERDHMVLHEYVNAAGITLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1882 - protein, 243 aa, Artificial Sequence
  Synthetic
SEAERTKESLKKVLKALVDLNRELLRKLEENMRELTKLNEERDHMVLHEYVNAAGITIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1883 - protein, 243 aa, Artificial Sequence; identical to SEQ ID NO: 1882
  Synthetic

SEQ ID NO: 1884 - protein, 182 aa, Artificial Sequence
  Synthetic
DEAEKLLKELRDLLEESRKDLERLLKELEDLLEESKRDLERLRDHMVLHEYVNAAGITRRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 1885 - protein, 182 aa, Artificial Sequence
  Synthetic
RVEDALRKLLDDVRRLVEEAERRLRTSNDKSRRLVEEAKRRLRDHMVLHEYVNAAGITRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 1886 - protein, 181 aa, Artificial Sequence
  Synthetic
SEVERVLEDLRRLVRDVEEKLRRIIERDRRLVEEVERENRKTRDHMVLHEYVNAAGITDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 1887 - protein, 174 aa, Artificial Sequence
  Synthetic
SRDEKIRDILRRVLKEVRDSTKKVEEDLEDVHRRTEEELRKVRDHMVLHEYVNAAGITSEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 1888 - protein, 174 aa, Artificial Sequence
  Synthetic
SELEKVVKEVADLLRRNLEKSKRVLEEVRRRLEENLRESEKVRDHMVLHEYVNAAGITEGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 1889 - protein, 178 aa, Artificial Sequence
  Synthetic
DDLERVLKEIKKAADKIREDNKRTADKIRKRVKELDDETRDMRDHMVLHEYVNAAGITGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 1890 - protein, 187 aa, Artificial Sequence
  Synthetic
DEEEELRKRLEKLSKEVRELLRRDEEEDRRLNRELEELLKDHRDHMVLHEYVNAAGITKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 1891 - protein, 175 aa, Artificial Sequence
  Synthetic
SEEDELRRLLKEVNERVERLLDEIRKELEKIAEELRDLLKKNRDHMVLHEYVNAAGITDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 1892 - protein, 171 aa, Artificial Sequence
  Synthetic
SEKEKVIKEARELLERLRKRLKDVNDDVTRLLDELRKENEKSRDHMVLHEYVNAAGITVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 1893 - protein, 177 aa, Artificial Sequence
  Synthetic
SAIEKVKEVVERVLETVRDSVRRSHEESKRLIDKVRKRLEEVRDHMVLHEYVNAAGITPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 1894 - protein, 183 aa, Artificial Sequence
  Synthetic
SEIEKLVEDVRKLVEDNLRHSEEVHRRNRRLIEENERKIDELRDHMVLHEYVNAAGITRGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 1895 - protein, 174 aa, Artificial Sequence
  Synthetic
DELRDVKRELDRLLRENEEIVERIAETVRRLLEELKKLTKELRDHMVLHEYVNAAGITPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 1896 - protein, 174 aa, Artificial Sequence
  Synthetic
DEEEDLERRIKKLLDENRELLKRIAEELRRLLEELRRLTEESRDHMVLHEYVNAAGITPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 1897 - protein, 177 aa, Artificial Sequence
  Synthetic
SEAEKVVEELKKLLREVEKKIRDHTEDVKRILEELERRLRKHRDHMVLHEYVNAAGITDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1898 - protein, 182 aa, Artificial Sequence
  Synthetic
DEIETVLDEVRRLHEDAKRRLEEMIDEVRKLNEESVRELARVRDHMVLHEYVNAAGITRAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 1899 - protein, 174 aa, Artificial Sequence
  Synthetic
EELERILDKVRKVIEEVRKRLRDDLRTVEKVLKETEEVLRRARDHMVLHEYVNAAGITRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 1900 - protein, 178 aa, Artificial Sequence
  Synthetic
SSKDEIRRRVEEVVERSDEIVKRSREHVKTVVDELDRVVKELRDHMVLHEYVNAAGITDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 1901 - protein, 182 aa, Artificial Sequence
  Synthetic
SDADRVAEELKKLVEDSRRENERVIEESKRLVKENEDRNRELRDHMVLHEYVNAAGITKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 1902 - protein, 175 aa, Artificial Sequence
  Synthetic
SEVDEVLREAKRIVDEVHKDNERATEESRRLVKKVHEENEEMRDHMVLHEYVNAAGITDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1903 - protein, 175 aa, Artificial Sequence
  Synthetic
SEMDDVLKKLAETVKRIIERLKKLTDDSRRLVEEVHRRNDKLRDHMVLHEYVNAAGITDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 1904 - protein, 186 aa, Artificial Sequence
  Synthetic
SEVDEVRKTLEDLLRRLDEENKDIIRRNKELLDDLDRKVREARDHMVLHEYVNAAGITKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1905 - protein, 183 aa, Artificial Sequence
  Synthetic
SEVDEVLERIKRLLERLAEHSDKVVRDIEKLLDDNRKENERLRDHMVLHEYVNAAGITRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 1906 - protein, 184 aa, Artificial Sequence
  Synthetic
ELIKKARKDVEEVRERSERLVDELRKRNKKLADESRRLIDKLRDHMVLHEYVNAAGITKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1907 - protein, 182 aa, Artificial Sequence
  Synthetic
SELEKTLEDLKRHSEENKKKLEEDLRDMERNLKENKDRLKKIRDHMVLHEYVNAAGITEGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 1908 - protein, 186 aa, Artificial Sequence
  Synthetic
SEIEKLIEELRRELEKVKDELERSIEEMDRELDDVRRDSKRLRDHMVLHEYVNAAGITRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 1909 - protein, 178 aa, Artificial Sequence
  Synthetic
DREREVKKRLDEVRERIERLLRRVEEESRRVAEEIRRLIEEVRDHMVLHEYVNAAGITGLKDKEEVRRVLERLRKLNAESDELLERILERLRRLVEATNRLVKAIIEELRRLVEKIVREVPDSEELREELKKLERKIEKVAKEIHDHDKEVTERLEDLLRRITEHARKSDREIEETAR

SEQ ID NO: 1910 - protein, 172 aa, Artificial Sequence
  Synthetic
SRAETVLKEVTDKIKKLADSSDELLRRNKENIDELKKSSEELRDHMVLHEYVNAAGITDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 1911 - protein, 188 aa, Artificial Sequence
  Synthetic
SEIEKILKEIEDLARRDEEVSKKIVEDIRRLAKEVEDTSRDIRDHMVLHEYVNAAGITKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD

SEQ ID NO: 1912 - protein, 178 aa, Artificial Sequence
  Synthetic
SEAEKAKETIDRLADRVRKLLEEIKRSLDDSRRKSKETVEENRDHMVLHEYVNAAGITGSVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 1913 - protein, 179 aa, Artificial Sequence
  Synthetic
SEVEELIKRLAKVLKELVDKVRKVIEDTKELLERLKRRSEDHRDHMVLHEYVNAAGITDDEELKEILDRLRKTLEELEEELKKALEDDREEAKRLVDDARRVLKELEEEVREIRERRGESEELDRRIEKVLKEIEEKIREVIKEWERVHREVEELLKRLIDENRKVLDEIRKLLEEKSK

SEQ ID NO: 1914 - protein, 184 aa, Artificial Sequence
  Synthetic
DEIRKVVKEITDLLKASNDKNRKVVEEIRDLLRKSKKLADELRDHMVLHEYVNAAGITKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1915 - protein, 184 aa, Artificial Sequence; identical to SEQ ID NO: 1914
  Synthetic

SEQ ID NO: 1916 - protein, 176 aa, Artificial Sequence
  Synthetic
STAETVEKKVEEVIRENEKSMRESEEKVDRSTKRIEDVLRRLRDHMVLHEYVNAAGITGERVKEVLEENRRLLEEAKKLVDEVLETNKKLLEDDKRLNEEVSKTLKKLLEEIKSVDTREDATRVIEEAKRILDEARKLNEETIRRSEELVRRIERVIEEIIKRSEKLLEDVARESK

SEQ ID NO: 1917 - protein, 186 aa, Artificial Sequence
  Synthetic
SRVEEIIEDLRRLLEEIRKENEDSIRRSKELLDRVKEINDTIRDHMVLHEYVNAAGITEKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 1918 - protein, 180 aa, Artificial Sequence
  Synthetic
REVEEMIKELEELLKDLKEKNERASKRNRELVRRLEEENKRVRDHMVLHEYVNAAGITSGEDEEVLREVLKRLEEVLERVRALNERVLEAIEKSLEEVKASNEAVKRRLKELLEEAERGVDSEKLKELRDVIAEVAKRIDELDEYTRESIRRAKKEIERLNRETKKVIEEVVKRIEEERK

SEQ ID NO: 1919 - protein, 181 aa, Artificial Sequence
  Synthetic
DAVEEAEKLIRKVIADSEKLLRDLADLNAKSIRRSEKLVEDDRDHMVLHEYVNAAGITNGGSEEELRALLKEVEDTNRASHETNKRLLDEDRALNKEVHDRNEKLLRDIKRLVEEVAKGIDSEELLRRIKKLLDEIKKAIEDSSREIKRLLEESERVMKRSSEDIKRTLDDTRRVVEEVRR

SEQ ID NO: 1920 - protein, 181 aa, Artificial Sequence
  Synthetic
SEVDDVLRRLEELIKTLEDINAKSLEDIKKLIDDLAKILEDARDHMVLHEYVNAAGITGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 1921 - protein, 175 aa, Artificial Sequence
  Synthetic
SEIERVKKRLEELLAEVEESTRRLEERLKRLLEEAKRSSEEVRDHMVLHEYVNAAGITRDEKLVSELEARVKELLEDSRASLEELKKRVRKLAEDSARLLEEVKREVEKLKAKLDRGGDADDVLARVEELAKRAHDENERLIREVEELVRAHNKRNKELVDEVKRLVEKVIEEER

SEQ ID NO: 1922 - protein, 183 aa, Artificial Sequence
  Synthetic
SDVDRVLEEIRKLLEDLKRHSEKVSEENEDLLRANTELNKRVRDHMVLHEYVNAAGITRGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLRRLNEELDRSLERAERTIRELAK

SEQ ID NO: 1923 - protein, 180 aa, Artificial Sequence
  Synthetic
DEVEDVLRKIEKILDDHRKRIEKNSRDMARIIDEHRRKVEENRDHMVLHEYVNAAGITRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 1924 - protein, 238 aa, Artificial Sequence
  Synthetic
EEDERLTKRVEEIKRENRELLRRLEEEVKELERKSEKIVRDLRDHMVLHEYVNAAGITSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1925 - protein, 238 aa, Artificial Sequence; identical to SEQ ID NO: 1924
  Synthetic

SEQ ID NO: 1926 - protein, 240 aa, Artificial Sequence
  Synthetic
SDKEEIKRRVEKTARDLETEHDKIKKRLEDTVRDIKRELDELRDHMVLHEYVNAAGITEGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1927 - protein, 240 aa, Artificial Sequence; identical to SEQ ID NO: 1926
  Synthetic

SEQ ID NO: 1928 - protein, 248 aa, Artificial Sequence
  Synthetic
DEDRIIEEIARLLEELLRELLELIKKLIETNRRLNEEHERAVRDHMVLHEYVNAAGITKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 1929 - protein, 248 aa, Artificial Sequence; identical to SEQ ID NO: 1928
  Synthetic

SEQ ID NO: 1930 - protein, 246 aa, Artificial Sequence
  Synthetic
KEIEETLKELEDLNREMVETNRRVLEETRRLNKETVDRVKATRDHMVLHEYVNAAGITKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 1931 - protein, 231 aa, Artificial Sequence
  Synthetic
SKEEEVEKVLRKWEEILRRLIEENKRANDKIRREYEELVKEIRDHMVLHEYVNAAGITSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 1932 - protein, 247 aa, Artificial Sequence
  Synthetic
RDRDVLRKVKAEIEELVARIEKVSRDALSEVKRLLDENRKIARDHMVLHEYVNAAGITTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 1933 - protein, 231 aa, Artificial Sequence
  Synthetic
SKDEELARLLEELVERWRKIVEDLERDHRRLVKEIRELVERIRDHMVLHEYVNAAGITDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 1934 - protein, 237 aa, Artificial Sequence
  Synthetic
KEKEDALKKLEDLARKSREDLERVLRKHKKILDKIEELLKRVRDHMVLHEYVNAAGITTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 1935 - protein, 229 aa, Artificial Sequence
  Synthetic
SKEERLREVAEKHKKDLEDIVKRVDEAAKETARRLEEILKRLRDHMVLHEYVNAAGITDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 1936 - protein, 246 aa, Artificial Sequence
  Synthetic
SEREELLERIKEILKRVKDKLDEDLKRLKEILEKLKEKADRDRDHMVLHEYVNAAGITRTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 1937 - protein, 252 aa, Artificial Sequence
  Synthetic
SLEEITKRLLELVEENLARHEEILRELLELAKRLAKEDRDILRDHMVLHEYVNAAGITNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 1938 - protein, 237 aa, Artificial Sequence
  Synthetic
REDEVLRDIERLLREIEEKIRRILEESTAELRKVEEEVKRIIRDHMVLHEYVNAAGITKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 1939 - protein, 237 aa, Artificial Sequence; identical to SEQ ID NO: 1938
  Synthetic

SEQ ID NO: 1940 - protein, 243 aa, Artificial Sequence
  Synthetic
SEAERLADEVRKAVKKSEEDNETLVREVEKAVRELKKNNKTWRDHMVLHEYVNAAGITDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 1941 - protein, 243 aa, Artificial Sequence; identical to SEQ ID NO: 1940
  Synthetic

SEQ ID NO: 1942 - protein, 245 aa, Artificial Sequence
  Synthetic
SEKDEVTRRIRELLKEAEETNREAIERIKRLLDRVREAVEEVRDHMVLHEYVNAAGITRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 1943 - protein, 245 aa, Artificial Sequence; identical to SEQ ID NO: 1942
  Synthetic

SEQ ID NO: 1944 - protein, 243 aa, Artificial Sequence
  Synthetic
SRVEELKKLIEDILRISREVVERIARVAEDIHRINRRVLDDLRDHMVLHEYVNAAGITRKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 1945 - protein, 249 aa, Artificial Sequence
  Synthetic
DAEEVVKRLADVLRENDETIRKVVEDLVRIAEENDRLWKKLVRDHMVLHEYVNAAGITGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 1946 - protein, 240 aa, Artificial Sequence
  Synthetic
DKDKRLEELLKRLKELNDKTFEELERILEELKRANEASLREARDHMVLHEYVNAAGITDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 1947 - protein, 240 aa, Artificial Sequence
  Synthetic
SKEETLKRLLDELEKRNRETVERLERLLKELEDRNRASLEELRDHMVLHEYVNAAGITSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 1948 - protein, 240 aa, Artificial Sequence; identical to SEQ ID NO: 1947
  Synthetic

SEQ ID NO: 1949 - protein, 243 aa, Artificial Sequence
  Synthetic
DEEETLRRLLERKVELAKEYLDVSKEVIDRTTKLLDEYLKTSRDHMVLHEYVNAAGITGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 1950 - protein, 243 aa, Artificial Sequence
  Synthetic
SEAERTKESLKKVLKALVDLNRELLRKLEENMRELTKLNEEVRDHMVLHEYVNAAGITVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 1951 - protein, 243 aa, Artificial Sequence; identical to SEQ ID NO: 1950
  Synthetic

SEQ ID NO: 1952 - protein, 186 aa, Artificial Sequence
  Synthetic
SAEDSIRELLERDERLLEEARKEAKRLNEENERLLERIEETVRRDHMVLHEYVNAAGITIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 1953 - protein, 182 aa, Artificial Sequence
  Synthetic
RVEDALRKLLDDVRRLVEEAERRLRTSNDKSRRLVEEAKRRLERDHMVLHEYVNAAGITIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 1954 - protein, 184 aa, Artificial Sequence
  Synthetic
KLDEVIEEIRKLLRRMEEELRRSVEEIDKLLREVRELLRESSERDHMVLHEYVNAAGITGVPEEVKERLDRLVETLRRLSEETLKELDKLVREVKELSKESLKRLRELVERLRRELEEIKKRGEDEKLVEDLKRRAEEVIRELREIVKRNTEIAREVVERAKRIVEKNEKLLKDVVEEAKKIVK

SEQ ID NO: 1955 - protein, 181 aa, Artificial Sequence
  Synthetic
SEVERVLEDLRRLVRDVEEKLRRIIERDRRLVEEVERENRKTIRDHMVLHEYVNAAGITISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 1956 - protein, 177 aa, Artificial Sequence
  Synthetic
ELREDVERVVDEIRRLVEENVRRIDEVAKDIKRLADDNVRRVKRDHMVLHEYVNAAGITGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 1957 - protein, 173 aa, Artificial Sequence
  Synthetic
SLEELLEEARKTVERLIRESERVLRESEERVRRLIEELERVVRRDHMVLHEYVNAAGITEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 1958 - protein, 179 aa, Artificial Sequence
  Synthetic
STREDARRLVERVRKEVKRLLKKNSDLLREVTERVKTLNERNRRDHMVLHEYVNAAGITDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 1959 - protein, 180 aa, Artificial Sequence
  Synthetic
STEEVLDEIRKLHKTLTEDIKRVLREIEELHRRTIEENKEVLDRDHMVLHEYVNAAGITDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 1960 - protein, 180 aa, Artificial Sequence
  Synthetic
SKEEVLREIERLHKETIRRIEEVLREATELHKRLTETNKRVLERDHMVLHEYVNAAGITDTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 1961 - protein, 178 aa, Artificial Sequence
  Synthetic
DDLERVLKEIKKAADKIREDNKRTADKIRKRVKELDDETRDMLRDHMVLHEYVNAAGITREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 1962 - protein, 187 aa, Artificial Sequence
  Synthetic
SEKERLKEELEKLSKEIEDILRDDKRSDDELRRRLRELLEKDRRDHMVLHEYVNAAGITARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 1963 - protein, 175 aa, Artificial Sequence
  Synthetic
SEKEDLERELEEVRRRVEESLRKNEEDVKRVRDELKKLLDENRRDHMVLHEYVNAAGITKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 1964 - protein, 175 aa, Artificial Sequence
  Synthetic
SEEDELRRLLKEVNERVERLLDEIRKELEKIAEELRDLLKKNERDHMVLHEYVNAAGITEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 1965 - protein, 177 aa, Artificial Sequence
  Synthetic
SAIEKVKEVVERVLETVRDSVRRSHEESKRLIDKVRKRLEEVRRDHMVLHEYVNAAGITERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 1966 - protein, 174 aa, Artificial Sequence
  Synthetic
SEIEELEKRIDELLKELRDLSRRIAEEVKRLLEELKKLSKDSERDHMVLHEYVNAAGITEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 1967 - protein, 174 aa, Artificial Sequence
  Synthetic
DEEEDLERRIKKLLDENRELLKRIAEELRRLLEELRRLTEESARDHMVLHEYVNAAGITEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 1968 - protein, 177 aa, Artificial Sequence
  Synthetic
SEAEKVVEELKKLLREVEKKIRDHTEDVKRILEELERRLRKHSRDHMVLHEYVNAAGITDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 1969 - protein, 174 aa, Artificial Sequence
  Synthetic
EELERILDKVRKVIEEVRKRLRDDLRTVEKVLKETEEVLRRAARDHMVLHEYVNAAGITGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 1970 - protein, 178 aa, Artificial Sequence
  Synthetic
SSKDEIRRRVEEVVERSDEIVKRSREHVKTVVDELDRVVKELERDHMVLHEYVNAAGITGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 1971 - protein, 175 aa, Artificial Sequence
  Synthetic
SEVDEVLREAKRIVDEVHKDNERATEESRRLVKKVHEENEEMVRDHMVLHEYVNAAGITEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 1972 - protein, 186 aa, Artificial Sequence
  Synthetic
SEVDEVRKTLEDLLRRLDEENKDIIRRNKELLDDLDRKVREAIRDHMVLHEYVNAAGITLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 1973 - protein, 184 aa, Artificial Sequence
  Synthetic
ELIKKARKDVEEVRERSERLVDELRKRNKKLADESRRLIDKLRRDHMVLHEYVNAAGITRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 1974 - protein, 186 aa, Artificial Sequence
  Synthetic
KEVEDLERRVKEILDRMKRLIDENRKKIEKSIRELERLIDENRRDHMVLHEYVNAAGITGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 1975 - protein, 186 aa, Artificial Sequence
  Synthetic
DEIRELEERVRRILDELRRLVERNREVIERSIRELEKLLDRNRRDHMVLHEYVNAAGITGGDDKKTMLDDVRRLLREAEDHSRRSSETAKRIHRENEEHSKDSSRKVRKLIEELRELAKKVEKEITDERVKEAIKELVKDVDRVMREVDRANRELTKTSKKVLEDVDRTNRRLVKEVRDVVERARK

SEQ ID NO: 1976 - protein, 186 aa, Artificial Sequence
  Synthetic
KEVEDLERTVRTILKRMRELITRNEEEIRRSIEELKKLLKENKRDHMVLHEYVNAAGITGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 1977 - protein, 185 aa, Artificial Sequence
  Synthetic
SAEELLRTIEKRIEDNHRRLEEILEEIARLIEDMLRTDERIVRRDHMVLHEYVNAAGITGVPEEVLERVRRELERLKKELEELRRRSEEKVKELKRRLEEIRRKLEEEHRDLRRKLEELRRDLGDKEEVVKKLVEDVERELERSLREAEDLLRRVEEVIRTSKKESKDVLEKIERLLRDLERRTR

SEQ ID NO: 1978 - protein, 176 aa, Artificial Sequence
  Synthetic
REAEEAKEEVEELNRRNKKELDDARRRVDELDKRNKDRLKESSRDHMVLHEYVNAAGITGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 1979 - protein, 182 aa, Artificial Sequence
  Synthetic
DLERRLDELLKRIEDRVRELVRTLEESLRELERRVREIIRRLERDHMVLHEYVNAAGITNKPDKAVKDDVRRLRENADRLNKRVREELKKLREDVKRVNEDVKRELDKLAEEAKDMLRKLREAGIDERVIKKAEEDVRRLLREIEEVSERHKREVDRLEREIEEVSREHKERVEKLLREIER

SEQ ID NO: 1980 - protein, 179 aa, Artificial Sequence
  Synthetic
RLEDEVRKMEKEVREEVKRLEDESRKVLEESRRNLDKLREESKRDHMVLHEYVNAAGITGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 1981 - protein, 183 aa, Artificial Sequence
  Synthetic
SVDERLDEVLERVKEDMDRNRRKNDESLREDEENVRRNKKETDRDHMVLHEYVNAAGITVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 1982 - protein, 183 aa, Artificial Sequence
  Synthetic
SIEDEIRKLKEDIKRVLDKVRRDNERLKERLDKVLEDIRRSSERDHMVLHEYVNAAGITPVDERLVRKVEEAVKRLKEHNEDSTRRVEEVIRRLKEESEESVRKTEKVARDLERELDEVLTRGGEERVREVIEKLKETLERLKREDKEVADRAEKLLREAEEHNKRSLDESRRVLEELDEEIR

SEQ ID NO: 1983 - protein, 183 aa, Artificial Sequence
  Synthetic
SIEERVRELMRDLERVLKEIREHSKRVIEEAKRVLEEIERNSERDHMVLHEYVNAAGITPVDETLVREVEEAVKKLKEHNKRSSDTVRDAVRKLVERLKESSDRATELVKDLKRKLEEVLRRGGEKELEEVERRLRKVLEDLRRNNKEVVDRLKEVLERLKEHNRRSLDESRKVLRELKERIR

SEQ ID NO: 1984 - protein, 174 aa, Artificial Sequence
  Synthetic
SESDEVIRDLARLLDELARHVDDSVRRMDEVVKRSTREADELARDHMVLHEYVNAAGITERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 1985 - protein, 172 aa, Artificial Sequence
  Synthetic
SRAETVLKEVTDKIKKLADSSDELLRRNKENIDELKKSSEELLRDHMVLHEYVNAAGITEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 1986 - protein, 174 aa, Artificial Sequence
  Synthetic
DEEEDLERAIKKLLDENRELLKRIAEELRRLLEELRRLTEESARDHMVLHEYVNAAGITEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 1987 - protein, 184 aa, Artificial Sequence
  Synthetic
DEIRKVVKEITDLLKASNDKNRKVVEEIRDLLRKSKKLADELVRDHMVLHEYVNAAGITSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 1988 - protein, 181 aa, Artificial Sequence
  Synthetic
DAVEEAEKLIRKVIADSEKLLRDLADLNAKSIRRSEKLVEDDRRDHMVLHEYVNAAGITGGSEEELRALLKEVEDTNRASHETNKRLLDEDRALNKEVHDRNEKLLRDIKRLVEEVAKGIDSEELLRRIKKLLDEIKKAIEDSSREIKRLLEESERVMKRSSEDIKRTLDDTRRVVEEVRR

SEQ ID NO: 1989 - protein, 177 aa, Artificial Sequence
  Synthetic
SEDEDLDRVAEKLAREHKKSVEEIKRVLKSADEESKKLVRDTERDHMVLHEYVNAAGITNIDEELVERLKKKIEDILRTLEERHKKLIKELREILKRLSDESRRLAEETEKVLEDLERKGVDEEVLKKLAEIVRRVKEENRKVNEEVEKRLRELEEENKKVIEDLKSTVEELVERLR

SEQ ID NO: 1990 - protein, 177 aa, Artificial Sequence
  Synthetic
SKEDRLREELKKLLARLAEEIERLKRALEESNKDLKRTIDASERDHMVLHEYVNAAGITEELLRELERSTAENKERAKELLKRHEDLVRKVEKELADLLRRLEEIVARVDEALKRGISEEELDKLLKEARDLIREIEKRLEELLKRVEKLTEDAKRDLERSNREHKELADRIKETAR

SEQ ID NO: 1991 - protein, 238 aa, Artificial Sequence
  Synthetic
EEDERLTKRVEEIKRENRELLRRLEEEVKELERKSEKIVRDLKRDHMVLHEYVNAAGITTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 1992 - protein, 245 aa, Artificial Sequence
  Synthetic
TEEEVLRKVEKLIKDLLDVLRDLLRASEEVVREALRVLEELIERDHMVLHEYVNAAGITSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 1993 - protein, 250 aa, Artificial Sequence
  Synthetic
STEEILKRVKEILDELAKELRDIIRESLRTIEELLDELRRILERDHMVLHEYVNAAGITVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 1994 - protein, 247 aa, Artificial Sequence
  Synthetic
SEKEELLKLIKRVIELLKRVLEEHLRLVEDVIRRLKELLDSNERDHMVLHEYVNAAGITVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 1995 - protein, 238 aa, Artificial Sequence
  Synthetic
SEAEKIREALETNLRLLEELIKRLKEILDTHNELLRRVIETLERDHMVLHEYVNAAGITEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 1996 - protein, 247 aa, Artificial Sequence
  Synthetic
SEAEDLEELIKELAELLKDVIRKLEKINRRLVKILEDIIRRLKRDHMVLHEYVNAAGITDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 1997 - protein, 240 aa, Artificial Sequence
  Synthetic
SDKEEIKRRVEKTARDLETEHDKIKKRLEDTVRDIKRELDELLRDHMVLHEYVNAAGITGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 1998 - protein, 240 aa, Artificial Sequence; identical to SEQ ID NO: 1997
  Synthetic

SEQ ID NO: 1999 - protein, 248 aa, Artificial Sequence
  Synthetic
DEDRIIEEIARLLEELLRELLELIKKLIETNRRLNEEHERAVRRDHMVLHEYVNAAGITGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 2000 - protein, 248 aa, Artificial Sequence; identical to SEQ ID NO: 1999
  Synthetic

SEQ ID NO: 2001 - protein, 238 aa, Artificial Sequence
  Synthetic
DADELLRRLAEEVERVIREAEDLLRRWKETIKKVLDDLKRLLDRDHMVLHEYVNAAGITKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 2002 - protein, 231 aa, Artificial Sequence
  Synthetic
DKAEVLREALKLLKDLLEELIKIHEESLKRILDLIDTLVKVHERDHMVLHEYVNAAGITERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 2003 - protein, 231 aa, Artificial Sequence; identical to SEQ ID NO: 2002
  Synthetic

SEQ ID NO: 2004 - protein, 236 aa, Artificial Sequence
  Synthetic
STREKAKKVLDTLRADNEDMKRVVEKILRALKRTNERAEKLARRDHMVLHEYVNAAGITEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 2005 - protein, 236 aa, Artificial Sequence; identical to SEQ ID NO: 2004
  Synthetic

SEQ ID NO: 2006 - protein, 239 aa, Artificial Sequence
  Synthetic
SERELIERWLELHKEILRLIRELVERLLKLHREILDTIKKLIRRDHMVLHEYVNAAGITKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 2007 - protein, 239 aa, Artificial Sequence; identical to SEQ ID NO: 2006
  Synthetic

SEQ ID NO: 2008 - protein, 231 aa, Artificial Sequence
  Synthetic
SKEEEVEKVLRKWEEILRRLIEENKRANDKIRREYEELVKEIRRDHMVLHEYVNAAGITEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 2009 - protein, 231 aa, Artificial Sequence; identical to SEQ ID NO: 2008
  Synthetic

SEQ ID NO: 2010 - protein, 245 aa, Artificial Sequence
  Synthetic
DEDELIRKLLEDLKDIVRKILELIERDLRDIERVVRRIVKVIRRDHMVLHEYVNAAGITVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKNSKDILEEVRKLIDELRKRIKEVED

SEQ ID NO: 2011 - protein, 247 aa, Artificial Sequence
  Synthetic
RDRDVLRKVKAEIEELVARIEKVSRDALSEVKRLLDENRKIAERDHMVLHEYVNAAGITRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 2012 - protein, 247 aa, Artificial Sequence; identical to SEQ ID NO: 2011
  Synthetic

SEQ ID NO: 2013 - protein, 231 aa, Artificial Sequence
  Synthetic
SKDEELARLLEELVERWRKIVEDLERDHRRLVKEIRELVERIRRDHMVLHEYVNAAGITERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 2014 - protein, 238 aa, Artificial Sequence
  Synthetic
SEIEDVIRRLRKILEDLERVSEKLLREIKKILDEARRLNEEVIRDHMVLHEYVNAAGITGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 2015 - protein, 237 aa, Artificial Sequence
  Synthetic
KEKEDALKKLEDLARKSREDLERVLRKHKKILDKIEELLKRVLRDHMVLHEYVNAAGITESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 2016 - protein, 237 aa, Artificial Sequence; identical to SEQ ID NO: 2015
  Synthetic

SEQ ID NO: 2017 - protein, 241 aa, Artificial Sequence
  Synthetic
SEKELLKEILDRIRELLEDDNRLLKRIVDEIRKLLEEWLRVHKRDHMVLHEYVNAAGITEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 2018 - protein, 241 aa, Artificial Sequence; identical to SEQ ID NO: 2017
  Synthetic

SEQ ID NO: 2019 - protein, 240 aa, Artificial Sequence
  Synthetic
DREKSVRDIEEDLKRVLDKLRRRVETSKEELKKVLKADKENADRDHMVLHEYVNAAGITIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 2020 - protein, 240 aa, Artificial Sequence; identical to SEQ ID NO: 2019
  Synthetic

SEQ ID NO: 2021 - protein, 237 aa, Artificial Sequence
  Synthetic
REDEVLRDIERLLREIEEKIRRILEESTAELRKVEEEVKRIIERDHMVLHEYVNAAGITGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 2022 - protein, 237 aa, Artificial Sequence; identical to SEQ ID NO: 2021
  Synthetic

SEQ ID NO: 2023 - protein, 243 aa, Artificial Sequence
  Synthetic
SEAERLADEVRKAVKKSEEDNETLVREVEKAVRELKKNNKTWVRDHMVLHEYVNAAGITGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 2024 - protein, 245 aa, Artificial Sequence
  Synthetic
SEKDEVTRRIRELLKEAEETNREAIERIKRLLDRVREAVEEVARDHMVLHEYVNAAGITGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 2025 - protein, 239 aa, Artificial Sequence
  Synthetic
SAEDLVRRVKDLVDKLEDKLRKVVRTNERLWEEIRKRLEELVRRDHMVLHEYVNAAGITDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 2026 - protein, 247 aa, Artificial Sequence
  Synthetic
DEERLAEELERVLDRNRKLLEEALRELRRVIEENRKSVKRLLDRDHMVLHEYVNAAGITSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 2027 - protein, 243 aa, Artificial Sequence
  Synthetic
SRVEELKKLIEDILRISREVVERIARVAEDIHRINRRVLDDLRRDHMVLHEYVNAAGITKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 2028 - protein, 249 aa, Artificial Sequence
  Synthetic
DAEEVVKRLADVLRENDETIRKVVEDLVRIAEENDRLWKKLVERDHMVLHEYVNAAGITGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 2029 - protein, 240 aa, Artificial Sequence
  Synthetic
DKDKRLEELLKRLKELNDKTFEELERILEELKRANEASLREAERDHMVLHEYVNAAGITKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 2030 - protein, 240 aa, Artificial Sequence; identical to SEQ ID NO: 2029
  Synthetic

SEQ ID NO: 2031 - protein, 240 aa, Artificial Sequence
  Synthetic
SKEETLKRLLDELEKRNRETVERLERLLKELEDRNRASLEELERDHMVLHEYVNAAGITKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 2032 - protein, 240 aa, Artificial Sequence; identical to SEQ ID NO: 2031
  Synthetic

SEQ ID NO: 2033 - protein, 243 aa, Artificial Sequence
  Synthetic
SEAERTKESLKKVLKALVDLNRELLRKLEENMRELTKLNEEVKRDHMVLHEYVNAAGITDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 2034 - protein, 178 aa, Artificial Sequence
  Synthetic
REVEEIERRLRELVRRSDELVRTVAEELEKLVRRNKKLVEDVMKRLRDLVERLRELVDAGLDKKEAEEDVRRLEEEIRRLLETLKEHSDRTRKKIRELVERLRDVNRKVNEEVKKLIRDRDEVRKVLKDVTELSKTSEDKLEKVVREVKRKLDEVNRDLERVVREAKKLLREVRERLE

SEQ ID NO: 2035 - protein, 178 aa, Artificial Sequence; identical to SEQ ID NO: 2034
  Synthetic

SEQ ID NO: 2036 - protein, 178 aa, Artificial Sequence
  Synthetic
DEVDEIRRRLKKLLDDSRKTSKDIERRLRELLDRNRRLVERVEEELRKLIKELEELVRSGLDREDVKRMVKKIEDEIRKLLEDLREHSKRTLEEVKRLLEEDRRTNEDLNREIERLDRRREEVEKVLKEARDVSEDSKRETTEVLKEAKKALEDINKRLREIVETVREALERVERALT

SEQ ID NO: 2037 - protein, 178 aa, Artificial Sequence; identical to SEQ ID NO: 2036
  Synthetic

SEQ ID NO: 2038 - protein, 178 aa, Artificial Sequence
  Synthetic
DEKETVKDVVRRLVEKLEEVVKESKKLVDDLVKRAKEIVRESEELVRRNVRRAEEVARERNDEETAKRLIEDIRRTTKEIIDTSRRLIEELRRLLEELKRRSEELIREIEKELKDVADRLVRDEKVLKELEDAVREVKERIKKTNKELEEMVRRVEEEIRESDERLKKASEEVEEKIR

SEQ ID NO: 2039 - protein, 178 aa, Artificial Sequence; identical to SEQ ID NO: 2038
  Synthetic

SEQ ID NO: 2040 - protein, 178 aa, Artificial Sequence
  Synthetic
SEMETVLDDVRRVVEESEELVKRARDRVKKLVDDLKRLVEKNEEDVKRVVDELDKLVEKVRTEELLERVRKTIERLADEIRRSTETIEREITKIEEEIERIVKTIEDRDRRLLEEIERRGAGEEVLEEARRLSERSREELRRVLEEARRLIRRVREELKRVHDKARRLVERVEEKLRT

SEQ ID NO: 2041 - protein, 178 aa, Artificial Sequence; identical to SEQ ID NO: 2040
  Synthetic

SEQ ID NO: 2042 - protein, 178 aa, Artificial Sequence
  Synthetic
DEVEEVLERVKKVVADSEELVKRNRERVKKVVDDIRDLIRRNAETVKEVVKTIRELVKKVRTRELLEDVKRRIKKLLDEIRESTKRIKDTIRRLREEIERTSRKIEDDDRKLVEEIRKSGLGEEALKDAERRSDESRKKLKKVHDDADRMVREVTRRLDEVHKEAEKRVREVLAELDT

SEQ ID NO: 2043 - protein, 178 aa, Artificial Sequence; identical to SEQ ID NO: 2042
  Synthetic

SEQ ID NO: 2044 - protein, 177 aa, Artificial Sequence
  Synthetic
SIEEVLKEAHELNKEANKRLRDVEEDAKRLIEEVLRRLEDVLRESERLAREVLEELKRKGVDEKILREIKKLLDENRKHSEEVKRRIEELLRRLKDLVRRILKKDTDSNRELKRLVEEGLDAKELRRRVERSVEESKRLVDELRKDVKRVVDEIRKVVEEDLRHAKRVVDEIREKVR

SEQ ID NO: 2045 - protein, 177 aa, Artificial Sequence; identical to SEQ ID NO: 2044
  Synthetic

SEQ ID NO: 2046 - protein, 175 aa, Artificial Sequence
  Synthetic
DEAEEVKRVVEESVRRNEELVRRNEELVRDVLRRLKEVVDENERLVKEVVDRLRDLVRRGADKEEVRREIEKILRDLHEHSKRTEEEIRRLLEELHKHSEETLKDSKRSHEELRRRGAEERVLKEVEELDRRVLEELKRVNDEARKRVRTLLEELRRVNEKVEELVRRILEELKK

SEQ ID NO: 2047 - protein, 175 aa, Artificial Sequence; identical to SEQ ID NO: 2046
  Synthetic

SEQ ID NO: 2048 - protein, 172 aa, Artificial Sequence
  Synthetic
DEAEDVVRKVMDEIRKLIEVSKEILKELRRLVEELKKHSDRTVEELRRVVTELLKKEASEEEAKEVVDRIRELVTRLVEENKKLVEEIRRRVEELIRRSEEELKRIEREVDTKLKDITDAVRRVRELLETVRRTSEEVLKTLEEFLRRVEKSTRRAEEELEEFLKRVEDRVK

SEQ ID NO: 2049 - protein, 172 aa, Artificial Sequence; identical to SEQ ID NO: 2048
  Synthetic

SEQ ID NO: 2050 - protein, 183 aa, Artificial Sequence
  Synthetic
KEADKLAKELEETIERLKRDSERLVTDLERLLERLERRSRELVKRLRRHVEELLKTVRRDGGESEELKKRLKELKDSNKRLNEDSERVTRKLVTDVERLLEKAEERTKELSERVKRRIDEVRKDVPELREVIKKVEDLLREVEETSKRILDRVRELLKKVEDSSRRINEESKKLLKRVEEEAR

SEQ ID NO: 2051 - protein, 183 aa, Artificial Sequence; identical to SEQ ID NO: 2050
  Synthetic

SEQ ID NO: 2052 - protein, 175 aa, Artificial Sequence
  Synthetic
SELEKILEDLKRVAERVAKALDRSLRELEKVLRRVEEELTRSNERLREVVKEVEDAADKLREVIKKLRELLRDLEEKTKRLVDELRKLAKRLAEDTKRLVEDIKRLLDELRKRIRDVDRDEEVRKLVEDLARRLDDIVRRSEELSRKLAEDVEEIVERSKRLSEELAREARELVR

SEQ ID NO: 2053 - protein, 175 aa, Artificial Sequence; identical to SEQ ID NO: 2052
  Synthetic

SEQ ID NO: 2054 - protein, 180 aa, Artificial Sequence
  Synthetic
SEIEDVVRKVETLARESDERVKTLMEENKDLAEKLKKLVRDVVEKVKREVTRLLDEVRRRPEREVLDRIRETIKRIEDELRELLKTIDRLSRDLERKNRELRETSKKIIDDIRRELDKLPEDEELKKVKERLDEAERRSKELIDEADRLNREMLKRVKEAIKKVKETLDKALEDVERAVR

SEQ ID NO: 2055 - protein, 180 aa, Artificial Sequence; identical to SEQ ID NO: 2054
  Synthetic

SEQ ID NO: 2056 - protein, 173 aa, Artificial Sequence
  Synthetic
SDLERVEERLERAVREVEKLHEDSRRELRRVVKEVHDSTRKVEERNRKLVKRVEEADIREEMLEELRRRSEESIRRTRKVNEDLHRAIEEIERKDKELLDRAKKEVEELLKEVRERGDKKVIKKLEDMLREWAKLVEKSIKELKELLEELRKVSKKLVDDNDRLAEELKRRVD

SEQ ID NO: 2057 - protein, 173 aa, Artificial Sequence; identical to SEQ ID NO: 2056
  Synthetic

SEQ ID NO: 2058 - protein, 183 aa, Artificial Sequence
  Synthetic
DEVKALVDKVRELVRKLKEESDDLVRRNEELAKEVEKRSREVVEKVRDTVRKLLEELERADKSDKERLDRLITRIREKIDEVRRRIEELNREIEEVSKKSLKENKDTNREIRERIERLRKELDDKGVDKKVRDDLRKALEDVNRSSKRVEERDKEVLDEAHRSSTRVLETLKRMLERLDEKIR

SEQ ID NO: 2059 - protein, 183 aa, Artificial Sequence; identical to SEQ ID NO: 2058
  Synthetic

SEQ ID NO: 2060 - protein, 183 aa, Artificial Sequence
  Synthetic
DEVEKLVKKVEDLVKRLIEVSEDVVREVEKRLRELEKVHREALRKNRKLLEDLLRRLREADKTSDEEVKRLKEEIDEVSERSRRENDRLNEEVNRVTKEVTDKIRKVNEDIRRKIKELKKELDEKGVDDKVREKLKRALDRVNKSSREVEETLRRADKRLNDLVKEIKDEDKRMLERLERETQ

SEQ ID NO: 2061 - protein, 183 aa, Artificial Sequence; identical to SEQ ID NO: 2060
  Synthetic

SEQ ID NO: 2062 - protein, 183 aa, Artificial Sequence
  Synthetic
KEVEELVKEVRKLATKVIETSKRVVEELEKLAERLLRTSKEVVKRNKELVDDLLRRVREVSDGDEEKVRRLEEDIRRRSKKSEEDNDRLNEDINRKSKKVADELKKLNDDIRRELDELERELDREGVEEEVRKELRELLRRVNESSKDVKRRLEDLDREINRLSKRVKEEDRRALKEVEEEIK

SEQ ID NO: 2063 - protein, 183 aa, Artificial Sequence; identical to SEQ ID NO: 2062
  Synthetic

SEQ ID NO: 2064 - protein, 177 aa, Artificial Sequence
  Synthetic
SKEEEVKRVLREALERVEELNKRLNEEDKRMLDEVRKVNRDAERVLREALKRVEELLSRVSDKDRVKKLREDVKRIAEEVERLSRKSEEDVKKVHRESKRLSDENRKEVKRVEDRVRDKPKTDELVTDVERVVRELLDHVRRLVRESKELARELIRRSEEIVRTVEEVVRKLEKDVR

SEQ ID NO: 2065 - protein, 177 aa, Artificial Sequence; identical to SEQ ID NO: 2064
  Synthetic

SEQ ID NO: 2066 - protein, 177 aa, Artificial Sequence
  Synthetic
DKAKKVEELLRKAIEEVEKLNDEVNRTDEKMLRRVKELNDDVHRTLEEAIKRVRELLSRVSDEDRVRDLRKKVEDARREIEKLSEENEERVRRVHERSRKLSDDNRRRVKEVEDRIRKKEKTDEVVTEVEKLMRELLEHVKRLIDESRKLAADLEKHSRDIVEEVRRLVEELLRTVK

SEQ ID NO: 2067 - protein, 177 aa, Artificial Sequence; identical to SEQ ID NO: 2066
  Synthetic

SEQ ID NO: 2068 - protein, 177 aa, Artificial Sequence
  Synthetic
SKERDVERKVREVIKRVEDLNKRVHKTLEDVIREVEKLNEEVKTRVEKLIREVEELLKRVSDKDKVRRLRELVERVRRRIEELSRENKKRVEEVRKTIEDLSRENRELVERVRREIEKKEKTDRVVEEVERLLRELEKHSKEIEEAVDRLVRKLEEHVKKVVEEVARLVAELKERVK

SEQ ID NO: 2069 - protein, 177 aa, Artificial Sequence; identical to SEQ ID NO: 2068
  Synthetic

SEQ ID NO: 2070 - protein, 177 aa, Artificial Sequence
  Synthetic
SVAEEVKKVKDKLKKDVERLNEEDRRVLEKAKRESKKLLDEIKRVLEELERKLEELLRRDDDKDRVRDLRRKLDEVRKRVKKLIDDSRKRTKDVEKRTEDLNRETEELVRRVEKRVEDLPKAKEVVTEIRRVVKELLDKVRESIKETERVVRELLERNRKILKEIREVVRKLLEDVR

SEQ ID NO: 2071 - protein, 177 aa, Artificial Sequence; identical to SEQ ID NO: 2070
  Synthetic

SEQ ID NO: 2072 - protein, 186 aa, Artificial Sequence
  Synthetic
DEARKLLEELKRLAERVLKTDTDLLDESRRILEEVLKTNKKSIEDSKRLAEDVLRKVAREGGESERAKDLIRKLLEDLKELLKRSHETNKRLLEELRRLDEEIHRTNEKLLRELKALLDRIREAGLEEEVLDRVREIMERVLTESKELNDRIHTISRKAEEDSKRLNEEDRAIMEDVRRELKRVVD

SEQ ID NO: 2073 - protein, 186 aa, Artificial Sequence; identical to SEQ ID NO: 2072
  Synthetic

SEQ ID NO: 2074 - protein, 186 aa, Artificial Sequence
  Synthetic
SEAEKLLEELRTIAKEVLDRVRKMLRESEKLAEDVLRENKKSIEDSRRIAKKVLDELRRDGGEDESLRERIKRLLEELRRLLEESHKKNEELKRELEELNRRIEETIRRLEKRLKELLDRIEEAGLEEEVLERIRRIFEDVLRKLRKLLDEIHRISEKVKKESEELNEEDKRIVDDAERRLEDLER

SEQ ID NO: 2075 - protein, 186 aa, Artificial Sequence; identical to SEQ ID NO: 2074
  Synthetic

SEQ ID NO: 2076 - protein, 177 aa, Artificial Sequence
  Synthetic
SVKDAVEKILREAEETVKRLNEETKRRLDEAREESKRLIDEVRRILEKLKEVLDEVLRRVSDEEKVKRLEDVLRRIEKRVRDLLKEVEDNTRRSVERVRKLNEDDKRRLDEIKEEVRREPGAEELLERVKRLMDELEETSRRILEEVERVIRRNKELADRILKEVAELLKRLEEELR

SEQ ID NO: 2077 - protein, 177 aa, Artificial Sequence; identical to SEQ ID NO: 2076
  Synthetic

SEQ ID NO: 2078 - protein, 180 aa, Artificial Sequence
  Synthetic
DEAEELRKTVEDIMKELREELKRLEEESRRIMEELKKRLEKLIEDSRKAAEDLKREADRLTDKEKVKRLKEELERLNRTINKISKELLEKLRRLNTEINKTVDRLRERLERLAEDIRRRVDKRLLEEIKERVDRVKKELDEADKRINDSSREVEKTLEDLDRKINKSSEEVRRVLEEAER

SEQ ID NO: 2079 - protein, 180 aa, Artificial Sequence; identical to SEQ ID NO: 2078
  Synthetic

SEQ ID NO: 2080 - protein, 181 aa, Artificial Sequence
  Synthetic
DVEETLTRLLKEILDVVRKALRDTREIVRDVRRVSEEVLKELEDLLREVDREVKRVLAELKGKELLEELKKLLEEIRKVVKEIEDRLKRVTEESEENIEESLRELKRLLKEIKDDVDRVRKSGVEDTEVVKRIRELVEKLRELVKRSNDNLKEHVKRNKELAKRLLDELRKLVEDLKRARK

SEQ ID NO: 2081 - protein, 181 aa, Artificial Sequence; identical to SEQ ID NO: 2080
  Synthetic

SEQ ID NO: 2082 - protein, 176 aa, Artificial Sequence
  Synthetic
DMEEEVKKLIDEVRRVLEEVLKRVEDIIDASRRTLKKVVDDVRRIDEDVERELKEAEKRGVPKEVVEEVRDRLRRNHETVKKRIRDLEKENRDLIREIRKLIDKLRREIEELERRLDELGKEEVLREVDRLVKKVEKTARELLRLLEESIEKSKREAEKLLRSNEDVVRRVRERVR

SEQ ID NO: 2083 - protein, 176 aa, Artificial Sequence; identical to SEQ ID NO: 2082
  Synthetic

SEQ ID NO: 2084 - protein, 174 aa, Artificial Sequence
  Synthetic
DAEEDAKRLLKEVKDLLDEVRERHRELNERSRKVLEDARKTHEDLNEESRKTLEDRNIPEDILRKIEKHTRDTHRRAERLVRELREHSKKVHDTARRLVEELDKRIKELEERVRRERVGREARELLKRILKDIERILETVVRLSERDVEEVRKIMEELKKLSDDDLKRVEEEAR

SEQ ID NO: 2085 - protein, 174 aa, Artificial Sequence; identical to SEQ ID NO: 2084
  Synthetic

SEQ ID NO: 2086 - protein, 174 aa, Artificial Sequence
  Synthetic
SAREEIEELIKRVKDTSKKILEDVRRMIERVKRKSKKIKEDAKRLIERVEKLLRDSNLREDLLKRLEEEIRRIKEDIDRLIEKDERDIRRIEKEIEDLVRRNEDEIRKIEERIDKIDDKDELRELIKRLEDHSRRVVEEVARLVKELDEHSERVLKTLEDLIRRLDELVKRVTT

SEQ ID NO: 2087 - protein, 174 aa, Artificial Sequence; identical to SEQ ID NO: 2086
  Synthetic

SEQ ID NO: 2088 - protein, 174 aa, Artificial Sequence
  Synthetic
KAEETVKELLDRVERISERARKEVRELLERSKESTKRILDEAREMIKRSRDELRRVGTDDKELKKVEDHSEEVRREVDELIKKSEKHTEDIRREVEELVRRDREELRKVEDKARREGDLEDLERLARELARHSEDVMRRLRDLARKDKELSEDLVRRLRELVKRDLDLVKTVKE

SEQ ID NO: 2089 - protein, 174 aa, Artificial Sequence; identical to SEQ ID NO: 2088
  Synthetic

SEQ ID NO: 2090 - protein, 181 aa, Artificial Sequence
  Synthetic
SMEDRLREVNEKNNRLIEDATRKSERVLDKIRELLKEVKRRSEDVLRRIKELVEKLPVEERVKKEIKEDIDRLRKHSEELVRDVERIIRDLKRHSEEVVERVRRKDEETRREVEELARRGSDEKTLKELVEKIEKVAEDSLREAEEDVKRIEDLVREIKKRADDDVRRLEDRVRRLRERLE

SEQ ID NO: 2091 - protein, 181 aa, Artificial Sequence; identical to SEQ ID NO: 2090
  Synthetic

SEQ ID NO: 2092 - protein, 182 aa, Artificial Sequence
  Synthetic
SSVEEVVEEIERLVDELRKRAEELVRESEKLVAELERRIRKLVEDSEKLVKDLKDRAAKGVSEEELERLLEKLKRVAEKTNRTSEELLRELHDFNRRSEKEIDDLLRELEKRVKEVRDRINSDDKVLRKIEDVDRRLKELVRRVKKKDRDSNERVKELVKRLNDENEKVLKRVEELVRRDKT

SEQ ID NO: 2093 - protein, 182 aa, Artificial Sequence; identical to SEQ ID NO: 2092
  Synthetic

SEQ ID NO: 2094 - protein, 174 aa, Artificial Sequence
  Synthetic
DEIKKVVKDLEDLVKRLKDEVDRHVRENERIVEELKRNVDRHVEENRRLVKTLEDEVRKGVSEDELRKLLEEVERVTRRSKEDIDRMSKRVDDVTRESDEHIKELLKRVRDMAEKLPDSEDLKRVLKAVEDVVREAKERLERVNRTIREVVKRAREKLKRVHDTIRKVVDDARR

SEQ ID NO: 2095 - protein, 174 aa, Artificial Sequence; identical to SEQ ID NO: 2094
  Synthetic

SEQ ID NO: 2096 - protein, 178 aa, Artificial Sequence
  Synthetic
DEVEEVLKELKRSVDETRKLLKKIEDEAKRNVRRNEELAERVKRTVDRLVEELRDLIRRGVDKEKLDRLLRKIEKDLRELKRELEESLKESEKTIRRLKEELEDMLRRSREKIEELRRRGVDNEKLKRAEKEDEEVVRRIRELIERLREENEDVIRRAEELLREVVKRIEEVITEARR

SEQ ID NO: 2097 - protein, 178 aa, Artificial Sequence; identical to SEQ ID NO: 2096
  Synthetic

SEQ ID NO: 2098 - protein, 181 aa, Artificial Sequence
  Synthetic
SVEDEIRRVIEELDRLLRKDKETIKRVIKELRDLLREVKKRTEEMIRRLDELLETVTRRIKDEETMDRIDKEIKRLKEELRELLERSDREIRKLEERLERLVRESEKKIRDLKRRLDKARRDGSDVDDVRRLAKEVLDEVKKSVDETKRLADEVKTRVRKNVKDNTDLAREVLRRVAERAR

SEQ ID NO: 2099 - protein, 181 aa, Artificial Sequence; identical to SEQ ID NO: 2098
  Synthetic

SEQ ID NO: 2100 - protein, 174 aa, Artificial Sequence
  Synthetic
SRLEKLVKEIRDVVRELAERVKESVDRARKVVKEDLEHAEESVRRVKKVVKELEELVRKLDREEELRKTVEEIRRRNERSNRENRKHSKKVLDDDERSNRELERTMREIKDRIDKLDDDKDIKEVEKRLKDVLDEAHKLNKRTNDELKRVNKESNDLNRKTEEDLKRVLERAED

SEQ ID NO: 2101 - protein, 174 aa, Artificial Sequence; identical to SEQ ID NO: 2100
  Synthetic

SEQ ID NO: 2102 - protein, 174 aa, Artificial Sequence
  Synthetic
KRKEDLVEEIRKIVKAVEDEVRRSVKESEDSVRENLKEAERIVRELEEIVKELEKLVRDGLDRRDLRRVAREVKERLRELVERLRESIRDSNRRNKELHDRLRELVRRVAEELKKLDQDELLEDVRKKLEDVLREVEKLNKTVEDKNREVLRRIDELIRRVEEAIEDVRRKVEK

SEQ ID NO: 2103 - protein, 174 aa, Artificial Sequence; identical to SEQ ID NO: 2102
  Synthetic

SEQ ID NO: 2104 - protein, 174 aa, Artificial Sequence
  Synthetic
DEKEELVKRVEDKVKDLRDKVEKSVRESTESVRDNERRVRESVERSRDLVRRLDELVRAGLDEEEVKKVVKRIEEDNKRLHDELRRSVEASNEKNKKLHEDLKRLADEIRKEIDKLDQDEELERVRKELEEVLRRAKRLNEDVLEKNREVVRRAAELNKEVKKLLKEVLDRAKT

SEQ ID NO: 2105 - protein, 174 aa, Artificial Sequence; identical to SEQ ID NO: 2104
  Synthetic

SEQ ID NO: 2106 - protein, 175 aa, Artificial Sequence
  Synthetic
DEKEDIDRRLRDMVRRDRELARRSVEEARKLVDKNRKLVERVFRELKKLVDELDELVRRRDGPEDDIRRAVKKIKDDLRKLLKELDDHSKDTRRRDEESNRELERHTRELEERIRRLEDDKLLKDLEEELRKTREEVHRLNEETNRRLDKVNKDARDLVRELEELIEDVLRKVET

SEQ ID NO: 2107 - protein, 175 aa, Artificial Sequence; identical to SEQ ID NO: 2106
  Synthetic

SEQ ID NO: 2108 - protein, 174 aa, Artificial Sequence
  Synthetic
DEKETVEERLDRLVRHHEKLVRESVKELEELVRHNRELIKKSVEDARRLVEDLKRLIDEGVPEDDVRRTVREIEERNRESHKELEDHNRELRRRNKESHEELKKHIDEIRKELDKLPKDKLLDELRERIDKVNEDARKLNEEVERRITESEKEVTDLNRKVDEDIKRVLEKVER

SEQ ID NO: 2109 - protein, 174 aa, Artificial Sequence; identical to SEQ ID NO: 2108
  Synthetic

SEQ ID NO: 2110 - protein, 178 aa, Artificial Sequence
  Synthetic
SVEKVVKDVTDTIKKVVDDARRLSEEVVERNERVNKKLERLSREVVERIKDVLKRLRDKKSEKEEVERRIEKLVREHEEKTKKISEENKRSIREHERTSKEVEERIRRLVETLKELVRRGVPVEDLKRDADRIVEDIKRVVKELVKHAEKSVEDLERVVKEIVKDAERIVREIEKRVK

SEQ ID NO: 2111 - protein, 178 aa, Artificial Sequence; identical to SEQ ID NO: 2110
  Synthetic

SEQ ID NO: 2112 - protein, 182 aa, Artificial Sequence
  Synthetic
DVEEVVRRAREENKRSHDEVRELVKEVNERNKTVLERIKELAERALREIREVLREVDERKKDAREDLERLRKRVEDLLRRLEELLKTLEKRVRDLNDESRKLLKRLEEVNRELKKEIDDLEENRVETEKLKEDLDRIVRTSEELVRRLLERARRMVRETEELMRELLTEVKRIVEEVARRVK

SEQ ID NO: 2113 - protein, 182 aa, Artificial Sequence; identical to SEQ ID NO: 2112
  Synthetic

SEQ ID NO: 2114 - protein, 178 aa, Artificial Sequence
  Synthetic
DKEELLKRVTEKLEKVSDKSRRLIEEVEREVEKVHREVEERVRKVREDVRDVLRKIRAQGSSEEELEEVRDLARRIEETLKRILDEIKRVTEETREELKRLLEENRRLSEEIKDRLRRLRDDTELVLREVERLVAENERSVEELKKELEKLVRRNRTLVRKIEEDVRRLVEKITKRRE

SEQ ID NO: 2115 - protein, 178 aa, Artificial Sequence; identical to SEQ ID NO: 2114
  Synthetic

SEQ ID NO: 2116 - protein, 175 aa, Artificial Sequence
  Synthetic
SDSERVKKEAEDVLREIKRLIERNKRLAEETSERIRRLLEELKDLADKIVETLKDLIDRGEDKDTVREKIKDDLRDLERLAREVEDRIKKLTDELREHTRESEKEIKKIVEELRRKMKGREVVDEVEKRIRELLERLKDVSKKVEESNKKLLDEIRETVERVKKRIKELLEELRR

SEQ ID NO: 2117 - protein, 175 aa, Artificial Sequence; identical to SEQ ID NO: 2116
  Synthetic

SEQ ID NO: 2118 - protein, 176 aa, Artificial Sequence
  Synthetic
SLEEVVEEVKRRLTKLLKEIEDVIRRAEEESRRLLEEIERVIREAEKESRRLLEEIRTAGVREEELDKLRKHSEDVKRRLRKILEDNRKRSEEVAKELKELLEELKERIRKVEEDARDLDEDLVRKLAKELLDTLREVLKRIEEIAKEVLDLNDESLKEIRRIVEEDLRKLEEKMR

SEQ ID NO: 2119 - protein, 176 aa, Artificial Sequence; identical to SEQ ID NO: 2118
  Synthetic

SEQ ID NO: 2120 - protein, 173 aa, Artificial Sequence
  Synthetic
SEEEEVKRLLDDVREKVKRVAEENRRTVEEVKRVVDEVRRRNKETVERDRRELEKVARDEDKDRVVKEVRKSSADVVREDRESVRRAEEEIRKVMEDDKRSAEEVERIVRRAEEEVKVEEVVREIRRIVEDVRRKVKESVDRVKKILEKVRKDVEDSVREVERTMKKVSDDVT

SEQ ID NO: 2121 - protein, 173 aa, Artificial Sequence; identical to SEQ ID NO: 2120
  Synthetic

SEQ ID NO: 2122 - protein, 183 aa, Artificial Sequence
  Synthetic
SKEETAKRLIEEVRKVIEEVKKRAEDSNDHNRRSIEEVEKTLKRLIDEVRRVVEEVKEKISRTTDKDDIKRVLEEIKRIAEEVVRKIRRLLEEITRNSERIVRENEKLLREIEEIVRRVLEELKRLDLKEAVEEIERLMRKIKKVVEDSVRNVERTMREVEEKVRKVEEDVRRLAEDVTRAVK

SEQ ID NO: 2123 - protein, 183 aa, Artificial Sequence; identical to SEQ ID NO: 2122
  Synthetic

SEQ ID NO: 2124 - protein, 172 aa, Artificial Sequence
  Synthetic
DEVEEVLRRVRKIVKEDRDEAKDVREENRRLVEDDKRKVERVKEENRRLVEELRKRDEERVEEVVRRIEESARRVAKLSEETARDAERSVEKVVKDSERTVREIDKLVRDVVTDGDRRLLEEVERRVEKLVKESREIAKRSNDRTKDLVRRSEEILRESNERTRRLLEETER

SEQ ID NO: 2125 - protein, 172 aa, Artificial Sequence; identical to SEQ ID NO: 2124
  Synthetic

SEQ ID NO: 2126 - protein, 172 aa, Artificial Sequence
  Synthetic
SEAEKVLKDIEKIVKDLERNAKEVLDRNKRNVEDDKRAAEEVLEKLERIVREIDRGDKESVKEVVKEIRRLAEEVARASDETVRRNEKLAREVVEANKDVVRKIRKLVEDVVRDGDRELLKKVIRTVEKLLEDVHKLNEDSERAAKKLTDESREIAREVEERVERLLREEER

SEQ ID NO: 2127 - protein, 172 aa, Artificial Sequence; identical to SEQ ID NO: 2126
  Synthetic

SEQ ID NO: 2128 - protein, 174 aa, Artificial Sequence
  Synthetic
REVEEAEKRLREIVKEVTERNKEVVERLRDIVRKSEDDSRKSVETNKEIVDRVRRDVSDERVVREVKKVADEVVRRNERSAEDSRRVVEELVERSRESMERVREMVKRLVEEARKVTDRDVLRELIRTLEEVLKRSEDTNRELEKRIKEVVEDNRRKLEESIKESEKVVDEIRK

SEQ ID NO: 2129 - protein, 174 aa, Artificial Sequence; identical to SEQ ID NO: 2128
  Synthetic

SEQ ID NO: 2130 - protein, 174 aa, Artificial Sequence
  Synthetic
SEVEEAERRLKEIAEESKEISKRSVETNAKILDEVRRENTRVLETLKKILEEVERRVSDERVVREVEERVKELVRRSEESLRRVEEVIRRVLEENKESMRRSEERVRRLLEEARKVTDKDELERLIEDIREVVERNKKIADESIKRSRDVVKRSKETNDELEKTIREVVKRIED

SEQ ID NO: 2131 - protein, 174 aa, Artificial Sequence; identical to SEQ ID NO: 2130
  Synthetic

SEQ ID NO: 2132 - protein, 174 aa, Artificial Sequence
  Synthetic
DEVEEVLKRLRDILREAKELVERSVKRNEEIAEESRKESEESVRRNEEIVDAVRKRVDDKDKVARVEEVIRRVVEENRKSAKESLDMIRDVVRKNKKVLREAEEVVKRLVEEVRKVTDRRVLERLIRELERVLEELREKLKRSIEESEDVVRKNREILRRSIEKSEDVVRKIET

SEQ ID NO: 2133 - protein, 174 aa, Artificial Sequence; identical to SEQ ID NO: 2132
  Synthetic

SEQ ID NO: 2134 - protein, 182 aa, Artificial Sequence
  Synthetic
DVDEVLDTVRRLVEELLKKVERTSRESVRLAEKLLDEVRESSKRSKDESRRLLEEVREIDDSRKVARVVEESRRLMKEDLETVTEVVKRNEDSAREDEERVKRVAEEIRKIVADVFRRVKDKKREKVDKVRRDVERLVEEVEKTVKRSVEENRRIAEEIKRTVEESVKTNEEVVKRIEETAR

SEQ ID NO: 2135 - protein, 182 aa, Artificial Sequence; identical to SEQ ID NO: 2134
  Synthetic

SEQ ID NO: 2136 - protein, 172 aa, Artificial Sequence
  Synthetic
RERELVEEVERRLRESNERVKESVDRSRKLLETSHRRVKELVDRLKRVLERVEREVRNTTDKDRVRELVEEVKDAVRRVKEEVKKSVDEVREVVDKDVRDVRRSVKEVEEVARRVKVDELVKRVKEVVDHNERLAEESKKEVDDVVRRNEDLVRKVVEEVKDVVRRIKETVR

SEQ ID NO: 2137 - protein, 172 aa, Artificial Sequence; identical to SEQ ID NO: 2136
  Synthetic

SEQ ID NO: 2138 - protein, 172 aa, Artificial Sequence
  Synthetic
RERELVEEVERELKRSTREVEESIEESRKRLEESHRLVAELVKRLEEVLERVRDDVRRTRDKRRADKLVKDVEKAVRDVKREVDKSVKEVEDVVKEDKKRVDDSVTRVDEVLKRVDVDELRKRVEEVVRTNEELARESVRKVKEVVRRNKELVARVADKVREVVKRIRETLK

SEQ ID NO: 2139 - protein, 172 aa, Artificial Sequence; identical to SEQ ID NO: 2138
  Synthetic

SEQ ID NO: 2140 - protein, 179 aa, Artificial Sequence
  Synthetic
SVKEIVKKVVEENKKSDDELREFARRVAERNKRVVEELKKRLEDLVRKNEEVVDRLRKRSREEVVEKVKEDSKASVDTAKKVVDEVEERSRRSVKEVERVARESERKSRESVDRVRKAVRSEIVKEVVDRVRKSEESSRKLLEEIVRLVEKSLEEVKRILDEIRRRVEKSERDVRRLRK

SEQ ID NO: 2141 - protein, 179 aa, Artificial Sequence; identical to SEQ ID NO: 2140
  Synthetic

SEQ ID NO: 2142 - protein, 181 aa, Artificial Sequence
  Synthetic
DIVEELKENVKRVEETIRKIVKEARENVDDVLKKNKDNVEHDKRTAEEVLKEVKKSIKSDELRRKVEEVVERSRKTAKENEELARRVRDENEKVVKEVERLVRTVAEANKRIVEEIRRIEDKDTVRRLLEEASKLNKDVIRRVRELLKRLHERNEESLRRARELNERSRREAERVLEEVRK

SEQ ID NO: 2143 - protein, 181 aa, Artificial Sequence; identical to SEQ ID NO: 2142
  Synthetic

SEQ ID NO: 2144 - protein, 185 aa, Artificial Sequence
  Synthetic
SIVDRIREIMKEVREKVKRVVEENRRNAERIKRRVDEVVKTNRKTVDDVRRKVEDVVRKIKEKGREIERLLRRVEETVEESVERVERIAEKVVREHDKSVKDVERIVKRVTEVAEEVVKRLRRVDREVVEELLRRLRKIVKDVERELKRSTEELNRRSREVLKELEKSTRDVEKVVRELEERLRK

SEQ ID NO: 2145 - protein, 185 aa, Artificial Sequence; identical to SEQ ID NO: 2144
  Synthetic

SEQ ID NO: 2146 - protein, 185 aa, Artificial Sequence
  Synthetic
SVVDKIREIVRKSREDVRRVVEEIKDNARDLKRKAEEVVKEVKRIVDEVRETVRDVVEKIKELGREIEKLMERVRKAVEEVIRDIERIMREVLRLHEEVVERIERIVTEDEKKVRDVVAKVRRVREEEARKLLEDVKKSSDDVRRELKRLLEEVNRVSREAEKKLRELLERVKRIIDTLKDELRK

SEQ ID NO: 2147 - protein, 185 aa, Artificial Sequence; identical to SEQ ID NO: 2146
  Synthetic

SEQ ID NO: 2148 - protein, 185 aa, Artificial Sequence
  Synthetic
SVKDEIRRIVKESEEANRDVVEKIRRNVERIRRKVERVVEEIKRIVKEVKEKVEDVVRKNKEKGERIKKLVTDVEREVERVVEEIRRIAEKVTDVHRRVAEESKRSADEDKKTVDRVVERVDKAEEEVVRKLLEEVKKSSDESKDRSRRLLEEVNRISRDVERKLEELLRKVEKVVRDLEEELRR

SEQ ID NO: 2149 - protein, 185 aa, Artificial Sequence; identical to SEQ ID NO: 2148
  Synthetic

SEQ ID NO: 2150 - protein, 185 aa, Artificial Sequence
  Synthetic
SAEDVVRELKKRVDRSREDNTRVLEELKKAVEESRRLNEESNRRLEKIVRDIKEDLKRITTRKKELEDTVRRLLEKAEKVVRDSIKTSEETVTRVTDVVRRVIERSRETVTDLARVVEEVIRNVTREEVLRELAKIREDIERENKRVLEELEDVLRKVKRVNEEALKNSEDILRDIKEKVDRRRK

SEQ ID NO: 2151 - protein, 185 aa, Artificial Sequence; identical to SEQ ID NO: 2150
  Synthetic

SEQ ID NO: 2152 - protein, 180 aa, Artificial Sequence
  Synthetic
SVEELLRKLEEVLRKIREENERSLKELRDRAREIVKRNRETNRELEEVIKELEKRLSRRDKEKVEELVRRIRRIVERVVEEDRRTVEEIEKIAREVVKRDRDSMDRVRRTVEDVLRKATGSEDIVRKIERIVETIEREVRESVKKVEEIARDIRRKVDESVKNVEKLLRDVDKKARDRKK

SEQ ID NO: 2153 - protein, 180 aa, Artificial Sequence; identical to SEQ ID NO: 2152
  Synthetic

SEQ ID NO: 2154 - protein, 174 aa, Artificial Sequence
  Synthetic
SEEEKVKEEIRKLIEDSRRHVDELKKRLEKLLRDSEKNVEDAHRTNEKLARELKEKVKKTGTDKKLEEDLRRLLKKTEEYVKEHHRTNRELLEKVREEVKDHERRNRKLLEDLKKRGVNEDVLREAEEMLRDSNRELREILEKIERDLRKSDEELKKSVDDLRRLIKEVEDRLK

SEQ ID NO: 2155 - protein, 174 aa, Artificial Sequence; identical to SEQ ID NO: 2154
  Synthetic

SEQ ID NO: 2156 - protein, 174 aa, Artificial Sequence
  Synthetic
SREEELKKELKKRIEDSDRHVKEEKDELDRLIRESEEHVKRLKEEARKKLERLKDLVRKDGPTDELRKRLKDLLDEVKKMVEEHERDNRRKLKELEKRARDHHKRNRELLDEVRKAGVDEKVLREAEELLKEVDRKLERILEEIKRRLEKSDRDLRRVLKELEELIDEVRRRLE

SEQ ID NO: 2157 - protein, 174 aa, Artificial Sequence; identical to SEQ ID NO: 2156
  Synthetic

SEQ ID NO: 2158 - protein, 175 aa, Artificial Sequence
  Synthetic
SEKEDIKERIKELLKRSEENVRKLREENRELVRRSEENVKEIHKENEDLIRKLEKLRTRDVDKKKEAEDELRRLLRRTEKLLEDHKKLLEDILRRSRELLKEHEELLREIERELRERIKDEDVLREAKEALEESLRRLRKIHEDSERRLRESLEELRRSVEEAKRLLERLKRELD

SEQ ID NO: 2159 - protein, 175 aa, Artificial Sequence; identical to SEQ ID NO: 2158
  Synthetic

SEQ ID NO: 2160 - protein, 182 aa, Artificial Sequence
  Synthetic
DELDRVIEEAEELIRRIEEKLRRINETAKRLLDENLRHSERVHEEINRALERVRKKVEDAGLPKEVVETIKRLLEEVKKESEDLLRENKKLLDDVTKESKDLHDTVKELLKRVADELERLRRSGSDVKDVKDRLRRIIEELERRVRELKKRHEDILRELNRRSKELKDRHKKILEDLDRRVR

SEQ ID NO: 2161 - protein, 182 aa, Artificial Sequence; identical to SEQ ID NO: 2160
  Synthetic

SEQ ID NO: 2162 - protein, 182 aa, Artificial Sequence
  Synthetic
EEVERVIDEARRLLRENERHSEEVIEEITKLIRDVEEKVKRINDRAREALEDIREEVKRKGLPEEELKRIEELLDTVRRESEKMHETIKEKLKRVEDEVRKALKENRDLLKKLEDELRELRKTGKDVDELRKELERLIRDLNRLSKRIKEELKRRIEELEEEVKRLKEEHERIIEELRRRVK

SEQ ID NO: 2163 - protein, 182 aa, Artificial Sequence; identical to SEQ ID NO: 2162
  Synthetic

SEQ ID NO: 2164 - protein, 177 aa, Artificial Sequence
  Synthetic
EEVERAKKELEDRIREWEEDSKRLKDELKRIIKEWEDESRRVKEELRKIIDDLRKAVEKGISEETLRKIEREIEEILRKIEKKDRDILKRVEEIIEEIERRDRKILRELEKVLDELKKAGIDERILEEARRLVRRVHESSKRVLDDARRKLKELHERSKRVLDDVRRKLKKVADDTR

SEQ ID NO: 2165 - protein, 177 aa, Artificial Sequence; identical to SEQ ID NO: 2164
  Synthetic

SEQ ID NO: 2166 - protein, 177 aa, Artificial Sequence
  Synthetic
SEVERIKEELKRIIEDWDRRSRRLKEELKKEIKDWEEDSRRLKRELEEELKKLKEKVERGISEDELRELLRTVEKKIEEIERRDRRIKEEVEKKIEEAERRDEKIKREVEERLKELERRGVDKKIIDEARRLLEELHRKSREVAKEIRKEVKRLHDTSKKVLEDIRRAVKKVADDVK

SEQ ID NO: 2167 - protein, 177 aa, Artificial Sequence; identical to SEQ ID NO: 2166
  Synthetic

SEQ ID NO: 2168 - protein, 177 aa, Artificial Sequence
  Synthetic
SEVEKIKRDLEEIIRRWEEDIKRVKKRLDEEIRRWEEESKKVKKKLEDLIRRLEKEVADGRSEEDLKRLLKKLREELEKIERDDRRIAERVKRRLDEIRRRDEDIKKKLEDRLRELRERGVDEKILEDARREAERLHKTSKDVLKKVEDLLRRVNEHSRRVLEEAERRIRDVAEKTR

SEQ ID NO: 2169 - protein, 177 aa, Artificial Sequence; identical to SEQ ID NO: 2168
  Synthetic

SEQ ID NO: 2170 - protein, 177 aa, Artificial Sequence
  Synthetic
SEVEDIKRRLEKIIEDWRRKSKELEKRLEDIIDEWDKRSRKLKEDLKRIIEEARKAVDDGIDREEVKELKKRLEDEIEKIRETDREIEKRVDEAIREAEERDKEIAERVKDTLEKLRKAGVDEKVIKEAEDLLRELNESSRRVAKKAKDDLRELNERSRRALKEIRELLREVRERVE

SEQ ID NO: 2171 - protein, 177 aa, Artificial Sequence; identical to SEQ ID NO: 2170
  Synthetic

SEQ ID NO: 2172 - protein, 177 aa, Artificial Sequence
  Synthetic
REVEKIITDLEEVIRRVEEYLKRSDEELEKELRRVKRYLDKSDKDLRDEIRRVKEELDKRGGSEDVTRRLKELLRESEEHSERLKRRLDKLLKDSRDHSEELRERLRRLLEEARRRLKEVDKDELRARVEDVVRRAEDELRRHSELNKRLVDEARKLLEDHSRRNEELMRELRKLVE

SEQ ID NO: 2173 - protein, 177 aa, Artificial Sequence; identical to SEQ ID NO: 2172
  Synthetic

SEQ ID NO: 2174 - protein, 177 aa, Artificial Sequence
  Synthetic
SELEDILRKLEKRMTDVERYLDESNKDLERAVRRVVETLKRIDDEIRRLLEEVERDLDRKGGNEDLKRKLRELLKRLEEHSERLKRRADELLERSREHSERLKEKLRRLLEEVRRRLDEVDKDELETRLREITKTAEDELRKHSRTNEDIVRELKELVDEHEKELRKVVREAEDESR

SEQ ID NO: 2175 - protein, 177 aa, Artificial Sequence; identical to SEQ ID NO: 2174
  Synthetic

SEQ ID NO: 2176 - protein, 177 aa, Artificial Sequence
  Synthetic
SELEEILKDLERMIREVEDYLRKSNERLEDVLRKVKKKLDEINDELRRVVEEVKKKLEDKGGKRELTEKIDRLLDDARRHSEELKKELDDLLRESRKHSEDLKRELRRLLDEVRRLLSQVDAEELKRRLEEIVKRARDLLKEHSDDNERLVERAERLVEEHRDKVRKIVEELEEEVR

SEQ ID NO: 2177 - protein, 177 aa, Artificial Sequence; identical to SEQ ID NO: 2176
  Synthetic

SEQ ID NO: 2178 - protein, 178 aa, Artificial Sequence
  Synthetic
SEIERILEEVERAVRESDERLKDIVRKDREVVKRVKELLDKILRKDEEAIKRVIEDLERRGSDETLIRKLKKHLDENRRKVEELKRRLDEHLRRNDETVKDLIRKNNKELEEVRRRLKDITDKDELKKEVDKWVKRARDIVKELEEHSRRSTDELRRTVEDLERHSEESVRRAEKTSE

SEQ ID NO: 2179 - protein, 178 aa, Artificial Sequence; identical to SEQ ID NO: 2178
  Synthetic

SEQ ID NO: 2180 - protein, 183 aa, Artificial Sequence
  Synthetic
SELEKILKKIEDALKKVEEDLDRILEEDRKTLEEVKERLERDNEDLKRVVERVEEELKRRGRRRSELDKIRKELRDRLRDASKTHEDIKDELEKIHREVEDTIRRLKEELRDLVRRLEEMVRRDIDKTDELRKDVDRLVKRLKKLVDDLRRKSKETADRLRELVKRSRELSRTLAEELRKKTE

SEQ ID NO: 2181 - protein, 183 aa, Artificial Sequence; identical to SEQ ID NO: 2180
  Synthetic

SEQ ID NO: 2182 - protein, 178 aa, Artificial Sequence
  Synthetic
SEDEEAKKRVEDLVRELKKSNDELRRKSEESLRRLKELNDELRKRVRDLEDRLRKLVEDNVDKKDLKKTLDDIRKRLEELERRLKEEHKDLEDRTRELKKRHEDLLKRIKEELKRLADEGKISERIIEELDKELKKSSEETDEIVKRDEDVLRRSDEESRRIIKKLEDVLRRADERVK

SEQ ID NO: 2183 - protein, 178 aa, Artificial Sequence; identical to SEQ ID NO: 2182
  Synthetic

SEQ ID NO: 2184 - protein, 177 aa, Artificial Sequence
  Synthetic
SKDEEAKKRVEELTRKLEETVREDKKRIEDLAEKLKKVVDKLRRDSERTRKKLEEVERKGVDDEVVRRLKEEVERINKESREELKKLTKEVEDIIRDSERKLRRLEEEVRKLIEDLRRRGVDERILRELEKVLREVKKKHKETLRTLEELLREVAKRAEDINEEDRKVLEDVVRKLT

SEQ ID NO: 2185 - protein, 177 aa, Artificial Sequence; identical to SEQ ID NO: 2184
  Synthetic

SEQ ID NO: 2186 - protein, 179 aa, Artificial Sequence
  Synthetic
SEVEEILEDIRRRMTRVEERLRKSNKELEDAIREVTKRLKKSLDDLKKIIEEVKDVADKKGIDDKVKEKLKRDLDKHRRESEELVKKLDKKLKDHKRDSKRVIDELKRKVEDLERIVRKGELDAEELRKMVEDLTKELEDLVEEDKERVKRWRDELEEIVKRDRDKVERWREEAEKIKK

SEQ ID NO: 2187 - protein, 179 aa, Artificial Sequence; identical to SEQ ID NO: 2186
  Synthetic

SEQ ID NO: 2188 - protein, 179 aa, Artificial Sequence
  Synthetic
SELEEILRDVERLVRKVKTDLDDSLRRLKEVIDDVERLLRESNEKLRRVIKDVEDLADKKGIDDKEKKKLREELKEHDDRSRELVKELRKELKEHADDTERLKKEIEELLERLERIVRRGDLSEEALKKLVEDLRKRLREVVEEDKEKVRRWTEKAKRIVEDDKRRVEEWERKLEETVR

SEQ ID NO: 2189 - protein, 179 aa, Artificial Sequence; identical to SEQ ID NO: 2188
  Synthetic

SEQ ID NO: 2190 - protein, 179 aa, Artificial Sequence
  Synthetic
DEVERVLDDVRRKLEKVRRDLRRIDEDLRRVVETVKRLLDESNKDLERAVRKVKDELDKKVRDKKELEKVKKELDEMLEEHKKRAEDLKRRLEELLRRHHEELKKMERKLREELKRLEDAQLPEEELRRVVKELKEDLERLVRELEETVREVKEELEKVVRDDEKLVEEWKKRLEERSR

SEQ ID NO: 2191 - protein, 179 aa, Artificial Sequence; identical to SEQ ID NO: 2190
  Synthetic

SEQ ID NO: 2192 - protein, 179 aa, Artificial Sequence
  Synthetic
EEVERVLDDIRRVVEEVKRRLDEIDKKLTEENERVKEELDRIDDRLRKLVEEVKRRLDEKVGDKEELERVKRELDERLKKHHEEIERLKRELDEINKEHHRRIEELKKDLERLLKELEDAQLPREELEKVVEDIKRKLEKAVRDLEKTVKENKDRNDDIVRRVKKTVDDAEERLRRAVK

SEQ ID NO: 2193 - protein, 179 aa, Artificial Sequence; identical to SEQ ID NO: 2192
  Synthetic

SEQ ID NO: 2194 - protein, 175 aa, Artificial Sequence
  Synthetic
KEVEDILRELRRAVEEHRRRSEELLRRMRKLVKDLEDRIREILERARRSVKEIKDRIEKDGPDKRMEDLLRKDNEDLKRLAEEIRKVLEKLRRDIERVKRKNETDLRKWEEDLRRLNIDEEVLKEVKKLLDEVRKRSKDIVDEVRKLLEEVLKEAERVLREWKKLNDEVEDRLRQ

SEQ ID NO: 2195 - protein, 175 aa, Artificial Sequence; identical to SEQ ID NO: 2194
  Synthetic

SEQ ID NO: 2196 - protein, 180 aa, Artificial Sequence
  Synthetic
SEVEEVLKEVRKLIEDWRANSERILRRIERAIRELRRKIREWLERSKKKIKRLEEVIDKEVDKKEELREKIKRVREDNERRLKRLEEEIEEVRKELEDALRDDTRKLKELEKRLEDVRRDGVIDEDVLREARKRVDELEKRSREVAKRARDLLKEVRDKIKEVADRSRDLLRKVEEAIEK

SEQ ID NO: 2197 - protein, 180 aa, Artificial Sequence; identical to SEQ ID NO: 2196
  Synthetic

SEQ ID NO: 2198 - protein, 184 aa, Artificial Sequence
  Synthetic
SAEEVDRRVEELLKELERRSEEVLETWKELNKKLNKDAKDVTDEVRELLKELAELIKRDGLPEEDVRRLLERVKRTIEELKKELEKLSEDDKRRLERVREENKRIAERLRETIERIREDIKRGRSEEVVRRLLEDLRRLIDEWRKRSKEVEEEVRKSIEDIKRRIEEILRRIRKLIEEIRRRIK

SEQ ID NO: 2199 - protein, 184 aa, Artificial Sequence; identical to SEQ ID NO: 2198
  Synthetic

SEQ ID NO: 2200 - protein, 174 aa, Artificial Sequence
  Synthetic
DEDERVKDLLRRVKKTVDELLEELKREVKKSREEAKRLLKELEDRLRRSRKEAEKLRSSTDEDRLREESDRDRRELEDVREKLKRVLREDNERLKEVEKKLRDILRRMEDTLRRANIPREVLEEAKKILDDARRAIEEIIREWEEVNKEVDDRIDRIVEEWRKVNDKVNKDLTT

SEQ ID NO: 2201 - protein, 174 aa, Artificial Sequence; identical to SEQ ID NO: 2200
  Synthetic

SEQ ID NO: 2202 - protein, 174 aa, Artificial Sequence
  Synthetic
SEEEKIVEDLRREVKRLAERVKELIETSKKLVEDSKRHVKDLARRLRDIIRKLKKDLRDKGPTEDLKRKVDKVLEEAAREIKKHLDKNKELLERDERVVRDVERRLRELLKKVEDRGVERRALEELEKVVREIRRELERVHEETRRVIEESNRELEEILREAKELLEEVKKEAE

SEQ ID NO: 2203 - protein, 174 aa, Artificial Sequence; identical to SEQ ID NO: 2202
  Synthetic

SEQ ID NO: 2204 - protein, 187 aa, Artificial Sequence
  Synthetic
RELEKALEEAKRLLDKVRKELKKIHEESRRLLKETRDETRRVLEEAERLLREIKKLIDRLREDRDETEVKRLEDALKRLKEKVEEDVRRNEEHNKKLEEDDEKLLRDLERTIDTLERRIKEKAKRDIREEDVRRLVEELRDLIRELERKVKEVVETSRRLAEKDKEDNKRILEELRRLIRELEEDVR

SEQ ID NO: 2205 - protein, 187 aa, Artificial Sequence; identical to SEQ ID NO: 2204
  Synthetic

SEQ ID NO: 2206 - protein, 182 aa, Artificial Sequence
  Synthetic
EEIERVEKLVEEVVRRAEDELRRSAEHVDRVVERAERLVERSREHSKDLMRRLEEVLRRGEPRREVLTEVKEELDRHREENKRLVEELRKIVEDHERDNRRLVKKMREDIKRVEDRVRRELKDEDKAREIIERLRDVLRKIEEALERISRKLKEVLRRVEKKLEEDSRTLTRVVEEAKKKLD

SEQ ID NO: 2207 - protein, 182 aa, Artificial Sequence; identical to SEQ ID NO: 2206
  Synthetic

SEQ ID NO: 2208 - protein, 182 aa, Artificial Sequence
  Synthetic
KEIEELDEEVRRLVEELKRLSDESRKHSKRLVEELKKLLEDSKRHSEELARRARKVLREGRERDKVLKELEELVKRHEEDNKRIVDELRKLIEDHRRKVEELTERVRRLLETLTRKVKDKLKRREDAERIIKKLEDVMKRAEETNRRDIKKLEDVLKDVEDKLREDSKRLREVLEEVKKRLE

SEQ ID NO: 2209 - protein, 182 aa, Artificial Sequence; identical to SEQ ID NO: 2208
  Synthetic

SEQ ID NO: 2210 - protein, 182 aa, Artificial Sequence
  Synthetic
SEVEEILRDIERASEESKKTLDRILKKIEDASRRSKELSDKSLKEIRDAMEEIKKELDKGPDDEKVKRIKERLEELLRRLEEHNRRLKEEDDRLLKELRDKVRELKERDKKLLKDLERMVRRDVRKSEELDRRVKELVRKSEEELKDLDREVKELVRRSEELLEDDKRLVKEVVDEARERRR

SEQ ID NO: 2211 - protein, 182 aa, Artificial Sequence; identical to SEQ ID NO: 2210
  Synthetic

SEQ ID NO: 2212 - protein, 178 aa, Artificial Sequence
  Synthetic
DELEDVKRRVDEIVRELERLNEKLRRDVEEIVKRLKELNKRLLEEVRRTAEELKTKNVDRDRAKEELDEVRRKLKEVFDRAKRVHDEVRKRLEELKRRSKEVLDRVREDLKRLEREIPETEELREILKELKRVLDESRKLSKEIEEELERVLRDSERATEEILRELEKIIEEVERKVR

SEQ ID NO: 2213 - protein, 178 aa, Artificial Sequence; identical to SEQ ID NO: 2212
  Synthetic

SEQ ID NO: 2214 - protein, 178 aa, Artificial Sequence
  Synthetic
DELEEVRKRVERIMEELKRHLEKIAKDSKKSVDELKKHLEDADRKSEESVRKLERDNVDRDEARKLLEDNEREVRKVERNVEERNKRNEDEMKKVEDDVRRLNDEVRRDLERLAREIPRTRELEDILRRLEEVSERHRRSIEEILRRNEEASRRHRESIRRILEKNRRVLERVERKVE

SEQ ID NO: 2215 - protein, 178 aa, Artificial Sequence; identical to SEQ ID NO: 2214
  Synthetic

SEQ ID NO: 2216 - protein, 177 aa, Artificial Sequence
  Synthetic
EEDERAKERVKRVVEENDKVNEDVEREVRKVVKENEDVLEEIKRTVDKIVEDLERLVREGVSEEIVKKVKKDVKDVLKELEKKLRALSRKNKELLDRMEEVTRDLSRRNKELLDELKARNVDERILKELEDANEKSKKRSREILERLREANERIEETARRILKKLEEVLEEVERRTT

SEQ ID NO: 2217 - protein, 177 aa, Artificial Sequence; identical to SEQ ID NO: 2216
  Synthetic

SEQ ID NO: 2218 - protein, 174 aa, Artificial Sequence
  Synthetic
KEREDVKREVEKSVEDLRRHVRDVEEKVRKIKKELEDHVRELKKRVEEIRRRLKDLADRNVDREVVRKELEKLERELREEEKDVKRKNDDIRRRLKEIEDDVDRKNKESEERLRRSDIDESVLEELKRANERHKREIERIRKELEDVSKEHEDRIRRVLEELERVLEEVKRRVD

SEQ ID NO: 2219 - protein, 174 aa, Artificial Sequence; identical to SEQ ID NO: 2218
  Synthetic

SEQ ID NO: 2220 - protein, 175 aa, Artificial Sequence
  Synthetic
SEEERAKEEVEKHKRRLEKLVRDAERSSTEHERKLREIVERVKRELDKHEEKLRDIERKGDLTEELKRELDESTKRFKEKIERLKREIRRSSDEHRKRIKEIEDELKESTKRIKERLKRLEEVIREVEKISREVTKLLRDNLKRVEEVTERVERTLDELLERVKEVTKEVKERLR

SEQ ID NO: 2221 - protein, 175 aa, Artificial Sequence; identical to SEQ ID NO: 2220
  Synthetic

SEQ ID NO: 2222 - protein, 175 aa, Artificial Sequence
  Synthetic
SERERAEELVRRHEDRLEKLVRELEESSDRHKKRLKRLVEEVRRLIEEHRRRLDEIKKEGEQTEELTKELEDSDRAVEETIRRIEEELKRSSDRHRRKVTEIKRELDKSTRDIEEELKTLEEVLRKVRTVSTEVKKRLDRNLEEVKKLTEDVTRKLRRLLEEVNKITRDVKREIK

SEQ ID NO: 2223 - protein, 175 aa, Artificial Sequence; identical to SEQ ID NO: 2222
  Synthetic

SEQ ID NO: 2224 - protein, 175 aa, Artificial Sequence
  Synthetic
SELDEVRERLKRIVDDLRRRSEEVNKRLEEILREITERLREVNERLADIIRKIREDRKDAEESLRRLTKILEDAHRRSREVIEDLKRTLEELERRSRELIRRLEEILEKIRKDLEEGRREEVLKKLVEELRKRVEDMARTHDRLVEELKRKADEIVRRHEELVKDLKRKLEEVKT

SEQ ID NO: 2225 - protein, 175 aa, Artificial Sequence; identical to SEQ ID NO: 2224
  Synthetic

SEQ ID NO: 2226 - protein, 173 aa, Artificial Sequence
  Synthetic
SEEEKAKELVKELRKEAKKIVDEMRKLVEDHAKLVEELVRDHKRLVDEHRRLIEELKDREEKERILEELRRSDEKLKEDSERAKRELDRSTKELRETAERAKRRLTKLLDEIRREGVSEDVLRELEEIVRDIRKKIDDVIRKLEDISRKARKDSDDVNKRLNELTDDVRRKLT

SEQ ID NO: 2227 - protein, 173 aa, Artificial Sequence; identical to SEQ ID NO: 2226
  Synthetic

SEQ ID NO: 2228 - protein, 173 aa, Artificial Sequence
  Synthetic
EEEERARDLVRRLEEIVRRLVKEHEDLVRRHKELVDKLVREHEKLLEDHRKLVEELKDRERKEEILEELRRSTEEIERRSEEAKKRLRESDERLKEMSKRAKEEIKRLLEEIKRRGVSEEILERARKIVERLKTESDRVNKRLNEITRELEKRSDEVNTEVRRITKKVTEELK

SEQ ID NO: 2229 - protein, 173 aa, Artificial Sequence; identical to SEQ ID NO: 2228
  Synthetic

SEQ ID NO: 2230 - protein, 173 aa, Artificial Sequence
  Synthetic
SEEERADKLVKELKKMAEDIKREMDKLVEELKRTIDELRKKHKELVDRHRRLVEELARREDSERIERELKESDDRIKEESDRAKRKLEKLLKDLTDRAREAKKRLRRLLEEIERDGVSEEVLKTLKEIVRKIEEEIDRVEKRLRELVKELKDDSDEVNKEVNKITRKVKEELR

SEQ ID NO: 2231 - protein, 173 aa, Artificial Sequence; identical to SEQ ID NO: 2230
  Synthetic

SEQ ID NO: 2232 - protein, 175 aa, Artificial Sequence
  Synthetic
RTEEEAERTVEDVARKVKEWREELEEVVKEVRERVKRWKEEMRKLDEDTKKKLDDASDIDEELLKRLITEIKKINEDSKKKDKELEKEIRRLLEELKRKDEKLAEEIKRIIEDLRRRGVPEEVIERIERILKDLHRDSERVLRELKRILDELHRESKESNERNKKLVEDAERRTK

SEQ ID NO: 2233 - protein, 175 aa, Artificial Sequence; identical to SEQ ID NO: 2232
  Synthetic

SEQ ID NO: 2234 - protein, 175 aa, Artificial Sequence
  Synthetic
DTEKDAKRTVDDVRRKIREWEERLKKIVEEVKELVRELVERAKRLDEETEREAREAKDIDDDTLRKLKEKVERENRKSRKELEEIERRIEKLLEDMTEEDKKLEKEIRDILRDLRRRGVPEEVIKELEDLLRRLHEESKRVLDTLRRILEELRDRVRRSNKRNEEIVKELEDRSR

SEQ ID NO: 2235 - protein, 175 aa, Artificial Sequence; identical to SEQ ID NO: 2234
  Synthetic

SEQ ID NO: 2236 - protein, 175 aa, Artificial Sequence
  Synthetic
SEEDKAREVLKRVRDEVEKWRKELERLDEESKKKVDDLVRELEELDKKTDEELRRMQDATSEVLKDLERKIKERNEESKRKLKRIAEDAERTNRESKKKDEKLAEDIERILERLKEEGVPEEILKKIRRILEKLHEDSRRSNETNRRILEELEKRVRESNKRNEDILREVKRKAK

SEQ ID NO: 2237 - protein, 175 aa, Artificial Sequence; identical to SEQ ID NO: 2236
  Synthetic

SEQ ID NO: 2238 - protein, 175 aa, Artificial Sequence
  Synthetic
KTEEKVERDVERVKRDVDELIRRAEEVVKRVEDEVRKWIKELKELDDETERLVREASTVSSEDVKRLEEEAREINRESKKKDDELAKEVRRLLEDLRRLLRELAEKIRKIIEDLRREGVPEEVIKRIKKILDDVRRAVKEVLDRIRRILEKVHEDSRRSNKRNKEILDKVREDTR

SEQ ID NO: 2239 - protein, 175 aa, Artificial Sequence; identical to SEQ ID NO: 2238
  Synthetic

SEQ ID NO: 2240 - protein, 175 aa, Artificial Sequence
  Synthetic
SDEERVKEELKRILDEARRLLEESDEKLKRILDELRERLKESDERLKRILDKVRKDGLPEEVLRRLEKLVREHHKRNRELLKRVEDYVKEHHDRNRRLLEDVEKKVRELEELIDRGDLSSEELEKEVRELKKRLKKLIDESDKNVKEAEKELRELLRRSEEHVKELKKDADRESK

SEQ ID NO: 2241 - protein, 175 aa, Artificial Sequence; identical to SEQ ID NO: 2240
  Synthetic

SEQ ID NO: 2242 - protein, 175 aa, Artificial Sequence
  Synthetic
DDERRVKEKLKRILDESRDMLRRSDERVERSVRTLEDALRRSDEKLERILKKAEDDGVPREELERVRRYVKRHHEENRRLLKETREYAERHHRENRRLLKEDEEKIRRWEEILDRGELDSKELDDAVKKNKKESKETVDRSEKNVKELHDRNEELLRRSEKNVDDAKRRLDDTSR

SEQ ID NO: 2243 - protein, 175 aa, Artificial Sequence; identical to SEQ ID NO: 2242
  Synthetic

SEQ ID NO: 2244 - protein, 175 aa, Artificial Sequence
  Synthetic
DDEERVKKALDEILDRSRRRLEESDEKLDRSLKTLKKLLEESDRDLERILEKAERDGVPREVLEELKKLVEKHKKDNRELLRATEERVKRHKDTNRRLLEEDRRKIETWKEIIDRGELSREELEEAVRRNDEESKKTVDDSRRHVDELHRRNEKLIEESKDHVRRLEEELRKKSK

SEQ ID NO: 2245 - protein, 175 aa, Artificial Sequence; identical to SEQ ID NO: 2244
  Synthetic

SEQ ID NO: 2246 - protein, 175 aa, Artificial Sequence
  Synthetic
DEKEELSERVERVIRTAEKLLDEIKRKLEEIHKKANEDLERSLRKLEKVVKEVRDAGVSEDVERRLKRLVDEHRKKLEDIVRRSREELRELEKTLRDIKDEVKKELDRLEEVLRRGELREDELREDVERVKRRLEELIERLRKKVDEVKERHERMLKRSEEHVKELKDEVTEEAK

SEQ ID NO: 2247 - protein, 175 aa, Artificial Sequence; identical to SEQ ID NO: 2246
  Synthetic

SEQ ID NO: 2248 - protein, 174 aa, Artificial Sequence
  Synthetic
SEKEELEKEVEDLERRHREELEKLNRKSKKIDEDLKRIIEELNKVSKKIKEDLEREIRKGQRKDDLRRRLEEMLRRNKKDLDEVRKELEELLRENKRLLDKVEEDSKRRHEELERRNIDDEVRKRVEDINREVKEMLERNLRHTEEVIKKADREIEKNERHTREVIREAEERLR

SEQ ID NO: 2249 - protein, 174 aa, Artificial Sequence; identical to SEQ ID NO: 2248
  Synthetic

SEQ ID NO: 2250 - protein, 175 aa, Artificial Sequence
  Synthetic
SEVEEVDKKLETSHRDIEKRIREVLRELEESSRKLKRDVDEVLKKLEESHRRIAESLKTADEKLRRLEETTRTLIERLKRLVERVKELSDELARRLEEVEKELRERSRRLKEELKRVTDSKRLEELVKEHKRTLEEVKRRLEELVKKHRKDLEDLVREAEELVERHKRKLDETEK

SEQ ID NO: 2251 - protein, 175 aa, Artificial Sequence; identical to SEQ ID NO: 2250
  Synthetic

SEQ ID NO: 2252 - protein, 175 aa, Artificial Sequence
  Synthetic
SEVEEVDKEVERILDEARKALKRVEERVRKSHEDIRREIKRVEEDLERSSREIREKLKDQDRKLEELEKESKTLKDDLDRIRKEVEKLTRDVEKRLRELMERIKDEIRRVKEKLKRVTDAEKLKKLVEELEKEIRRLVDELDKLVRKHEEELDRLRKRMDELVKEHKKRLDDTAK

SEQ ID NO: 2253 - protein, 175 aa, Artificial Sequence; identical to SEQ ID NO: 2252
  Synthetic

SEQ ID NO: 2254 - protein, 184 aa, Artificial Sequence
  Synthetic
DDEERAKKRVKEAEKEIKDLAKESRDIVEKHRKEVEDVVREMERIVRELAEEAKDVVRKVKDDRDDDKIRELLERLKRKVEEILREIRKLLDDLRRKSEEVVRTNKELTDRLRKKIKDILDELEKEDVRTEVKDRLRDVLKKAEEMSKEVEDRLRKSSEDLREEVERVEEELKRVLRKIEEDIR

SEQ ID NO: 2255 - protein, 184 aa, Artificial Sequence; identical to SEQ ID NO: 2254
  Synthetic

SEQ ID NO: 2256 - protein, 184 aa, Artificial Sequence
  Synthetic
DDRERAKKTVDKVKEDLTRLVRRSEDLVRRHTEKLERVVEELERIVKELEERLKKVVDDVKDRRDREEIERLLRTLDREVKEIKKRIRELLKKLHDDSRRVVKENKELTDRAADEARRIEKRLEDEDVREDVKRTLREILRELEEASREVEERLKESDDRIRERVREVDEKLDRVLEELRKKMT

SEQ ID NO: 2257 - protein, 184 aa, Artificial Sequence; identical to SEQ ID NO: 2256
  Synthetic

SEQ ID NO: 2258 - protein, 174 aa, Artificial Sequence
  Synthetic
DELEKVRKELKEILDKLKDVLEESRERTDRLLRKAEEDLRRSDEETERLVKELKDAGVSEEALRRLEELVKRHKEELKKLLEELRRLIEEARDVHRRLLERIDRLIKELEEMLRRGTDKDELKKLVEDLDREVRKIVEELKELNKRIEDELRRIVDEARRSNEKVKELIDRLRK

SEQ ID NO: 2259 - protein, 174 aa, Artificial Sequence; identical to SEQ ID NO: 2258
  Synthetic

SEQ ID NO: 2260 - protein, 174 aa, Artificial Sequence
  Synthetic
DEVETVEREADRILKEDEDVLRRSKKITEDILDTLREMLERSERRTEEILKRLEEDGVSEEVKREIRERIKELKDRHRRIEEDVKRLADEHRERLKELLKDTKRIIEDIRRKLREGTDKDELKKLVDELKERSKETERELKESNDRLRKKVEDIRRELKRLNDEAEEAVRRLRT

SEQ ID NO: 2261 - protein, 174 aa, Artificial Sequence; identical to SEQ ID NO: 2260
  Synthetic

SEQ ID NO: 2262 - protein, 181 aa, Artificial Sequence
  Synthetic
SLIERIEEEIRRVIERVRRLVREIEDSDRKAKEDLERVVREDEETLRRVEKKLKDLNVPEEVLKRLREELEKVLRDSKELLKRMTEESERHNKEVRDEVRRLEKKLEKLVEDVKRTASRPTSEEEVKKLLEKVKRTARELEKVAEDMLRSNRELVKELLRTLEKSLRDSERTAEKLERAEK

SEQ ID NO: 2263 - protein, 181 aa, Artificial Sequence; identical to SEQ ID NO: 2262
  Synthetic

SEQ ID NO: 2264 - protein, 175 aa, Artificial Sequence
  Synthetic
DKEKEISDRLKDVLRKVRDVIEKDKRTNEEARKRVEDLVRKDEETLKRVLEEVRKGGLDEDKLRKLETEVRRILEESEKLLRDIRDRLRRSLEEIERLLEELERELRKIDEEVKRKEIPLEDLLRKVEKLAREITERLKESNERSRDLVEKLKREVKKSLRKSERLMEKARETLR

SEQ ID NO: 2265 - protein, 175 aa, Artificial Sequence; identical to SEQ ID NO: 2264
  Synthetic

SEQ ID NO: 2266 - protein, 174 aa, Artificial Sequence
  Synthetic
SEREEVKRTLTKAEEEARRLIKRDRDTNTEILKEATERSERDKDKLRKILEEVKKAGLPKELLDEVRERVRRHEEENKKVLEEVKKLIEDSKRETEELERRVKTKVDKLRDEIDKEPPDKDILDRVRRLVEELRRMIEELNDKSRKLVERLRKLLEDLNRHLEELVKRLRDKAK

SEQ ID NO: 2267 - protein, 174 aa, Artificial Sequence; identical to SEQ ID NO: 2266
  Synthetic

SEQ ID NO: 2268 - protein, 174 aa, Artificial Sequence
  Synthetic
SAKEELEDRIRDIVRRVRELITEVKKKNREILKRVEKVIKEVKETNERIEEEVRRGGLPEKLLRDITRKLRDHNRKVEEVMKRLRDLSRKHEKEVEDVLRELEKKAKELRDRLRKIEDIDKARKEVEDLVRDAKRVIEELERSLDELVRTLDELVRRLKKSSEDLMRELRKTTE

SEQ ID NO: 2269 - protein, 174 aa, Artificial Sequence; identical to SEQ ID NO: 2268
  Synthetic

SEQ ID NO: 2270 - protein, 174 aa, Artificial Sequence
  Synthetic
DEKKEVEKRLKEIEDEVRKMIKEVKETNRRILKKARDLIKKVEDTNKRILEEVRRGGRPEELLRRIEEELRKHNRDVDKVRKDVEDEVRKHDREVEEVLDRARRKVEEVARRVKRIEDIKKLEDEVRKLKDELRRELERLKRSSTDLARRLEEIIRRLERSSEDLERRLRERER

SEQ ID NO: 2271 - protein, 174 aa, Artificial Sequence; identical to SEQ ID NO: 2270
  Synthetic

SEQ ID NO: 2272 - protein, 174 aa, Artificial Sequence
  Synthetic
DEKEEVRKRLTDILRELEDLSRENERSNRRILDRVRELIERVKKTNKDILEEVERGGLPKDLLREIRERLRKHDKRVEEVLEEAERKVRDHDRENRRVTKEARELLEEARRRVERIEDIDKLRREVEELVRDLRRLIEELSRSSEELVKELEKLLRELEESSKKLAEELRKAVE

SEQ ID NO: 2273 - protein, 174 aa, Artificial Sequence; identical to SEQ ID NO: 2272
  Synthetic

SEQ ID NO: 2274 - protein, 181 aa, Artificial Sequence
  Synthetic
SSKERIKEKVDRIEERIREVVKEVEEELRRSTEEARRMVREVKRRLEDSNRKIKKFIDEKPEDEDLRRKEREIEELTRDIERKLRRIEEEIEKLSERLKRELDKISKTVEDLARKLEEKIKRITDSEELKRLLEDLRRKIEELAKELKKLLEEHKRRVDDVVRRMEELLKRHEELVRRIAK

SEQ ID NO: 2275 - protein, 181 aa, Artificial Sequence; identical to SEQ ID NO: 2274
  Synthetic

SEQ ID NO: 2276 - protein, 177 aa, Artificial Sequence
  Synthetic
SEAEEAKKTVEEISERLREALRRSEEETERILRENEKASERHKTEIEKITKELEDKLGDDKRVREEIERLRRNVEKLNKENREAAEELKRRAKEVHDRVRKKLRELEDKVDKLRRKGKDRDKDELKKVLKEIEDTVRRIVKELEDLNTEAEKASRKSVKELEEHLKRVEERVREEAK

SEQ ID NO: 2277 - protein, 177 aa, Artificial Sequence; identical to SEQ ID NO: 2276
  Synthetic

SEQ ID NO: 2278 - protein, 180 aa, Artificial Sequence
  Synthetic
ELKERLEKLLKDWADDSKRMRDELARLLKEWEDRSRKAKRDLEKILEENDDKVKKLDKVDKREAVEKELKELDERNKEVLKKLEDDDRKILEDAEELIERIERRDRKILEEVERDLSRISDEKVLREVKESAKKISRHSEKVLDEARKELERISEHSRRVLDRVRRESKKIVEDLRERKR

SEQ ID NO: 2279 - protein, 180 aa, Artificial Sequence; identical to SEQ ID NO: 2278
  Synthetic

SEQ ID NO: 2280 - protein, 178 aa, Artificial Sequence
  Synthetic
DIERELEEIVRRIKELIRRHKKRLEELVRELEELLRRHREELKKLVKRAAELVEELRRRNSRDETTLRRMREKLDRIRREIEKSTKEVEDELDKLLKEVDTSHKELEDRVRELAKELERKNVDDTVKDMLRKLLEEVKEASDRAREKLTDILRKIKKISEEVKREIDDIRKKIEDTAK

SEQ ID NO: 2281 - protein, 178 aa, Artificial Sequence; identical to SEQ ID NO: 2280
  Synthetic

SEQ ID NO: 2282 - protein, 178 aa, Artificial Sequence
  Synthetic
SIEEEAARIVEELRREVEEWERTLREIVERLRRLVEEHKRRLDELVAELKRLVDELRKENSKDETSLREIKERLERLEKEIDESDERMERELRKLTEEVKERNERLRRKVEEVKKELDDKNVREDIRRKLKEILDELDTITEKLKKELERIKREMKEASRRVREKIDRIRKEIEEVAR

SEQ ID NO: 2283 - protein, 178 aa, Artificial Sequence; identical to SEQ ID NO: 2282
  Synthetic

SEQ ID NO: 2284 - protein, 179 aa, Artificial Sequence
  Synthetic
DEIRELLKRIRDVAKRIKDKADRLNEKSRRKVEKLVRDVEKINEDTKRLLDRLRDSDQDRKDLERDVRRVKEDIKRLNEELDDRVRRILRELEKENEDSKREVDEIAKRIKDLLREIKLPEDVLRELERLLKEIEDLVRELNKTNKKIVDKARKDVKDVHRTNERLLREIERVVREKLK

SEQ ID NO: 2285 - protein, 179 aa, Artificial Sequence; identical to SEQ ID NO: 2284
  Synthetic

SEQ ID NO: 2286 - protein, 179 aa, Artificial Sequence
  Synthetic
SEAEELLRRLEKIIEDLERNARALLEKLKEEIRRLDKNLRDLLRRIEKIMRDLTRSDVDRDELRKEVDRLRKEIKKYLDDHREEVRKIVEEIKKELDDHRRRSKEIVDRIKRLLDEINLDEEVLKEIKRVLEEAEKVSEDLLREIKEVLDRAEELSRRLLKTLEDLLRDIERSVKERED

SEQ ID NO: 2287 - protein, 179 aa, Artificial Sequence; identical to SEQ ID NO: 2286
  Synthetic

SEQ ID NO: 2288 - protein, 174 aa, Artificial Sequence
  Synthetic
SSKEKVEELVKEIEEEDRRVLEDTRRLLEEIMRRDEDVLRKTDERIKEIEKELRDRVRDEELLRELLRELKEVLRRHREESKRSLEKLKKVMEDHDDESRRTLEELKEALRELKRDKDSKEAEDRLRDLVRRSREIAKRSRDHLRDLLRESEERVRASLEHVERLVKKLRKDAN

SEQ ID NO: 2289 - protein, 174 aa, Artificial Sequence; identical to SEQ ID NO: 2288
  Synthetic

SEQ ID NO: 2290 - protein, 178 aa, Artificial Sequence
  Synthetic
SEAEDLLRRLEEEIRRIKKRHKEVLDELRKLIKEVEDRHKELLDRLREEIRELEERDVSREDLKRLVEELRERVKRMNRESEKLVRDLEERAKELHRESEELVTRLERVIEDLERRIKGDRVKEELRRIVKEVRDEIRKANEKIKRLLDEVRERSKDMNRRLKEIVDRVTESLRRKAE

SEQ ID NO: 2291 - protein, 178 aa, Artificial Sequence; identical to SEQ ID NO: 2290
  Synthetic

SEQ ID NO: 2292 - protein, 180 aa, Artificial Sequence
  Synthetic
SEVDEALERIKRLIEDLERHVREWLKELREIIEDLRERVRKLLEDLERRIKELEEKARRTGPDRELEELLERLRRKIEEDIKKLEEDLREIEKRVEETNRRHEKKSRDVKREIDELLKRLRSKAVEDLERLVEELRKLSEEASRRSRKILEELRETVERVIKRLKELLKKLKEVVDELRR

SEQ ID NO: 2293 - protein, 180 aa, Artificial Sequence; identical to SEQ ID NO: 2292
  Synthetic

SEQ ID NO: 2294 - protein, 180 aa, Artificial Sequence
  Synthetic
DRAEKVLEDIRKLIEEMRKHAEEWERRAREAVKELRKEVTDWRRRLRKLLEDLEEKVRREGNDERLERLAEELLKEVKKVNEETKRRVKELLDRLRKENEEHDRLSKKLLDEIREKLKSLRSEVVRRLEKLVEDLRKINEDVNRRSRELVETLRDDVRKVNEESKRILEEVKKILDDSKR

SEQ ID NO: 2295 - protein, 180 aa, Artificial Sequence; identical to SEQ ID NO: 2294
  Synthetic

SEQ ID NO: 2296 - protein, 181 aa, Artificial Sequence
  Synthetic
DLRRELRRVLEESKKHVKELVRELDEDLTRWERRVEELVKRLRDVLRKLEKEVDELEKKPTREEELREAVERLRRVIRELEERNKRTLDEADKRVKDLKRKLRKVVEDHRRRIKELEDRVEGDRVKEELRELVRESDKIAEEIIEKLDRDVKKVKKDHERIDEELKRKLKEVEERVERIRT

SEQ ID NO: 2297 - protein, 181 aa, Artificial Sequence; identical to SEQ ID NO: 2296
  Synthetic

SEQ ID NO: 2298 - protein, 184 aa, Artificial Sequence
  Synthetic
SEVEETLREIKEDIKRSKKEWDDLLKTIKELIEDSKRKWDKLLRDVEELIRELLERLRRDGPTEEIDRTVKKIIDDVEELLRKLEKDDRDADERIDRLVKELVERDKRSLDKLKERLDKLKDRVPDRAERDVERIIREAKKLTDKVREDVERLREEWERLVREVKERIKRLLEDLRRLVEETRR

SEQ ID NO: 2299 - protein, 184 aa, Artificial Sequence; identical to SEQ ID NO: 2298
  Synthetic

SEQ ID NO: 2300 - protein, 184 aa, Artificial Sequence
  Synthetic
DEAERLLEEAERIIEKSREEWERLLERIKRLIETLRKRYEDDLRESEKRIEELLRKARRDGPTEELRREVEKINRDNKESLERWNREVEEILRELKELVERLEERDRRLIEELKRRLERLRERVSDRVAREVERILRELKKLTDDMKKRAKELIDELKRLSEEMHRRIEKSNEDLKRLVDDVDR

SEQ ID NO: 2301 - protein, 184 aa, Artificial Sequence; identical to SEQ ID NO: 2300
  Synthetic

SEQ ID NO: 2302 - protein, 185 aa, Artificial Sequence
  Synthetic
DEAEDILRRIRELIERSKRKWDELLREIKKLIEESRREWEELLRRIREIIERLKRLAERDVDDKDRLKEEVKRIKEELKREVDRLEERNRELLERLKKEVEKLKREDDEIVKELEELLTRAKDRVDERVKEEMKRLIEDLKRVSEEVKRELDKLIEELKEVSERASKRLKELIDDLDRLVKEVEK

SEQ ID NO: 2303 - protein, 185 aa, Artificial Sequence; identical to SEQ ID NO: 2302
  Synthetic

SEQ ID NO: 2304 - protein, 178 aa, Artificial Sequence
  Synthetic
SEDEKAIEELKKEIERLRRLLEELRKHVRRLIEEIKRLVEESKRHVEELIREIDDLRRRDQREEEVKRSVEKIKEDLERHERDVKRRLDEIREALKRHEEDTKRVDDELRERIERLDRRLKGRKEVTDIIRELKEVLDEIKRTSEELLRTIEEIVRDAERKNRELLKELKKVLDEVEK

SEQ ID NO: 2305 - protein, 178 aa, Artificial Sequence; identical to SEQ ID NO: 2304
  Synthetic

SEQ ID NO: 2306 - protein, 178 aa, Artificial Sequence
  Synthetic
DEDEELIKRLRDRIREIRKLVEDSARNVKRLIDEDERLARRSLRHLEETLKEIERKAREDQSEDTVREAVERIKRDLERHRRESKRLLETSDKLLRDHEEEVKKLLERIKRVIEDLDRKLRGRDEVREVLKEIRELVKELKERNDELLTRWKESIKRVEEEDERILREIERRVEEVER

SEQ ID NO: 2307 - protein, 178 aa, Artificial Sequence; identical to SEQ ID NO: 2306
  Synthetic

SEQ ID NO: 2308 - protein, 177 aa, Artificial Sequence
  Synthetic
RAEEEVKRLLKEDNETLKRIEDDVRRLLRKNNESIREAEKTNRELVKRVEDIIRRARERGVDESVLADLRRVLKELKEESDKVLDELRKLNEKLREEVRELKRELDEENKELDREIKEGQPLEELLERIKELNERTKKKVADLRRVAKRLDEETERKVRETERRWRDVLDKVRKKVK

SEQ ID NO: 2309 - protein, 177 aa, Artificial Sequence; identical to SEQ ID NO: 2308
  Synthetic

SEQ ID NO: 2310 - protein, 178 aa, Artificial Sequence
  Synthetic
REVEEVLERLKELLREHEKHAKEVEDRLRELIRENKEHAREMLERLEKILDELKKIRDSEEVLRETLKRIDEEVRRLIRHHEELSKEVLKEIEDIIRHHRKESRRSEEEVREIEKRITDEEALRELRRLLDEIRRVNRKVEERIKEVLKKIDEDNKEVVRRLEEALEKIREVIERTAT

SEQ ID NO: 2311 - protein, 178 aa, Artificial Sequence; identical to SEQ ID NO: 2310
  Synthetic

SEQ ID NO: 2312 - protein, 176 aa, Artificial Sequence
  Synthetic
KAKEDVKRALDEWKEVNDRVNEELKKAIDTWREVNRKVKEDVDRLVKEIEELIRRVRENGADERLLEKLKRELEKLTEDVKRRLKEDNDRLEKLLTDLKRESDKDREELKELARRLDELRREDVKRELKRVIEETRERAKRLLEDLRRLIEETKKLAEELLARAKEIIDRIREAAR

SEQ ID NO: 2313 - protein, 176 aa, Artificial Sequence; identical to SEQ ID NO: 2312
  Synthetic

SEQ ID NO: 2314 - protein, 182 aa, Artificial Sequence
  Synthetic
RAEEELDRLSREVEKVSKKAREDLEEMRKALEDVSRRVKEKLRRILEEIKEAIKDVKRRTNGSSKKLKEIEDLLRKLEEDLRDLERRVEESHERLEREVRRLLKEVDESSKRLREEVKRLRDEPPSRELIREVEKLIEDHRRRLEEIVETVRRLVDEHRRRLERIVREAAKLVKDIKRELEK

SEQ ID NO: 2315 - protein, 182 aa, Artificial Sequence; identical to SEQ ID NO: 2314
  Synthetic

SEQ ID NO: 2316 - protein, 182 aa, Artificial Sequence
  Synthetic
SVKEKLRRISKELEKASRDDERENRRILKEARDVIREAADKIRRIEEELRKIIDRVRKETNGSEDELRRIEELMRRADTELRKLEKTIEDLLREVEERVKESLERSRRSSERLRELVRDLDEKPPSEEIIEEVKRLVDEHKKRLDENVKRLKELVDRLRETLERLVDRLRKLVETLKRESDR

SEQ ID NO: 2317 - protein, 182 aa, Artificial Sequence; identical to SEQ ID NO: 2316
  Synthetic

SEQ ID NO: 2318 - protein, 182 aa, Artificial Sequence
  Synthetic
KVEEDLKRIKKEIKDAADEDREKNREIMKRLNDVTREVEERLRKILEDLERLVRRVKEEVNGRKEELDRIEELLRRAREELEKLEEDVRRDNKELRERVRESLERSDELVRRLEDELRRLEEKPPSEELIKRVKELVREAKERLKDNVRRLEELVKEWKRKLKEIVDRVRELVKDLERRLKE

SEQ ID NO: 2319 - protein, 182 aa, Artificial Sequence; identical to SEQ ID NO: 2318
  Synthetic

SEQ ID NO: 2320 - protein, 175 aa, Artificial Sequence
  Synthetic
SEKEKIVKDVEELIREAEELVRRLLKRLKELNDESEKTARDLVRKNEETLKELKDVVDRRVKDKDTLRKRVKELHDESRDDLRKLDELNRRVERELEKLVEELKRTIEELKKRLEEAPRARELDELIKKLDEVLRRAEKEAEELIRDHRRISREVKERIKDLNRRIERILREAEK

SEQ ID NO: 2321 - protein, 175 aa, Artificial Sequence; identical to SEQ ID NO: 2320
  Synthetic

SEQ ID NO: 2322 - protein, 181 aa, Artificial Sequence
  Synthetic
SLEEIVKRVEEDIRRIIEELRRRIEEADRKIAEIIDRLRKTVEKVNKEIEDLIRELKKKEGDDRDVERKLRELEELLRRHTERVRDVERRLKKLLEDHHREVREILKRAEKLLRDLSEELRTITDDKRVRELVEEVKKKLRDLVEEVRESVKRLEDTLRRVEEEIRTTARELLRRLREELE

SEQ ID NO: 2323 - protein, 181 aa, Artificial Sequence; identical to SEQ ID NO: 2322
  Synthetic

SEQ ID NO: 2324 - protein, 181 aa, Artificial Sequence
  Synthetic
SLEEEVRETVKRLRKEVEDWLREVEKVLEDLLRELKKSIEETKKVAKELEDKLRDVKRRNVDEDEVRRLKEEAKRTIEELEKKNKELERKIEKIVRELREKDKELDKRVEDVLDELRKRLTDERIRRTLEKAREEVKRLSAETKRLIEEVKRRLDELLKRDNDIIDDARRRVKKVLDEIET

SEQ ID NO: 2325 - protein, 181 aa, Artificial Sequence; identical to SEQ ID NO: 2324
  Synthetic

SEQ ID NO: 2326 - protein, 181 aa, Artificial Sequence
  Synthetic
DLEEELRKVVEDLERKLRESIRETEEVMRRLEESVEESIRKTEEVVKRLREKLEDVKRRNVDEEVVKKLEREVKEVIDRLREENRRHHETVKEIIKELEEKNRRLKKEAEDVIRELEKRLKSDEIRDTVRKAKEDVERLLEEDNRRIKEVLDRVAKLNKRDNETIERAEEEARKVLREIEK

SEQ ID NO: 2327 - protein, 181 aa, Artificial Sequence; identical to SEQ ID NO: 2326
  Synthetic

SEQ ID NO: 2328 - protein, 181 aa, Artificial Sequence
  Synthetic
DIEEEIREEVERLRRTLKELADRIKKLVDELREKLRRWLEEVEEVLRRLIEDLRRVKEENVDEKVVDDLEKKVRKLVEELKEKDKRLNEEAKEVIRKVEEEIKRHHDEVKKRLDELRKRVKTEELEKRVREAEEEVRRVNKKLKDDLDKAREDLKEFSDRTRRMIKAVERDVKRVLDEIRR

SEQ ID NO: 2329 - protein, 181 aa, Artificial Sequence; identical to SEQ ID NO: 2328
  Synthetic

SEQ ID NO: 2330 - protein, 177 aa, Artificial Sequence
  Synthetic
SVEETIKRILEEVEELIREVKERNERIERRAERLIEEVKRSNDEIKKEVRTAIEKVIRKREDDRVRKVLRELEKAVEDHDREVEKVVEEVRRLSKKHLDEVERALEELRRRLKEIKDRPVDKEKVDKLVKDLRRVIEELRKSLEDLERRLDDILRRLKESSDELVRELRRLLKEMEK

SEQ ID NO: 2331 - protein, 177 aa, Artificial Sequence; identical to SEQ ID NO: 2330
  Synthetic

SEQ ID NO: 2332 - protein, 177 aa, Artificial Sequence
  Synthetic
SVEEALDEIEKKVEEMIREVKETNDRVRRKVKELSEKSKTENERVVREARELIREVEREREEEEVRRILEEVERLSKKHLDENRRLVEEIDKEVEDHNREVERVLEEARRRLDDIKKKPVDKKDVDDLDRDLEKKLRDLKDSSRKLVKRVEDLVRESEDTVRKLIERLERLIRETKR

SEQ ID NO: 2333 - protein, 177 aa, Artificial Sequence; identical to SEQ ID NO: 2332
  Synthetic

SEQ ID NO: 2334 - protein, 177 aa, Artificial Sequence
  Synthetic
KVEEELDKILKEVEDLVRRDEEEIKRILEEVKELIRKVKETNDKVEREMRKLVEEVKKREEREEVKKVEREAEKKVRDHKREVKRVLEELARELKELLDETRRLLKDIRREVEDIKRKPVDEDSVRELVKRLRERAEESKKRTKDLEDKIRTKIEELERSSKELTDELRTLIREAER

SEQ ID NO: 2335 - protein, 177 aa, Artificial Sequence; identical to SEQ ID NO: 2334
  Synthetic

SEQ ID NO: 2336 - protein, 184 aa, Artificial Sequence
  Synthetic
SVEEAIKEILRELEKVNEDSKRLSDRNLKELEKALRDAKKSVEEILRELEKALDEVRKNGLSEELERRVREVLERIKEKLDRLRKTIKEALDRSRKKTEELSRENERLLRDIRRRVEEVRKDDSREDVERILKEIKDEVDRVRKENERVNRESEDESRKLVEELKKVLRRLKEEVRRIVEELRT

SEQ ID NO: 2337 - protein, 184 aa, Artificial Sequence; identical to SEQ ID NO: 2336
  Synthetic

SEQ ID NO: 2338 - protein, 182 aa, Artificial Sequence
  Synthetic
EVEERLEEILRRLERAVEDWKRKNEKILKELRDVVRESKKRTREIEKKIEDAARDVLREVNTDKKKLEEIKRLLEEVRKEIEDLLRTNEKLLEDLERLSKDDERRVRELLKEVRERVDKLKKDKVSKEVVKELEKDVRRIVEELKDSLRRLKEKVEEVARTVKKLNEELDDSVREIVERLRK

SEQ ID NO: 2339 - protein, 182 aa, Artificial Sequence; identical to SEQ ID NO: 2338
  Synthetic

SEQ ID NO: 2340 - protein, 182 aa, Artificial Sequence
  Synthetic
NVEEELDRIRREAEKVVKESRELTREILERAREAVEKSEEDTRRILERLERVVKRVKKDVNDREEKLKRIEDIVRRVRESVKKLEEDNKKILRELEESIRRWLEAIEKILEDLRREIKKLKDDRVSEEVLDELRKKVKKLVDELRTEDRRLEEEVKKIVRDAEKRNKELEDEIRRLAEELEK

SEQ ID NO: 2341 - protein, 182 aa, Artificial Sequence; identical to SEQ ID NO: 2340
  Synthetic

SEQ ID NO: 2342 - protein, 176 aa, Artificial Sequence
  Synthetic
SETETAVKKLKKLVDDLKREVERLVERLRELVRENSEKSRELVKRSDDLVRELLEKVKRRDLREDELRKEAEDLRETDDDLLRDDERHVKELEERMREELKRLREEARKLEEDIRKGEVDSELVKTVEEELKKVLEEVDRLVRKILEDLRRSLEESKRLSEESKKKLEDVLDRARR

SEQ ID NO: 2343 - protein, 176 aa, Artificial Sequence; identical to SEQ ID NO: 2342
  Synthetic

SEQ ID NO: 2344 - protein, 176 aa, Artificial Sequence
  Synthetic
RELEEAVKKLKKKVEDNTRTSRKLVTDLEREVEELKKEVEEVVRKSKELVRELKKKVDRRDLDKRELRKEVKELEERDERLLEKLERAVEELERKIRELLERDRRHVDKLRKDIEDGEVDSELVERVKEELKRSLEESDKLVEDVRRKLKEVLDDIRRLSEESKRELRDVLREADK

SEQ ID NO: 2345 - protein, 176 aa, Artificial Sequence; identical to SEQ ID NO: 2344
  Synthetic

SEQ ID NO: 2346 - protein, 182 aa, Artificial Sequence
  Synthetic
ELEEIVKDARRRIKELIDEARRTSEEVVERIKELLKRAEEISREARKRLTELLEELKKTVKDEDTLRRLLTELERLIREHDRLSREVLERLKKLIEDHKRKSDELLERLKRLLEELEDMVRRRIDKKEELRKIVEDILRTIKKLLEELRDDARRLLEEIKRLLEELERHVRKLLKEIDERIK

SEQ ID NO: 2347 - protein, 182 aa, Artificial Sequence; identical to SEQ ID NO: 2346
  Synthetic

SEQ ID NO: 2348 - protein, 182 aa, Artificial Sequence
  Synthetic
ELEEIARKAKEDIERLVEEARRISEEVKRELTELVERLRRISEEVRKRIEDLADELRKKVEDKDTLKRLEEEIRELAERHERKSRELEKRLKELVDTHRKKSEDLLRELKRLVEELERVLRRDIKDKKTLKEKVEDILRRIRELLRELRENARELVKEIERLIRELEKDAKRILKKIEDAIR

SEQ ID NO: 2349 - protein, 182 aa, Artificial Sequence; identical to SEQ ID NO: 2348
  Synthetic

SEQ ID NO: 2350 - protein, 181 aa, Artificial Sequence
  Synthetic
SVEELVKEIEKRLDELVREIEKTNKKVEDDIRKMLEDIKRVHDKSNEDLEKLVKELREKLKDEKRLEEITRRVEKMKRDNNEVLKELEERVRRILEHHRRLSDRVREEAEDIRRRLRELLERGLDLKDIEKVARDILRRVKKILEENRKHAEKARRELEKLLRESKRLVDELLRRAEEEKR

SEQ ID NO: 2351 - protein, 181 aa, Artificial Sequence; identical to SEQ ID NO: 2350
  Synthetic

SEQ ID NO: 2352 - protein, 175 aa, Artificial Sequence
  Synthetic
SREDRARELVKRILDEHKKILEDVEELAKELLRRHEELLKTLRELMRRIEEDLKRLEDEDVDREKAKRRVDELRKTLKKVLDELHKESRRLLKTLEEVLRRIDKRSREIKEELEKGEIDSEILKTVTRLSEELNRRIREVVRKVEEDLEDLNRRLKKIADEIEERIKEILRRIEK

SEQ ID NO: 2353 - protein, 175 aa, Artificial Sequence; identical to SEQ ID NO: 2352
  Synthetic

SEQ ID NO: 2354 - protein, 177 aa, Artificial Sequence
  Synthetic
SIEDVVRRIREEDRRLHEEIRKVVDEIRKRLEDALRSHEERVREVLERIKKLLEELKRRGTDKRVEKEVEDIERRLKEVLEESRDIVRRLEEELKRTLDKIRRENEKSEDELKKLTDERLDEKDLRKKLREIEEKNERLLRELERLLEEIRRTLEDLNRKLDEEIKKLERRLKERDR

SEQ ID NO: 2355 - protein, 177 aa, Artificial Sequence; identical to SEQ ID NO: 2354
  Synthetic

SEQ ID NO: 2356 - protein, 184 aa, Artificial Sequence
  Synthetic
SLKELIDEVERRLREVNRRARELVEEVKERLRRVNEESRELLREIEERLEDVLRELEEGDLREEELRRLAEDIKRVKDEVKKLFDDHRDTNRRIEDDLRKKVEEHHERNRRIIEELKRLLDRGNGEEEIKELVKRARELVKRSKEHVDELMETAKRLVDESRKHAEELFRELKKLIEELREKIR

SEQ ID NO: 2357 - protein, 184 aa, Artificial Sequence; identical to SEQ ID NO: 2356
  Synthetic

SEQ ID NO: 2358 - protein, 176 aa, Artificial Sequence
  Synthetic
SEVEKLVEDLRREVKRHSEKVERLVKELRDDLERWKERLEEIMRRLEKLVRDLEELLRRGDLSEESIKRLIDDAERRLRELLKRIREEIEEHRKKSEDLRREAKETVDELRERIERMNLDEELVREVKERLERSRERVDKLLRDNHKRLKEVLDEAKKLIDRVRKLLRRVLEEAKK

SEQ ID NO: 2359 - protein, 176 aa, Artificial Sequence; identical to SEQ ID NO: 2358
  Synthetic

SEQ ID NO: 2360 - protein, 176 aa, Artificial Sequence
  Synthetic
SDVERLITELADSVRDHSRDVRRVVEELEKLLRDWERDIEDIVEKLDRLVRTLEELLRRGELSEDLIREVVKDIDRKLKKVAREIEKKIRDHERKSRKLLEDVEKTSRENREEIKKANAREDLVRTVEKLNTESLDEVRKLVKKNHEDLKRVLDKAKKLIEEVRKKLEEVLDEARK

SEQ ID NO: 2361 - protein, 176 aa, Artificial Sequence; identical to SEQ ID NO: 2360
  Synthetic

SEQ ID NO: 2362 - protein, 178 aa, Artificial Sequence
  Synthetic
TLEEILKEVAERVKKANEDSRRILEKVKRDVETVNRENEKILKKAAEDVKRVLDEARKRNVDEKLLRELERLLEELKKEVEKLNRRNEKLLRDLARRVRELDERNKELLDRLADLVRRGDLSEKELREMIEKLKRDNERMLRELERRIEELKRDNDRVNEESKRLVDELKRDAEEKLK

SEQ ID NO: 2363 - protein, 178 aa, Artificial Sequence; identical to SEQ ID NO: 2362
  Synthetic

SEQ ID NO: 2364 - protein, 178 aa, Artificial Sequence
  Synthetic
TLEEILREVEKRVKEANERNRKISEELADLVRRVNEENKKILEDVAEEVRRALERARRRNVDERVLKKIRDLLRKLAEEVKKLNERNKEELKRLEKRDKELNDRNKELLKRLKETVERGDLSEEELRRMIEELEKRNRDVDRESKKLAEELEKTNRDVNRKSRELVRRLRRKLEEELR

SEQ ID NO: 2365 - protein, 178 aa, Artificial Sequence; identical to SEQ ID NO: 2364
  Synthetic

SEQ ID NO: 2366 - protein, 178 aa, Artificial Sequence
  Synthetic
ELEDILREVRKRVEDVNRRNKEILERVAEEVRRLNEENKRILEEARKRVEKVLEDLKRRNVDERLLRELEELLERLARRVEELNRENKRDLDRLRETVKRLNDENRELLRRLAETVKRGDLSEEELRRAIKELKDRNEDVDRRTKELIKRLEDKNRELNRESRERVEELKKRAEELAR

SEQ ID NO: 2367 - protein, 178 aa, Artificial Sequence; identical to SEQ ID NO: 2366
  Synthetic

SEQ ID NO: 2368 - protein, 178 aa, Artificial Sequence
  Synthetic
DLEEILKDVKRRVEEANRRNEKILEEAKEKVDRVNRSNEKILEEVKETVKEVLRRAREENVDDRVLEDLKRLLRELEERVKELNRRNRELLKELADRVKKLNDDNRKLLEELADTVRRGDLSEEELKEMIRRLEETNRRVDKETRKLIEELERRNREVDRESERLIRELKKKAKDDLD

SEQ ID NO: 2369 - protein, 178 aa, Artificial Sequence; identical to SEQ ID NO: 2368
  Synthetic

SEQ ID NO: 2370 - protein, 178 aa, Artificial Sequence
  Synthetic
TLEDILREIAKVVKEANKRNKRILEKVARDVEEVNKENKKILDEVKRDVERVLREAEKRNVPEDVLRKLAELLKRLEDRVRELNEETKRLLEELADRVRELNERSKDLLRRLADIVRRGDLSEDELRRMLEELERTLREVDRESDELVKKLKRDAERVNEETRRLIKELKEIADRLLD

SEQ ID NO: 2371 - protein, 178 aa, Artificial Sequence; identical to SEQ ID NO: 2370
  Synthetic

SEQ ID NO: 2372 - protein, 184 aa, Artificial Sequence
  Synthetic
SIEELVREIEKTNEDMRREIERLSDENRRRLDKALEDIERRAREIKEKLERVMKRLREKGVSEEVEERLRRLEKELKEVLDRLREIIKELKDDNERLTKRIRDRSRETRERLKRFLDEARRDKDEKRVLDELRKLLEDSKDELRRLLEELRRHIKETDDTVRELLDRIRKIREELDDEVRRLEK

SEQ ID NO: 2373 - protein, 184 aa, Artificial Sequence; identical to SEQ ID NO: 2372
  Synthetic

SEQ ID NO: 2374 - protein, 174 aa, Artificial Sequence
  Synthetic
KEEEDARRALKRVEEEVRRNKEEMRKLLEDNEKRIRENKKRAEDSSRKVKKRIDELRRDGKRGEEVKRDLDRLRDEHRRETKKSEDELKRNNERLEEETKRSKEDIKRIKEDLDRRGLPEEVLREIEKILRDLERDHRRVLEEIRKRNDELRETHERVLRENEKILEKVERELR

SEQ ID NO: 2375 - protein, 174 aa, Artificial Sequence; identical to SEQ ID NO: 2374
  Synthetic

SEQ ID NO: 2376 - protein, 181 aa, Artificial Sequence
  Synthetic
SVDDKVRRRIREIKEELERVLTRSERESDDIKRELEEVLKRSEERTKKIKDDAERGGVSDELREKLERETKRAEDKHRKIREDLKRDEDRNRKRHKEIRDEARKDTERMKKKLKDLKDDKDDERVMRDLERELEKLERKVREIKRELEEHNARLREKVRRIDEDLKRDNKELEDTIREDTR

SEQ ID NO: 2377 - protein, 181 aa, Artificial Sequence; identical to SEQ ID NO: 2376
  Synthetic

SEQ ID NO: 2378 - protein, 182 aa, Artificial Sequence
  Synthetic
KEEEELEERIRRLEKLVEDYKRELDRSIKELEDEVDRARRELEKSIEEMKKKVKKAEDDGPVDEELKRRLEEDNERHKRDLDRRKEELEKKLRELRKRNEELRRRLEEELKRVEEELKEANLPDRVIRKIKKLLDEVRERLERINRTHRELLKEVEERLKKILKDITDANRRIEERLEEITR

SEQ ID NO: 2379 - protein, 182 aa, Artificial Sequence; identical to SEQ ID NO: 2378
  Synthetic

SEQ ID NO: 2380 - protein, 182 aa, Artificial Sequence
  Synthetic
SLKEELKRINDENKEELDRLREELKKLLKEVEEELRRAAEELERINRRIKEELDKVADRVDDEKIKRIEKRLKEEHDRHREELKRIKRELDELKKELEKVLKDIEKKNREREKELRDREETTTEEVAERLLEELREDVKRTKEKMKEMLDRVKKKIDDIKRKLEKLLRDNERRIEELKRDAD

SEQ ID NO: 2381 - protein, 182 aa, Artificial Sequence; identical to SEQ ID NO: 2380
  Synthetic

SEQ ID NO: 2382 - protein, 176 aa, Artificial Sequence
  Synthetic
SVEEKLKKALEESKRKSKRIKDDDERANREVKKRIEDIVRRLEEVLRKVLKDVTKDIKDKRELLKEIEDRIREIEERIRRLTEEMKRTHEENEKRTREDEKRNDEEHKRIEKKLAETGASEDEVTRDVKRLEDHNTRLEKKVKESVERLKEKLEELRKRVEKIERDLEKLLEDVRT

SEQ ID NO: 2383 - protein, 176 aa, Artificial Sequence; identical to SEQ ID NO: 2382
  Synthetic

SEQ ID NO: 2384 - protein, 179 aa, Artificial Sequence
  Synthetic
KAEDVLRRVKEEHERIRREIKRVIDDVRRKHKEILDRLREEIKRVEELLRKILEDVERDGKRDDRLRRLAEELKKRLDDVKRDVEEKEKENRRRLEKEEKRLEENFKRNEERLRRIEEEGPVREEVVKELEDNVKRNEEDAKRTVEKLRKNLEDNRREVEKIVRDLRRLVEKAREDVKR

SEQ ID NO: 2385 - protein, 179 aa, Artificial Sequence; identical to SEQ ID NO: 2384
  Synthetic

SEQ ID NO: 2386 - protein, 173 aa, Artificial Sequence
  Synthetic
DLKEILDEARKLIEDLRKKAEEILEESKRLLDDLKRKADEILTRYDELTKRLSTKVPRTRELEELERRSKEELDKLKRELEEEVERWKEENEKIRKRMEDLVRDLRRKLEEARRDQRLEELKKRLEELIREVEKDLRRIKKESEDRVEEIERRLRRIAEELDKDVRRVEEEAK

SEQ ID NO: 2387 - protein, 173 aa, Artificial Sequence; identical to SEQ ID NO: 2386
  Synthetic

SEQ ID NO: 2388 - protein, 181 aa, Artificial Sequence
  Synthetic
SKEETVARRVDEIARELEEKNKKWEDDSRKAVDELRRKLEEWEKRSRDLREKVKDLLRKLKDQDDKERLKEEVRRVLEEWRRELKKLREEVKRTAEKWRRELKKLEDDSRRKLEEVKRELEELDVSEELKKKVEKLLEDHRKKSEELLRKDEKLIRDMEREVERLLREDEKVIEDVERATK

SEQ ID NO: 2389 - protein, 181 aa, Artificial Sequence; identical to SEQ ID NO: 2388
  Synthetic

SEQ ID NO: 2390 - protein, 181 aa, Artificial Sequence
  Synthetic
SKEETVERDVERIVRRLRELNKEWKKRSEEVKREVDESDKRTAEAVKKLVRDLEETLKDLKDRDDRETAKEEVDRRIKKIEDDLRRLLDEHRKLLEEWRERLKKLLDDSRRELEKVKEELERLDVSEEIKKKLEKLLKEHEDLSRKLLKEDEEEIDRHRRKVREWAEDLRKKLEEAERAST

SEQ ID NO: 2391 - protein, 181 aa, Artificial Sequence; identical to SEQ ID NO: 2390
  Synthetic

SEQ ID NO: 2392 - protein, 177 aa, Artificial Sequence
  Synthetic
SEKERAEEELKRIEDELREAIKRSEDRLRRIEKELRDREKRSEEELRRLEEELRRLAEERISEETVEKVARDIDEENKKHEDEVRKTEEKVKTENERHKKEVEDIARKVKRSIEELKRRNGDRKIIEDLKRLLREFERAVEESNERLRRLLEEFKEKVKESNKRSRELLRRMEEEVR

SEQ ID NO: 2393 - protein, 177 aa, Artificial Sequence; identical to SEQ ID NO: 2392
  Synthetic

SEQ ID NO: 2394 - protein, 175 aa, Artificial Sequence
  Synthetic
DDLERLEKEAREILERHKRALDELEKRLRRVLEKHEEDLRRLEETLRELLKKVRKDGLPEEVLRDVKRKLDKLKEDLKRSLDRLREELDRLRKELERSLRELKRDVERVKEELERNEKRREELEKEVRKLEKKSRDDIRRLEKELRELEKRSRDNIRELEKRVRRVARELDKTAK

SEQ ID NO: 2395 - protein, 175 aa, Artificial Sequence; identical to SEQ ID NO: 2394
  Synthetic

SEQ ID NO: 2396 - protein, 177 aa, Artificial Sequence
  Synthetic
DEKEEAEKALREIKKRIEDNVREVRRLNRELREKLRKLIEDYDRLLKELEKRVEDIVRKGRVDEKVKEDADRELEKNREELDRRRKEVDDRLRKHNRELEESMKEARRRLEEVDRRLDELGERDLRREEKKLRDELRDLHREHRKSIEDLDREIKKMEDELRRSIEENRKRVEELEK

SEQ ID NO: 2397 - protein, 177 aa, Artificial Sequence; identical to SEQ ID NO: 2396
  Synthetic

SEQ ID NO: 2398 - protein, 175 aa, Artificial Sequence
  Synthetic
REKERVKRVVRRVEEELKRNLEEVEEESRRDLRRLEENLERVEEAVRRILKRLDDSRIDSEELKRLKEEVREKLRRAKKDHDEYLKRNEEDLRRVRRKHEEIRERIKKKLRDVERENKPREELEKLIEKIERELKKTHDDSRREIERLRRETKKLHEKSEELIRELEKRLRDAER

SEQ ID NO: 2399 - protein, 175 aa, Artificial Sequence; identical to SEQ ID NO: 2398
  Synthetic

SEQ ID NO: 2400 - protein, 180 aa, Artificial Sequence
  Synthetic
SEVEEILDRIRRELERLAREARKTVERNKKELDRIREEVDRSLRRNKEELDRLRREKKDVDEEFLRRIEKELEDNKRELEREDRRLEEELKRNHEELEKEDRKIRKEIKDLEDEVEKKVRGEDARRAARELLKRLEDLLREHHDRLRKSDEEIRKLIEDHHRALEESNREIKELIDRMAK

SEQ ID NO: 2401 - protein, 180 aa, Artificial Sequence; identical to SEQ ID NO: 2400
  Synthetic

SEQ ID NO: 2402 - protein, 185 aa, Artificial Sequence
  Synthetic
DEAEKLIKDIEDKDEELKEKARELKEKLEERDERTKKLIEELKREADRTLEELKKKVEKAKTSDEKVLEELVREVEELLKRVKDLLDELVETVKRLNEESEEELRRLEERSRKVIEDLERRLSKLRSEVVKRVRDLLKRHEDLTREIKKEVKKMNEKNRELVRRVEETLKKLLEDLKRLLDESRK

SEQ ID NO: 2403 - protein, 185 aa, Artificial Sequence; identical to SEQ ID NO: 2402
  Synthetic

SEQ ID NO: 2404 - protein, 175 aa, Artificial Sequence
  Synthetic
SEEEEKVKDIERKLRKHNKEVKDTERENEKRLRELRRTVEEDRKDAERELERIKRVVERGEVDEETLKKILKDLRRKLEELRKRIEELKRRLERHHEEVERRLEESLRRLEDTLRKLEKSEELDRLEKELRESIRRAEELLKDSKRRADELIERIKDVLRKVKEKIEKLIEDTRR

SEQ ID NO: 2405 - protein, 175 aa, Artificial Sequence; identical to SEQ ID NO: 2404
  Synthetic

SEQ ID NO: 2406 - protein, 173 aa, Artificial Sequence
  Synthetic
SEKEVVEELKKTVDDLKRKSEEAIKKAKEAVDKIRRDSERAIRKNEDTLRKIEEEIKRNRSEEALKKIEDTLRELSKEHKEIIERIKKALDDLKRESEEIVKRLEDALRELAKSETDEDILREIAKRIKDLIEDHKRASKEIERDIRKILEDHKRAAEKIRRDLRRLLEDVER

SEQ ID NO: 2407 - protein, 173 aa, Artificial Sequence; identical to SEQ ID NO: 2406
  Synthetic

SEQ ID NO: 2408 - protein, 179 aa, Artificial Sequence
  Synthetic
SLEKMVTDIIRKLEEIARRHKTRSDEIVRRLEEIIKTHEKRSKELMDDLKRLVDEVRKKKDKAEEVKEKLRESLKRLAEESRKVVEDLKRTIERIKKESTETLKRIKDVVRRIREEARDKEPKEEDIRRLDEEVKDLERRSREEEERLEREVRELEKRSEETIRRVEKKVRDLADELRK

SEQ ID NO: 2409 - protein, 179 aa, Artificial Sequence; identical to SEQ ID NO: 2408
  Synthetic

SEQ ID NO: 2410 - protein, 174 aa, Artificial Sequence
  Synthetic
SEEDVVKKVRKKLEDVHRDTRREIRRLEEETKKLHDETRKTIETIERRLRDLRDRLTKEPKDKRVEEKVKKIAEDIERILRKLRRDHEDYLRRNEEVLKRLEDKHRKITEELDRGELDSEEVRDVKEKLKRNLEEARKASREDLERLKRNLEKADEDVRRLLEELKRLLDEVRR

SEQ ID NO: 2411 - protein, 174 aa, Artificial Sequence; identical to SEQ ID NO: 2410
  Synthetic

SEQ ID NO: 2412 - protein, 183 aa, Artificial Sequence
  Synthetic
SLEEAIEDLRRKLEKLLKDYADLSKEIEDKLRKIHEDSRRLVEKLEEEARRILKEVRERGKDEERVKKEERDIREELKKLEKTIEDSEREVEKEKRDSDEKLKRVEDDARKLLEDLRRSGEGREEEVRKEIEDADKRVKDLKRELERDIDELRKRVEELRRRHEEKIKKVAEDVKRREDEARK

SEQ ID NO: 2413 - protein, 183 aa, Artificial Sequence; identical to SEQ ID NO: 2412
  Synthetic

SEQ ID NO: 2414 - protein, 175 aa, Artificial Sequence
  Synthetic
SRLEKIKRELDKKLKDHEDDSRDKVRKLRESLKRHEDKSRKEEEEVKKTLKELEDKLRRDGPDKRVEEESRRHLEEVEKLLKELEDHSRRHREELKKRLDELRDHLRKLLEDLDRTDLEKRLVDDAKRKIKELEEENERLVKEVEDRNRELDERNKRIIDRIRRLNERVKEEAEK

SEQ ID NO: 2415 - protein, 175 aa, Artificial Sequence; identical to SEQ ID NO: 2414
  Synthetic

SEQ ID NO: 2416 - protein, 179 aa, Artificial Sequence
  Synthetic
DEVETVIERDKKLLEDWVDRARKVVKRDEDSLRRDEEENRRVVEENSRTVKELKERIRDERLVREVDTLARKLNRDIERTVEESRRLSEESKRLIEEVVKKVEKLSRDSVRILEAVKDGKEEVVKRVEEEVKRLNERADELLKRVEKRAEELNEESRRLSEEVERKVRELNREADERVK

SEQ ID NO: 2417 - protein, 179 aa, Artificial Sequence; identical to SEQ ID NO: 2416
  Synthetic

SEQ ID NO: 2418 - protein, 179 aa, Artificial Sequence
  Synthetic
SEVEEVVKRNSDTAKEDMDRNEKVVEDNSKRLREWEKAIEEVEKEVDKAMKDLKRRIRDEELVRRVEKLAKELKEIIKKVLDDIRKLIEELNRKIKDTVRRSKKEIDELNKILEEVRDGREKLVEDVRREVEKLNRESEERSKRVKEEVDDLNRKLEKLLRDVKEEVKKLLEEAERETK

SEQ ID NO: 2419 - protein, 179 aa, Artificial Sequence; identical to SEQ ID NO: 2418
  Synthetic

SEQ ID NO: 2420 - protein, 178 aa, Artificial Sequence
  Synthetic
DEVRKVVEDNERSVREIKEELKRVVEEDKELVDRWRERLEKVVKDNERSAKKIKDDVTKEEVKKLVEEVLRTSRKLAEELKKLIEEVHRTSRELIKRVDEEVDKVLEDSRRLAKELKDVDEMLRRIEETIRRLDEELRRLVEEVKRRIDELNREVEKRIREVEERIKEMDKRLREAVK

SEQ ID NO: 2421 - protein, 178 aa, Artificial Sequence; identical to SEQ ID NO: 2420
  Synthetic

SEQ ID NO: 2422 - protein, 178 aa, Artificial Sequence
  Synthetic
DEAEKVVEKDRRLIEKWKEDLKELVRRVREKVKEIKKRVADVVKENEDSVRRIEKEVTKEEVKRLVREVLERSRRLIEEVRRLVDEVLKTVEKLAKELVDKAEEVHRESRELIKDLKDVDEMLRRIDRRAERLNEDVARVIDEVAKRVTRLLERLEEKLKKIRDDIKKLDEELEEAAR

SEQ ID NO: 2423 - protein, 178 aa, Artificial Sequence; identical to SEQ ID NO: 2422
  Synthetic

SEQ ID NO: 2424 - protein, 178 aa, Artificial Sequence
  Synthetic
DEVRELVKENRRSVKENEEELKRILDEDERLIRDWKKKLEEVVRKVAELVREIEERVTKEEVKKLVREVLKTVKKLIDELRKLADEVHKRSNKLIEDNKRLTDEVLRRSEDLARKVKDSDELLRRVAETVKRMDEDLNRTTEEIADTIRRLNEEVAKRIREVERTVERLIEELEEAVR

SEQ ID NO: 2425 - protein, 178 aa, Artificial Sequence; identical to SEQ ID NO: 2424
  Synthetic

SEQ ID NO: 2426 - protein, 170 aa, Artificial Sequence
  Synthetic
DEEEELEKDARRVLEELRRELERVVREAKDINRRVEELIREVRERAKRVDDELRKRPRDDEVMKDVKREVERTIRDIERVLEDIERLSERSERLIKRVLDEVKRVVDDVLRKITNERVLREVERVLRELEREADEVLKEDRELLERWKKTVKDVVKENRDSLDELAKEMK

SEQ ID NO: 2427 - protein, 170 aa, Artificial Sequence; identical to SEQ ID NO: 2426
  Synthetic

SEQ ID NO: 2428 - protein, 170 aa, Artificial Sequence
  Synthetic
SEEERLREEAKEVLKRLREDLKRVEEDVERVDKRLRELNEDVARKLEEVLKRLREQPRDKDVADRVRREVEKILRESREVLKKSARDVDETIKKIETVLREIEKKVEEVVRKITNEKVLREVKRALDDLRRRVEEVLRKNEKSLRELEEENRRVLKKVEDLLEDIIRRLK

SEQ ID NO: 2429 - protein, 170 aa, Artificial Sequence; identical to SEQ ID NO: 2428
  Synthetic

SEQ ID NO: 2430 - protein, 175 aa, Artificial Sequence
  Synthetic
REEDEVRKELERVERRIEDLLREVERTNREVIETSERLTKTVEDDVRRVNTEIDRLLKEKKDDKERVVREVRELIRELNEKIKKTVEDSKRLADELAERNERVAREVRRLIEELKRRVGVEELLRELEEVLRRIEEKLKKIDDESKKLAKEDTDRNKRIVDENTRLVEEWDKRAK

SEQ ID NO: 2431 - protein, 175 aa, Artificial Sequence; identical to SEQ ID NO: 2430
  Synthetic

SEQ ID NO: 2432 - protein, 187 aa, Artificial Sequence
  Synthetic
SVLEEVRKKVERVIRESRELSERVREHIKRTIDEVKKLTEEVRKIVETLIRRLKELLDRVRRKELVEEVVRRARKVLKELEELAEKSIRDTRRLLDENRDILRKTIERSKRLLEEIEDVARKILKDVPDEEVRKILTDLRKAVDEDRRRNEKLLKDSEDAVRRDEKENRDILRELRKAIEEIERRLR

SEQ ID NO: 2433 - protein, 187 aa, Artificial Sequence; identical to SEQ ID NO: 2432
  Synthetic

SEQ ID NO: 2434 - protein, 187 aa, Artificial Sequence
  Synthetic
SMVDKVREEARKLIEEARRLSEEVKKIIDELTKRVKDLTRTSHELSKRLEDTIRELLKRVRRRELVEEVVRRLREMLKELEKTDRDSIRTTRDLLRRLEKIVRDTIRESRRVVKEAEDEIRRITKDVDDEKLREILKRLREELKRDEDRNRELLKRVRDRVKKDEEENRENTKRVREAVEKIERELE

SEQ ID NO: 2435 - protein, 187 aa, Artificial Sequence; identical to SEQ ID NO: 2434
  Synthetic

SEQ ID NO: 2436 - protein, 187 aa, Artificial Sequence
  Synthetic
DVLEEVRRRAEEVIREARELSKRSHDRSRELIERVKKLTEESHRLSRKLIRELEERLEKVRREEELEKVVRDAEKVLRDLKETDERSIRDTERVLRELEKTDRETIKRSRDLLEELERLARKILKDVPDEEVRRILKELRDEVKRDEERNRKNTKDVKDEVDKDRRTNEKNTEDAEREIRRIKEDAR

SEQ ID NO: 2437 - protein, 187 aa, Artificial Sequence; identical to SEQ ID NO: 2436
  Synthetic

SEQ ID NO: 2438 - protein, 187 aa, Artificial Sequence
  Synthetic
SVLEDVRRDVERLRREIEELSKRSHERSRRIIERLEELLKRSHDLSKRLRERLEELLKRVRREELVRRVVEEARRLLKELEKTDRDVVEEARRLVTELEDTDRRTIEESRRALKELEEEARKIRKDVPDEEVRRILKKLRDDVKKDEDDNRRNTEEVRKLAKDIERKLKKNTDDVRKDIKAIEDRLR

SEQ ID NO: 2439 - protein, 187 aa, Artificial Sequence; identical to SEQ ID NO: 2438
  Synthetic

SEQ ID NO: 2440 - protein, 187 aa, Artificial Sequence
  Synthetic
SVLEKVKELLDRLIRELEELVKTVEEIARRLITEVRELTERSHELSRRLIKELKRLLDDVRREEVLKDVVRRAEEVLERLRKTDEDSIRSTEDAVRRVAELAKRVLDKAEEVIRKVREDARKISKDVPDEEVRRILEEITRVLEEIATRLKRILDELRKAVDKDRKDNERNTEEVRKLIEEIKRRLK

SEQ ID NO: 2441 - protein, 187 aa, Artificial Sequence; identical to SEQ ID NO: 2440
  Synthetic

SEQ ID NO: 2442 - protein, 187 aa, Artificial Sequence
  Synthetic
SLLDEVRRKVKEVEDRLRKLVKDSHELSRRLIEEVERLTKTSHELSRRLIEELRELLKRTRTEELVKKVEEIVKELLRRLEETDKRSIERTEELLEELRETDRRVVEEAKRLVKEVEDEARRIKERVPDKDLRDILRKLREVLEEIERRLRKNTEDVKKVVDDDRKRNKDNTDEVRKAIREIEERLR

SEQ ID NO: 2443 - protein, 187 aa, Artificial Sequence; identical to SEQ ID NO: 2442
  Synthetic

SEQ ID NO: 2444 - protein, 181 aa, Artificial Sequence
  Synthetic
SEIERLLEEDTKRLRDWEEAIRKNLEDSEREAKKLKDRVKKLLDDARRDIDRLKKERKDDKDVIKLLDEVLDTVRRLAEDIKRVIEEVLKESRRLVEEVKKVIEEVNRRSKKLVEEIRREEREEILDEVRRRLKTLNDDVERLLREVHERSKKLRETVRKIVEEVEKRITELRDRVRRAAK

SEQ ID NO: 2445 - protein, 181 aa, Artificial Sequence; identical to SEQ ID NO: 2444
  Synthetic

SEQ ID NO: 2446 - protein, 181 aa, Artificial Sequence
  Synthetic
SDIDRLLEEDKKKLDDWRRAIEKNLEDSERRAREIKERLKKLLDEVRREAERLKEERKDDKDVLELIDRVVDTVRKLIEEVERVIDEVLRTSEKLVRDVKRAIDEVNERSKKLVEDARRDEKEDILREIAKRIEDLNKEVEDLLRTVHKESRRLDREVEEIVRRVKEEIDRLIREVREAAK

SEQ ID NO: 2447 - protein, 181 aa, Artificial Sequence; identical to SEQ ID NO: 2446
  Synthetic

SEQ ID NO: 2448 - protein, 181 aa, Artificial Sequence
  Synthetic
SEVDKLLEDDRKALEEWERRITKNLEDSKREIDDIRRRLRKNLEDSRRAIKEMKDRRREDEEVLRLLEEVLERSKRLVEEVEKLLEKVLRDSEKLVREVRRAIREVNKTSAELAKELKREEREEILKRIADEIKRLNDEVKKLLEEVHERSRRLIEELRRLLEEVHRRSRKLIREVEEAAR

SEQ ID NO: 2449 - protein, 181 aa, Artificial Sequence; identical to SEQ ID NO: 2448
  Synthetic

SEQ ID NO: 2450 - protein, 180 aa, Artificial Sequence
  Synthetic
SAEEEIEERLKRAIDRDEESVKRSAEEIKRLIEELKKSVDDSARELKELIERLKKLKKDGVDKSVIDKVVRELTRRVEELHERNRELLERVKETVERLHEENRRTSDEIEERVRELVREVDTKEIKDLLDRVKKEVERSKRKSAKLLKELEDAIKEIEDRSRELLERAREELKRVKDDKR

SEQ ID NO: 2451 - protein, 180 aa, Artificial Sequence; identical to SEQ ID NO: 2450
  Synthetic

SEQ ID NO: 2452 - protein, 180 aa, Artificial Sequence
  Synthetic
DETKRVRDLIRELIKRDEESVRRSARTLEELIRRLEESVKRSKKLVEDVIRKLKKLVKDGVDSDDIRKLVRDVERVVRKVVEENRRLVETVAREVERVHKENEDTSEEVRRTVKELVDEVRTEEAKKLLEDVEEAVERSKRKSRKLLEDARRALEKVKRDSDKLLEDVREEVERVLRTVK

SEQ ID NO: 2453 - protein, 180 aa, Artificial Sequence; identical to SEQ ID NO: 2452
  Synthetic

SEQ ID NO: 2454 - protein, 180 aa, Artificial Sequence
  Synthetic
DELEKIAEELDKLIRDDKKSVDESKRLLEDLIRRDRESVEESERELTELRRRLDELRRRGVDRDEIRKALEEVKRVVEKLVEENERSTEEVKRTVDRLHRENERTSEEVRRRVEELVREVDTREIKELLKRVRELVRESKERSRAVKERLKEEVKESERRSRELLERVRRDLEKIERDTR

SEQ ID NO: 2455 - protein, 180 aa, Artificial Sequence; identical to SEQ ID NO: 2454
  Synthetic

SEQ ID NO: 2456 - protein, 180 aa, Artificial Sequence
  Synthetic
SELERIKKELEELIERDKKSVKDTARRLEEMERRLRESVRKSEEDLRRMIEKLEKLVTDGVEEESIRRLIKEIIRTAKKLHDDNERLLKEVEEVVRKLVKDNEDTSKEIEDRVRELIREVKTDEARKLLEDVKRLVEESKRESKRLLDEVKKVIDRLRERSEKLLRDVERALREAEERTR

SEQ ID NO: 2457 - protein, 180 aa, Artificial Sequence; identical to SEQ ID NO: 2456
  Synthetic

SEQ ID NO: 2458 - protein, 180 aa, Artificial Sequence
  Synthetic
EEDERIRRDLEEAIRRDRKSVEDTREELRKMIEDDERSVRDSEEKLKELIKRLEELVREGRDSKDIEKALRDVEDTVRRLVRENEKSTEDIEKRVKELVEENKRTSEEIERRVEKLVDDVRTDEIRELLRRVRELVKKSKDDSRKLLEDVKRELERSKEESKRLLDEVKRAIDEIRERDK

SEQ ID NO: 2459 - protein, 180 aa, Artificial Sequence; identical to SEQ ID NO: 2458
  Synthetic

SEQ ID NO: 2460 - protein, 180 aa, Artificial Sequence
  Synthetic
SELERIEEELKKLIEDDKKSVDDTRKELDRAIEEDKRSVERSERDLRRMIKKLEDLVRRGRRDEDIRKLLEDVKREVKRLVDENEASTRTIKRRVEELDKRNRETSERIRKRVEELVREVKTDEIRKLLEEVKKLVEESKRTSEELLKEVDRRLRRSEDESRKLLEEAKKAVKRIEEETR

SEQ ID NO: 2461 - protein, 180 aa, Artificial Sequence; identical to SEQ ID NO: 2460
  Synthetic

SEQ ID NO: 2462 - protein, 180 aa, Artificial Sequence
  Synthetic
DELEEIKRRLKELIDRDRESVKRTEDELRELIKRLRKSVDDSRKEAERLIRELERLVKEGVDRRDIERLIREIKKRVKELNDENRRLAEEILRRVEKLDKENKETSEEIRKRVKRLVDEVRTDEIRELLERVERALRESKERSRKLLEDVRRAIEKVERDSEKLLKDVEEALERVKRERD

SEQ ID NO: 2463 - protein, 180 aa, Artificial Sequence; identical to SEQ ID NO: 2462
  Synthetic

SEQ ID NO: 2464 - protein, 180 aa, Artificial Sequence
  Synthetic
REEDEIRRELKELIERDERSVEETRKELEELIRELEELVKRVEDDLRRLIEKLEDLRRKGRDRREIERLLEEIEKRVTELVKEIEKLIEDIRRRVDELDKENRRTSEEIRKRVKELIDEVRSDEARKLLKEVEELLRRSKRKSEELLKRVEELLRKAREDIRRLLEEVKRVIDKVKKDTD

SEQ ID NO: 2465 - protein, 180 aa, Artificial Sequence; identical to SEQ ID NO: 2464
  Synthetic

SEQ ID NO: 2466 - protein, 179 aa, Artificial Sequence
  Synthetic
SDVERIIRENERKAKEIKDKVRKVIEDNERSVEEIKEKAERIVREVRKTLEEIRKRIRSELMRRLAELIREIEKRIEDVLRRIEKLHKDVSEAIRRVLKEIEDLHREVTEEVKRVRDANSKEMVERVERLIEEVARRSEELLRRIAKLVEDVNRESERLIREIKELAREVEKELKERAD

SEQ ID NO: 2467 - protein, 179 aa, Artificial Sequence; identical to SEQ ID NO: 2466
  Synthetic

SEQ ID NO: 2468 - protein, 179 aa, Artificial Sequence
  Synthetic
SEVDDIIRKNEELLKKIEDDARKILKENEERVEEIKERIKKLIEDDRRKLEEIKRRIRGELAERLRELSRTTVELLKEVLRRIETLHKKVTDDLKKVLEDIRRLHEEVTKELRRVKDANSEEALDRIRKLIEKVKRESEKLLEDIKRLIDKVDKDSERLLRTVKKLSEDVEKELKDTTK

SEQ ID NO: 2469 - protein, 179 aa, Artificial Sequence; identical to SEQ ID NO: 2468
  Synthetic

SEQ ID NO: 2470 - protein, 179 aa, Artificial Sequence
  Synthetic
SEVDEIIKDNERELDEVRREVEEIDKENKERLKEWVEEAREILDRLRKDLEEIRKRVRSRLVDELERLIREVEEVIRRVLERVRRLIEEVSKIITDVLREVERLHEEVTKELRKVEDANVREALDRLRRLIEKVVEDSRRLIKKVDELLKKVNKEIEDLVREVKDLVRRVKEELDRRVK

SEQ ID NO: 2471 - protein, 179 aa, Artificial Sequence; identical to SEQ ID NO: 2470
  Synthetic

SEQ ID NO: 2472 - protein, 179 aa, Artificial Sequence
  Synthetic
EEAERILKKDDDSVRKIKKEADRIVRENERLAEEIKKEVRKIIEDDKRTLEEIEKRIRSKLVEDLKRLSRETLEELRRVLEEAEKLHEEVTRLIRDVLRKIEELHRRTKKKLRDVRDANSEEMLRRVEEDLRRVNEESERLIRRIAKEVKRVTDESKKLLEEVKRISETVIEKMKEDAR

SEQ ID NO: 2473 - protein, 179 aa, Artificial Sequence; identical to SEQ ID NO: 2472
  Synthetic

SEQ ID NO: 2474 - protein, 179 aa, Artificial Sequence
  Synthetic
DEVEEILKRDEEALRDIEKKVREVDERNRREVEKIKEKVKEIIKRDKDELDEIRKRIRSEKARELEELSDRTLKTLKKVLDDIEREHREVSRDIKKVLEDIKRLHDETLKELTRVRDANSEEVLKRLEEEARRVNKTSKDLLKEVEDKIRKVNRKSEELLKKVEELSRRVIEEMRRRVK

SEQ ID NO: 2475 - protein, 179 aa, Artificial Sequence; identical to SEQ ID NO: 2474
  Synthetic

SEQ ID NO: 2476 - protein, 181 aa, Artificial Sequence
  Synthetic
RELEELIEDLRRALERSREEVTRLLKDLEDANRRSHRHNEELIKRLRKILKEARDRVKRDNVDERVVRRVERLVKESEKDNRRVLKESSDLVKKIVDELREVLKRSTELVERVVDLIRKLREEEALKDLRRVVEEVKKRSTDLNREVAKVIEEVKKRSEDLNRELEKLNRDIEERIDRETR

SEQ ID NO: 2477 - protein, 181 aa, Artificial Sequence; identical to SEQ ID NO: 2476
  Synthetic

SEQ ID NO: 2478 - protein, 175 aa, Artificial Sequence
  Synthetic
REEEEARKILERLEEELKRSLDEVRDLIEKATKESKDVNEKIRKLLEELKEELRKVVEDTGGNVEEIDKILKKVKKDLDDLLKESEDVARKVKKLLDELHEKNREMLERVRRELERVVKVEELVKDVERKLKRVAEESRKLVEDLRRRIKESREEIKRLVEDLERVLKEIKEEAK

SEQ ID NO: 2479 - protein, 175 aa, Artificial Sequence; identical to SEQ ID NO: 2478
  Synthetic

SEQ ID NO: 2480 - protein, 175 aa, Artificial Sequence
  Synthetic
REEEEALKRIRETSERIKRVVDDLHRRNKKSTDDIKRRVDELHKRNEKIVREVLDVIRRRGGEAEEVKELVERLRRSVEDSLREVTRLVEEDKRSVDESLDELRRLLKENRDLVERLVDSEVLRELDRRTKELKRRADELVTENRKLSKELEDEIRRLAERNRDAIRKIDKAVKE

SEQ ID NO: 2481 - protein, 175 aa, Artificial Sequence; identical to SEQ ID NO: 2480
  Synthetic

SEQ ID NO: 2482 - protein, 175 aa, Artificial Sequence
  Synthetic
DEEERALETIRDTSRRIEERIDDLRRRVEKIVRDIEETIRRLHEENRKIAERVKEVIERRGGKAEEVKKLVDELRRSVKKSLDDARKLVEDLKRVIDKVLEELRRLLEEDKRLVDELVDSEVLKELEDETRRVKERVDKIIKELEERVEDVERKVRELVKRNEELLKKIKDDADK

SEQ ID NO: 2483 - protein, 175 aa, Artificial Sequence; identical to SEQ ID NO: 2482
  Synthetic

SEQ ID NO: 2484 - protein, 175 aa, Artificial Sequence
  Synthetic
SREEDAVRKIRKLVEDVTRETKKMLEDVRRLVETVEKLTDDLLEEVRRLVEEVEDEIRRAGDVEERARELVEEIKRIIDEVRETSERLDREIEDLLRKVEKRARDLDRRIKEIIDREVDSELLREVEDLLRRHHETVRRILDEIRRLIERHHRRVREILKELDKLVKDAADEVRR

SEQ ID NO: 2485 - protein, 175 aa, Artificial Sequence; identical to SEQ ID NO: 2484
  Synthetic

SEQ ID NO: 2486 - protein, 188 aa, Artificial Sequence
  Synthetic
SEVERVEEEVKRLATEVEKSNRDSLREIEDLNRRDRDISRRVKEEIERLIREVKKLIDDRREEEAVREVEKVIREVLRRVTELIRRLRETVKEIRKRVEELIRRDEELVDRVLKEVRRLIEELRKRNDEKKVKELLERAKKIADELRKHIKRTLKKVEEEVEKNKRDNDKLLEEARELIKRLDDEVRR

SEQ ID NO: 2487 - protein, 188 aa, Artificial Sequence; identical to SEQ ID NO: 2486
  Synthetic

SEQ ID NO: 2488 - protein, 188 aa, Artificial Sequence
  Synthetic
DDLERVRKEIEDLNREDKRRSEEVRREVKKLIEDLEDSNRRSLEEVDRLVETVRELIDRERREEAVDKVRKVIEEVLRRVRELVERDERLVDEVLRRVKELIRELRETVKEILKRVEELIRRLEDRNDKEKVKRLLRTVRELMKKNKRDNDRLLKEAEDEARRVKRHIKESLKRIEEEIRRLKERLER

SEQ ID NO: 2489 - protein, 188 aa, Artificial Sequence; identical to SEQ ID NO: 2488
  Synthetic

SEQ ID NO: 2490 - protein, 188 aa, Artificial Sequence
  Synthetic
DELEKVAEDIKKLNKEDRDRSDEVRRAVKELVKEVEKKDKDIKRRAEELIREIKEDIERRREEEVVDRVREKIKKVLKEAEDLIRDSKRVIDEVLERVERLIRELEKTLEEILRRVRKLIRDLEEKNDREKVRKLLEDVEREARKNEEDNRKLLKDIREEIRRLADRSRKTLEDAKRLIEKIERDLEK

SEQ ID NO: 2491 - protein, 188 aa, Artificial Sequence; identical to SEQ ID NO: 2490
  Synthetic

SEQ ID NO: 2492 - protein, 172 aa, Artificial Sequence
  Synthetic
SEVEEVLKEIEEMLRDLERRVKESDEENRDSLRKIREDVERVDEENRDTLRRIKEKVKGELLKEVEELIRELSRELEKVLKEAEDAVRELSKDNRRVLEEIRKAVKRLLDLVREDGSEKVMKEVRDVIARLRDELEKVTEDSRRVNKELKKRLEDVVREIRRANEELDERVR

SEQ ID NO: 2493 - protein, 172 aa, Artificial Sequence; identical to SEQ ID NO: 2492
  Synthetic

SEQ ID NO: 2494 - protein, 172 aa, Artificial Sequence
  Synthetic
DEVEKVLEEIKRALDDLRKKVEESKREIKEALKRVEKHTRDSDTDNKRTLREIEERVKSKDLERVRKLVEELSEENERSLREVRRVAEELLEINERVLEEVERVVKRLLDLVRRRGEERVVEEVRRVLEELRRRLEKVTEDSRRAIERLEREDRRVSKKSKDVNKKLDDDVR

SEQ ID NO: 2495 - protein, 172 aa, Artificial Sequence; identical to SEQ ID NO: 2494
  Synthetic

SEQ ID NO: 2496 - protein, 178 aa, Artificial Sequence
  Synthetic
DSARKVEREVEEAARRVERTLEDVTRKVRELHDEVRRRLEEVKRRIEDLHRRVDEEPRGKELKEKLDEVHKRSEDMLREVEKIVRKVNTESKKLLDDVRRELEDVLRRVKELLRDVLSDKDTVKRVLDDVARIVKRIEEDIKRVLEESKKLVRDIEKEIRDVKKESRDLVREIREKIR

SEQ ID NO: 2497 - protein, 178 aa, Artificial Sequence; identical to SEQ ID NO: 2496
  Synthetic

SEQ ID NO: 2498 - protein, 178 aa, Artificial Sequence
  Synthetic
SSAEEVKRELEERHRDLRRTDEELRKDLDRVHDRARKILEEIEKKIRDMHRKVKERERGEDLERELDEVNKRSEELVTRAKEEVTRVNERSKRLVERSKEKVAEVNKRSETVLRDVLSDERKVKKVRDESNKVVEEIMRHSDKVLERSRRLVEEIRRRLEEVLRTSREVVRRIRDEVR

SEQ ID NO: 2499 - protein, 178 aa, Artificial Sequence; identical to SEQ ID NO: 2498
  Synthetic

SEQ ID NO: 2500 - protein, 172 aa, Artificial Sequence
  Synthetic
REVEEVLKEIEEMLKRIEDDVRRVLEEIKDVARRNEDEVRKLLRENEESVEEIKRRVSEELLRKVVTLSEDVVRKLAEVVKDTLRKIETVVKKVEKVVEKIRRDIKRVAKKVRKDSDRKVVEEVRKLLTDLKRLLEEVVKEVRKRLKELHDRTRTVAEEIRDINKKLKEEVN

SEQ ID NO: 2501 - protein, 172 aa, Artificial Sequence; identical to SEQ ID NO: 2500
  Synthetic

SEQ ID NO: 2502 - protein, 185 aa, Artificial Sequence
  Synthetic
SSVDEVRRTIEELIRRVEELVKRSKDHVDETERRVKELVRRSHELTKEVIERVEELLRRLKQRDVLEDILRRVKKLVDDVHESNRRVLEEVKRLVDENRESNKKVLEDVTRAVEELERLLRDKVSDEDKVRKLVEDLRRALEKIRREIEKSTEESDRVLRRIEEEIRRDSEELKRALREAEEEVR

SEQ ID NO: 2503 - protein, 185 aa, Artificial Sequence; identical to SEQ ID NO: 2502
  Synthetic

SEQ ID NO: 2504 - protein, 184 aa, Artificial Sequence
  Synthetic
SEVEELLKEVERLVREVEERVRRLHETDRKLLEDVKRKVEELHREDKKLADEVREAVKRRRDEEAVERIERLLREVEKHSDETVKEVKKLLDEVTKHVEDSNREAERLLREVRELVKEVLRRAGDNEDVERLRRELEKVAEKIRRLVEANRKTVEDARREIEKLLEENRRELDKVRRDVEREAK

SEQ ID NO: 2505 - protein, 184 aa, Artificial Sequence; identical to SEQ ID NO: 2504
  Synthetic

SEQ ID NO: 2506 - protein, 188 aa, Artificial Sequence
  Synthetic
KEVDDLLKEVRRLVREVEKELKRLHDENRKSSEEIARRLEELHKESKELVERVKETLRDLRKDSGDERVRREIRRLVKEVEDVVRRSIREAEELVERDERSVKRSIEEIRRLVKEVEDFVRDVIRKIRDEKVVRDLEREVREALRRLEEILRRDEDDVRRSREELKRIIDENREEVKRVLRELEETLR

SEQ ID NO: 2507 - protein, 188 aa, Artificial Sequence; identical to SEQ ID NO: 2506
  Synthetic

SEQ ID NO: 2508 - protein, 182 aa, Artificial Sequence
  Synthetic
SEVDELVERNERLVDEVRRRVEDVARKLEKVSRDSDDLVRRSNEELEDRLRKVEKRVREERDAKELVEKLIREVRKVLEESEKLVRDLIKKNEDVLREIEKEIRRLSKENEDVLREIERRIEDKKKLDEIRERSKRANDTLRKLLEDIRKRVEDSIRRLDELLKRSETRVRDIIKKLEDELR

SEQ ID NO: 2509 - protein, 182 aa, Artificial Sequence; identical to SEQ ID NO: 2508
  Synthetic

SEQ ID NO: 2510 - protein, 182 aa, Artificial Sequence
  Synthetic
DEVDELERRNERLAEDVRRKVREVEERLKELSKRSMDIVKDVLRRLKELVDRVEKKVREKRDDEELVRRLIKEVRRVLEEAKKVVKRLIEENRRVLEEIKEVVERLSRKNEEVLKRIRERISDEKKVEEIREKSERVNRDLEDKLRKIEEKVKESEKRLRDLLREIEERIKRAIEKLERDLK

SEQ ID NO: 2511 - protein, 182 aa, Artificial Sequence; identical to SEQ ID NO: 2510
  Synthetic

SEQ ID NO: 2512 - protein, 182 aa, Artificial Sequence
  Synthetic
SKVEELTERLRRLSKRSEEEVEKSNKDNDELVRRVLKRVKEVMRELEKLVEKVKEDVRRERDSRELVKKLIDEVRRVLEDARRVVKELSKENERVLRESEKLVRELIKENERVLKELEKRIDDKETLDRIRKEVEDSIERLKKLLDDSRRRSKEANDALRKLLKEIEDTIRRAIEELERARR

SEQ ID NO: 2513 - protein, 182 aa, Artificial Sequence; identical to SEQ ID NO: 2512
  Synthetic

SEQ ID NO: 2514 - protein, 182 aa, Artificial Sequence
  Synthetic
SRVEELTEENRRLAKRLKEVVKKVLDELRRRVEEVKERVERSNKKLRDLVREVDERVATKRDVKELVEKLLREIEKVLRESEKLVRDLIRDVRRVLEEVKKLVKEVSDRNREVLEDIKRRIDDEEIVRRIEEESKKVNRELEELLRKIEDDIRKAEEELRELVERSKREVDKALDDIDRRTR

SEQ ID NO: 2515 - protein, 182 aa, Artificial Sequence; identical to SEQ ID NO: 2514
  Synthetic

SEQ ID NO: 2516 - protein, 182 aa, Artificial Sequence
  Synthetic
KEVDDVKKELDDVDREVKELIKRAHDKNRKVVKEVEDELRRLTEDDKRVADKVRELLKKVRDKEEVVRRLLEEIERSLRKIEEDVKKLLEKIKRSLEESRELAKELLEKVARVLDKIKKTITDKDKMKEVEDEVRKVLDTIRKLLKRDEEAVKEALDKVKKMLDDARRHSEKVLREVEDTLR

SEQ ID NO: 2517 - protein, 182 aa, Artificial Sequence; identical to SEQ ID NO: 2516
  Synthetic

SEQ ID NO: 2518 - protein, 178 aa, Artificial Sequence
  Synthetic
SEVEELLKEVRELARRIEEEIKKLHRRNEELARRIKETIKRLIDENRKLAEDVRRDSGPDDRLRDLVRRVAEHVKESSDRIKELVDRVRRHVKKTSKEVDELLKKVERVVEEVLRRVGDGEDAKRIRDELERVRKSIEKLIRDNERFLEKVERDIRKLIEENEDLLRKIKEDVERKEK

SEQ ID NO: 2519 - protein, 178 aa, Artificial Sequence; identical to SEQ ID NO: 2518
  Synthetic

SEQ ID NO: 2520 - protein, 178 aa, Artificial Sequence
  Synthetic
DEVRELLETVRKLAEDVERRIRELIKENERLAREVERRIKELHDRNRELAREVEEKTGPDEELRRLLKEVEDHVRRTIREVEDLLRRVKKHVEDTTREIAKLLREVEEVVKDVLRKTGEGKEAREIERELEKVKDTIRRLLERNEELLEEIARRITKLLEEDKELLERIERRIAEKLK

SEQ ID NO: 2521 - protein, 178 aa, Artificial Sequence; identical to SEQ ID NO: 2520
  Synthetic

SEQ ID NO: 2522 - protein, 185 aa, Artificial Sequence
  Synthetic
SEVETLLRELKRLAEEVKKRIEELDRELKKLSDDVRREIERLIRENERLAREVLKEIRDLKGDKKRIEELLREVEKSVRETSKTIRDLLRRVEKVYEDVLRTIRELLERVRRVAEDVRRKIKERGKEEALREIEKLLRKVEEDVRRLIEKLKKSLEDSARDVDRLVKENERILEEVAREVEKLLR

SEQ ID NO: 2523 - protein, 185 aa, Artificial Sequence; identical to SEQ ID NO: 2522
  Synthetic

SEQ ID NO: 2524 - protein, 185 aa, Artificial Sequence
  Synthetic
KEVEDLLRDLKRIVDEVEKRIRKLIEDNKRLADEVRERIERLHKRNKDLAEEVLKRVRELKGDDKRIRELLKEVEDSSKESVERIEELLREVEESVKRSSREIERLLEEVARLAEDVIRKAEERGKKEVVKRIKEELDRVREEVKKLIKRNEELLKKVAEDVRRLLEKDKKALEEIKRRVEDELR

SEQ ID NO: 2525 - protein, 185 aa, Artificial Sequence; identical to SEQ ID NO: 2524
  Synthetic

SEQ ID NO: 2526 - protein, 181 aa, Artificial Sequence
  Synthetic
DELEELRKRVKENEDEVEKVLRELHKLNEENKEEVDRALEELRKRVRDIEEEIKKEPVDEELLRELERLVDELRRIVEKVIEDAKKLTEESNELNRRIIEESRRLSKELRKIVEDVSRVENRKDVVDKVRKVIEEVHKRSRDLAKEAREVNRRVHETTKKLVEDVRRVIEKVEEDVRRKVK

SEQ ID NO: 2527 - protein, 181 aa, Artificial Sequence; identical to SEQ ID NO: 2526
  Synthetic

SEQ ID NO: 2528 - protein, 181 aa, Artificial Sequence
  Synthetic
SSLEEADKKVDKNRRDVDRALEELHRRNKRNEEEIRKALKENRETNKRLLEEIRKNPVERELLEELEKLVRDSLRVSEEVIRDLERLTRESNRLNKEVIDESRKLSERLKDIVRTMSRVENREDAVRRVDKVIKEVHDESKRLVDELRDRNRRVHDETRRLDEESKKINRTVEELIRRKET

SEQ ID NO: 2529 - protein, 181 aa, Artificial Sequence; identical to SEQ ID NO: 2528
  Synthetic

SEQ ID NO: 2530 - protein, 181 aa, Artificial Sequence
  Synthetic
DKVEELLKRLEESTRRILKRVEELLRENERLAREVRKTVERLLEENRRLIEEVERRVRRDKKREAIEKLVRDVSRSADESSKRIKKLLDEVEESVRRSSKEIKRLLDEDRKLVEDVERRITDEKLRRELRRLLRESEKKIKEMLDRNKELLDEIERTIRELLKRNEDLLREVRERAKEADK

SEQ ID NO: 2531 - protein, 181 aa, Artificial Sequence; identical to SEQ ID NO: 2530
  Synthetic

SEQ ID NO: 2532 - protein, 181 aa, Artificial Sequence
  Synthetic
DEAEDLLRKLKRSTDEIKKTVEKLLRENEKTSRDIEREVRELLRRNKELAERVEEVARRENDKKKIEELLKEVERSARESSERIKKLLRDDEKSVKDSSDEIKRLLKEDKELVERVIRRITDEKVRRELERLLRESEKEIRKLLKRNKELLDESRDTIREMLERNKRLLEEVRKKIEKMKE

SEQ ID NO: 2533 - protein, 181 aa, Artificial Sequence; identical to SEQ ID NO: 2532
  Synthetic

SEQ ID NO: 2534 - protein, 181 aa, Artificial Sequence
  Synthetic
SEAERLLEELKRSTDEIKKRVEKLLEDNKRTSEEIEEEVRRLLETNRKLIEDVKRKVERDRDKDEIKRLLDEVKKSAEDSSRRIEELLKEDKKSADDSSEEIKRLLDEDRKLVEDVIRRITDERVRRELEKLLRDSERKIKEMLERNEKLARDSEERIRRMDDKNKDLLRRVKETIERKLK

SEQ ID NO: 2535 - protein, 181 aa, Artificial Sequence; identical to SEQ ID NO: 2534
  Synthetic

SEQ ID NO: 2536 - protein, 181 aa, Artificial Sequence
  Synthetic
DEVEDLLRKLEESTRRILERVKKLLEDNKRLIDRVRKEVERLLRDLKRLAKEIDEEVRRDNDKDRIRDLLREVERLVREVIKRIRKLLEEVKKSIEDSSREIKRLAEDDERLVREVIARVTDERVIRELEELLKESKKRIDDALRENEKLLREVKRRIEEAERTIKELLEEIKRKIAEEEK

SEQ ID NO: 2537 - protein, 181 aa, Artificial Sequence; identical to SEQ ID NO: 2536
  Synthetic

SEQ ID NO: 2538 - protein, 182 aa, Artificial Sequence
  Synthetic
KEAEELKRRLEDLVRRVEEDNRRLLEEHKKLVKDVRKRAKELLETHKKLVEDVTREVRKSTDSDVIRRLLEEIHRLVEEILREIEELLKRLHDLARRILERVRDTLRELEKLVRKILKDIKDLREVLEDLKRDLERARKINEESEKRIKDSDKRVHEEIRRVLEEVKKSDEEVRRRADRERE

SEQ ID NO: 2539 - protein, 182 aa, Artificial Sequence; identical to SEQ ID NO: 2538
  Synthetic

SEQ ID NO: 2540 - protein, 181 aa, Artificial Sequence
  Synthetic
REVDELRKELERIVKEVEDVIRDLNKKLKDILKDVKDKSDELNERLKKIVEDVRRLIRDVKGNRKDIRTVLERVKELVEETIRRDEELLDRVRKLVEETIRRIKRMLERVEELVKRVISRVRDKMVEELERLLDEARRRVEEAIRSNEELLKRIEEESERTVRSNEKLLKEAEEEVRRAEE

SEQ ID NO: 2541 - protein, 181 aa, Artificial Sequence; identical to SEQ ID NO: 2540
  Synthetic

SEQ ID NO: 2542 - protein, 181 aa, Artificial Sequence
  Synthetic
DEVEDVERDLKRILKEVKDRSDELIERNRKSTEDMKRRSKELNEELRRIIEDIRRLIRDTKGDKKKIEEALERVERLARRTIEEDKRVLEEDKRLVDRLLDTDRKLLKEVKDLVKEIIKRVRSKMVERLERLLEEAERTSRETLKRLEDTLRESEKRSRETVRSNEELVKEVTKEVEDAKK

SEQ ID NO: 2543 - protein, 181 aa, Artificial Sequence; identical to SEQ ID NO: 2542
  Synthetic

SEQ ID NO: 2544 - protein, 181 aa, Artificial Sequence
  Synthetic
DEVETVLRDNERTTKEAEDDVRRLNEELKEIIKRVREVSKRLIDELRRILEDVERRAREVKGDKDDIDRLLKEVEELVRRVIRTDEELLKRVEKLVRETIKKSKDVVKEDEKVVRRLISRIRSDFVERLRRTLEESKDKARRNVESNRELLERARKDSKRTLEELERLLETVRKSVDEMKK

SEQ ID NO: 2545 - protein, 181 aa, Artificial Sequence; identical to SEQ ID NO: 2544
  Synthetic

SEQ ID NO: 2546 - protein, 178 aa, Artificial Sequence
  Synthetic
EREERLEEKLKKSVDDSRELIERVLRKHEKVSDKVRRELERILEDHKRVLEEIKRVLKDRRKDKEVIRDLLRKIHEVATRLRERIKRLLEEVRRSVEEIKELVDRLNKHNERVIREVRRDSDVERLKDLLDKAHEEDRRAKEEVKRLLEDTTKKIKEFLDRVERSNEEVERELEKAER

SEQ ID NO: 2547 - protein, 178 aa, Artificial Sequence; identical to SEQ ID NO: 2546
  Synthetic

SEQ ID NO: 2548 - protein, 180 aa, Artificial Sequence
  Synthetic
DKDRKIKRIIEEVKKTIRKLLDDVRRINEEVLKELRKLLREVEEINKEILRRLKELVKTSKSDDVIRKARELIKRSREINKEVIDRLRKLVEDTRRINKTVIDEIKKLIDDVAEIIKDVTDEKVKKELDDEIRDAERELREAKKDMDRSNEELREEIKRAEERLRRLDEKLREEVEKDRK

SEQ ID NO: 2549 - protein, 180 aa, Artificial Sequence; identical to SEQ ID NO: 2548
  Synthetic

SEQ ID NO: 2550 - protein, 187 aa, Artificial Sequence
  Synthetic
SVKEEIKEMLKKIKRHSDEALKKNKETLDRDRKRVEDVIRELKKLLDEIRKRVEDVRRRVKDEDKLREIEDVLRRIEKRVTDLIREVRDSLRESEELSKRLLDKIKRSLDEAKRLVEELLEEVDRDDREEIARKVRELLERVLRDDRRVVREVEELNRRMHKKNEEVAKKVRDLLREVRKELEDVDR

SEQ ID NO: 2551 - protein, 187 aa, Artificial Sequence; identical to SEQ ID NO: 2550
  Synthetic

SEQ ID NO: 2552 - protein, 188 aa, Artificial Sequence
  Synthetic
REAEELLKELDEIIRRVEEEVKRLLDKVRETTKRIEEEIRKLDEDLKEIIREVEERIRKLKSDSGDERVRDKVRKLLRRLERVATESIRRIRELMKRDEDVIRRVLERVDELLKEIEKLIKEVRDRTDDEEVERRIKRLREKVKKKIDELKERVRRLLEESRRKAERVEESNRDLLRELKERLEERRR

SEQ ID NO: 2553 - protein, 188 aa, Artificial Sequence; identical to SEQ ID NO: 2552
  Synthetic

SEQ ID NO: 2554 - protein, 175 aa, Artificial Sequence
  Synthetic
SFEEEIKKIADEVEKRIRDAEKRSKDILEKSREVVERAKRRSEKLLRDAEREIKRVMEEKDDERIRRLLKELRDVVKRSKDLIDDLLRENKRVVDDSLRLIRELLRRLREVVRRLEEDGKDEMLRRLKKVTDDVRKRLEDSHRRLEKVTEESRKRADESHEELRKLIEEVREKLK

SEQ ID NO: 2555 - protein, 175 aa, Artificial Sequence; identical to SEQ ID NO: 2554
  Synthetic

SEQ ID NO: 2556 - protein, 175 aa, Artificial Sequence
  Synthetic
SSKERIEKILREVKREIEEAEKRSRDILKDSERIMRDVKRTTDDLLRKAEEIIREVAKRKDDDRVRDLLRRLRDVVRRSRELIKKLLKDNRKAVEDSKRLIKKLLDELRDMAEKLKKDGDEEVLKRLRELIDTVRRVLEESHKRLRELTKRSEEEARRVNEELRELIDRVRREAE

SEQ ID NO: 2557 - protein, 175 aa, Artificial Sequence; identical to SEQ ID NO: 2556
  Synthetic

SEQ ID NO: 2558 - protein, 175 aa, Artificial Sequence
  Synthetic
DVEKRIEELRERSDRIIDEARKRSEKLLRESEKMMRDVDKTTEDILREAEEEIKRVLDEKDDDRIRKLLEEIRKVIKESKDVIRKLLKENKEAVDTSRRLIEELLKRNREAIEKIRDKGEERVLKDLERLSKESEDELRRSHEELKRLTEESRETIEDVNRKIKEKIEDVKRKLK

SEQ ID NO: 2559 - protein, 175 aa, Artificial Sequence; identical to SEQ ID NO: 2558
  Synthetic

SEQ ID NO: 2560 - protein, 186 aa, Artificial Sequence
  Synthetic
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 2561 - protein, 186 aa, Artificial Sequence; identical to SEQ ID NO: 2560
  Synthetic

SEQ ID NO: 2562 - protein, 181 aa, Artificial Sequence
  Synthetic
SEVEEIVKEIEKLIKENEEVVREVEKEIRELIKRNREVVERIRKELEKMLRELERLAREGADRSLIRTLVREIEKEIERLAEEIRKTTEDINRRIEELLKRIKETTKEINDRIRELLKRIDRGEARERIKELVRRNERLLREVEKRLKTLSEENKKLLEDAKRELDRILKEVRDLLRETER

SEQ ID NO: 2563 - protein, 181 aa, Artificial Sequence; identical to SEQ ID NO: 2562
  Synthetic

SEQ ID NO: 2564 - protein, 181 aa, Artificial Sequence
  Synthetic
SRVERLSAEIKKLIDENRRVAEELLRELEKLLKDNEDVVREVERRIRDSSRKLEELARAGAPEEDIRRLVEESKELIKRLLRDIERTTREINEVIKRVVETIRRTTDEINRRIEELVRKIDRGEAREDMDRLVRENERLLKKVEDDLRKLSEENKRLVDRARERLARLLEENERLVDERRK

SEQ ID NO: 2565 - protein, 181 aa, Artificial Sequence; identical to SEQ ID NO: 2564
  Synthetic

SEQ ID NO: 2566 - protein, 172 aa, Artificial Sequence
  Synthetic
REAEEALKRVKEILKRIAEEVERVLTEVKKLSEDVKRRVEEVLTRLKRSTEEIERKKGPKEDLERLVKDDERTIKELLKEVEELIRRVDRLSEELLRKVEKLIRDLSKTLRDVGVDKKLVEDVDREIKKLLEEVTKKAKRLNDENKRLLDDVRDKARRVIEESREVLERARK

SEQ ID NO: 2567 - protein, 172 aa, Artificial Sequence; identical to SEQ ID NO: 2566
  Synthetic

SEQ ID NO: 2568 - protein, 176 aa, Artificial Sequence
  Synthetic
SSEEEVEKLERKVRAVIRKAEEDLEDSLRKSEKMAKEVTDEIEKSRRKAKAVIDDARRRNVDTDLVRELLRKLEETTRRVKKLVDELLEENRRTTERLKELVKRLLDELDEVVKEIARRGEEEVLKKVEELIRKVEKVIRTVLEEDRKVSEDSLRKMRKVLKEDEDVIKEVRDRAQ

SEQ ID NO: 2569 - protein, 176 aa, Artificial Sequence; identical to SEQ ID NO: 2568
  Synthetic

SEQ ID NO: 2570 - protein, 176 aa, Artificial Sequence
  Synthetic
SMKEEVDRLLKEVKDVIREVRERIKKSEEDVRRVIDDARRKLEELSKRAREVVEEVRRRNVDDEAVERLLRKVDRTSKELKKTVDELLKELERTTRRVKELVDRLLEKLRDVAEKLKKRGEEEVLKRVKELIDEVRERIEKVLTDDRRLIERVKREIERVIRENEKVIRDARERLR

SEQ ID NO: 2571 - protein, 176 aa, Artificial Sequence; identical to SEQ ID NO: 2570
  Synthetic

SEQ ID NO: 2572 - protein, 178 aa, Artificial Sequence
  Synthetic
DEVEKLLRDLEELDRDIERKVRELLKRNKEVLDDIEREVRRLEKELRRIIKEVADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 2573 - protein, 178 aa, Artificial Sequence; identical to SEQ ID NO: 2572
  Synthetic

SEQ ID NO: 2574 - protein, 187 aa, Artificial Sequence
  Synthetic
DVEDEARRLEKELRDILREIADDIRKLLEENKELLKESEKDIRRAEKAIEDILDDVRKRITDEKKLREIEKLAEDVKRRVRELLEEDRKSVEDTTRRIKELLREVKELVERVIKRVRELVDEVRKDKKEKLLTEVSEEVKRLADELRELARRVKEEVKKLLDDNRETTDRIRRTVTELLEELKRKTK

SEQ ID NO: 2575 - protein, 187 aa, Artificial Sequence; identical to SEQ ID NO: 2574
  Synthetic

SEQ ID NO: 2576 - protein, 187 aa, Artificial Sequence
  Synthetic
SVDETITEVIKRIEDTLRKVKEDADRLDERNKALLEDSKKKIKEVEEELRRILEEVRRKVKDEKKLREIEELVRRVIEEVRRLLDEDRKSVERSSRRIEELARRVEDLVRKVIETIRRLMAEVRREERRELVEEVKERAERLLKELEDLIKKVKEEVERLLEENRKTTEDILKRAKDLARELRKRTK

SEQ ID NO: 2577 - protein, 187 aa, Artificial Sequence; identical to SEQ ID NO: 2576
  Synthetic

SEQ ID NO: 2578 - protein, 187 aa, Artificial Sequence
  Synthetic
DAKESIEEVKKRLEKSLEDSERESRKTLEENKDLLRRSREEIKKALDRLKDLLRRAEERIDDKDKLEKVKRLVERVEEEVRRLMREDEKSLEDSLETDKKLLREDEEVVKRIIDTVEELLRRVEEEEREKLVEEVEREVERLLRENEKTSDEIKKTSEELLKRNEETTRRILEEVERLLKRVKEATD

SEQ ID NO: 2579 - protein, 187 aa, Artificial Sequence; identical to SEQ ID NO: 2578
  Synthetic

SEQ ID NO: 2580 - protein, 186 aa, Artificial Sequence
  Synthetic
KVEETATRLREEVKRSDTEVHRENRESEDRNKKSDEEVHKTIRDALKRVKDKLDDVRRRRKSRKLEEIERIVRDILRRIEELLRRLHKLAKESRDLVRKTLEELHKLAEDILRRIKELLDEVKDERRDEIVRRVKEEVERLLEEHRRLAKRVRDENRRSTEEHRDLVRKVKREIERLEEELDRAEK

SEQ ID NO: 2581 - protein, 186 aa, Artificial Sequence; identical to SEQ ID NO: 2580
  Synthetic

SEQ ID NO: 2582 - protein, 186 aa, Artificial Sequence
  Synthetic
KVEESADRARREVKRSDEEVRKRNTDSREEIKKSDKEVHERIRELLERIRRILDEVRKKRKSRDLDRIRRIVEEIERRIERLLEELHKLAEEILKRVEETLKRLHELARRILEEIKRLLKEVERENRDEIVRRVEDEIEKLLREHRELVKDVERENRRLLEEHKKLVEEVEREVRRMMKKLRDATK

SEQ ID NO: 2583 - protein, 186 aa, Artificial Sequence; identical to SEQ ID NO: 2582
  Synthetic

SEQ ID NO: 2584 - protein, 186 aa, Artificial Sequence
  Synthetic
KVEEEIEKLLRHNDELLKEVEKRAREVEERIKRSDEAVHDSIRKLLEDVKRILDEARRRRKGEELEKLEKIARDVLEEIKRLLRELHELAKRILEEVRRLLEEIEKSSRESKERIKRLLEELKRENRDEIVERVEREVRKLDDDDRRLAERVLRRAEELLKRHKELVERVEREVERLLKELEDAVK

SEQ ID NO: 2585 - protein, 186 aa, Artificial Sequence; identical to SEQ ID NO: 2584
  Synthetic

SEQ ID NO: 2586 - protein, 186 aa, Artificial Sequence
  Synthetic
KAEDEARRLERHNKELLKEVRKDNTRSEREIEESDKRAHDEIKRLEEEVEEILKDIERRRKSDKLRKIREIVERIRREIRRLLKELHELAKTIKDRVRDTLRKLDESSRRSLELIKRLLREVERENRDEIVERVRRTVKKLDEDDDKLVKDVRKENKDLLRRHEELVREVTERVKKLLRDLREASR

SEQ ID NO: 2587 - protein, 186 aa, Artificial Sequence; identical to SEQ ID NO: 2586
  Synthetic

SEQ ID NO: 2588 - protein, 183 aa, Artificial Sequence
  Synthetic
DVEDEVRRAEESNRDSDRKVHEEVRRVLKSNRDSDTKAHRDVEEAKRRLKTELKDIERKRKGRKLDDIRRVVEEIERRVDTLLERIHRVVEETLERIKRALEEVHDVVRKSLEDIRRLLEEVREKRLVDKVRTEIKRLNDEHRKVLKKVRDLVRKLNEDHERVVRDVRREIKRLRDELRETAR

SEQ ID NO: 2589 - protein, 183 aa, Artificial Sequence; identical to SEQ ID NO: 2588
  Synthetic

SEQ ID NO: 2590 - protein, 183 aa, Artificial Sequence
  Synthetic
DVEDEVRKMKKELDELLKRAEEEVKRVLESNEKSDDEVHKRAREAEEELRRLLDDVRRRRKSEKLRRIEEVAKRVLDLVRELLERVHKVVEDTKETIRRLLEEIREVVREIEERVRRLLEEIRDKKVVKDVEKKIRDLLTKLREVLRRVRREVKKLNERHEDILREVERLIEELRKRLEDTTK

SEQ ID NO: 2591 - protein, 183 aa, Artificial Sequence; identical to SEQ ID NO: 2590
  Synthetic

SEQ ID NO: 2592 - protein, 187 aa, Artificial Sequence
  Synthetic
DIEDEVREAIERLKKLLEDSEREVRESIKRLRDLLREIARESEEANERIKRLLEEIERKVKDEEKLERIREEVERLSETNRRVLEEAADLVRKLIRENEEALEDSKRLVDELIREIEDVLRKIRKDDKEDVRRRLRELVEKVMREIEDSNRKLRKLSKDSEKAVRDAERRNRKLVREIEDRIRKSLK

SEQ ID NO: 2593 - protein, 187 aa, Artificial Sequence; identical to SEQ ID NO: 2592
  Synthetic

SEQ ID NO: 2594 - protein, 187 aa, Artificial Sequence
  Synthetic
EVDKEVRKVLKDIERLLEEIERRVRKSIEDLKTELKKIEDESEKANRELERLLREIKDRVDDEKKLREIEELVRRLSDENRRVLDDARRLVKKLIEENAEALKKARDDVRKLLEEIKRVLERIREDDKEDVRRELRELVDKVRKDVERVMKALEDLSRESRREVRRVKEKNRRLVEEVKKRVEDKAK

SEQ ID NO: 2595 - protein, 187 aa, Artificial Sequence; identical to SEQ ID NO: 2594
  Synthetic

SEQ ID NO: 2596 - protein, 174 aa, Artificial Sequence
  Synthetic
SEDEDMVRDVKRLIDEVRKLIERVKREVEDLIRRLNELDERVVRTSEELARDVKRLVDAGLSREEVEKVVRESIERTRRLAKELDERNRDVLREVKRLVAEVEKVIRDVLKAVEEKLDSEDVERLKEEIKELLDRARRTIEELERRIRENVKRSRKKIEDLVRRHKKILDEARK

SEQ ID NO: 2597 - protein, 174 aa, Artificial Sequence; identical to SEQ ID NO: 2596
  Synthetic

SEQ ID NO: 2598 - protein, 174 aa, Artificial Sequence
  Synthetic
REKEEAVKTVKELIKEVREMVERLHRKNEEMIRTVREVVKELNERNKELIKTVRDLRRRGTDKEDLRRIIEEVLDHIRRSLEELERLAEEVLEHIKRTLEEIERLVREVLDVIKKLVDSEDARRLEREVRELLRDVREKVERNKEKVERLKREVRKRVRDDLERVKRLKEEVDT

SEQ ID NO: 2599 - protein, 174 aa, Artificial Sequence; identical to SEQ ID NO: 2598
  Synthetic

SEQ ID NO: 2600 - protein, 174 aa, Artificial Sequence
  Synthetic
SEDERAVREVEKLIKRVEEVVRRLNERNRRLIEEVRRIVEELHRRNEDLIRKVRELAERGVDKRDVERIVREVLKHIRDSLERLERLAREVLKHIRKTLEELTKLAREVLEAIRRLVDSREMERLEREVERLLREVERRVKEDEERVRKLLEEVERLVRRNARKVEELLKEVEK

SEQ ID NO: 2601 - protein, 174 aa, Artificial Sequence; identical to SEQ ID NO: 2600
  Synthetic

SEQ ID NO: 2602 - protein, 184 aa, Artificial Sequence
  Synthetic
SEKEKLTEDIERIIDKVRREVERLNEENERLIREVRKRVEKLNRENKEAIKRVEEEVRRLRDRDKSDVRKKVEEAIRKLERSVRESLKEVRRLIEELKRSVEETLREIERLAKELKDILDKVRTDGIDEELVKRLEEKIRELLKRARDLVKEDEDRIRKLLEEIERVNRDDKRKIDKLLEEVRR

SEQ ID NO: 2603 - protein, 184 aa, Artificial Sequence; identical to SEQ ID NO: 2602
  Synthetic

SEQ ID NO: 2604 - protein, 182 aa, Artificial Sequence
  Synthetic
KSDEEVRERVERLLREVRRLTREVRRHAKETLDTVAELVDRVRREAERLLREVEELLRRLTDKDVLEEIKKRLDEVLKKLEDIVREVLKEIKRLLDENRRISEETLRRLDDVLRKLEELARRLGVDETEVRDVKRKADEIKEEDKRILEEAEKRHKELLEDLKRLLDRIKEEVKRVREDIKT

SEQ ID NO: 2605 - protein, 182 aa, Artificial Sequence; identical to SEQ ID NO: 2604
  Synthetic

SEQ ID NO: 2606 - protein, 174 aa, Artificial Sequence
  Synthetic
REEDEARKRLKELLDRITKLSKEVRDLIREMLRELEESIERTKREIDDLLRRLEEIRRAGVDKKELKKVADDVLKRIEELLKEDKDVADRVLAVIEKLLRDLERLNRDILREVEEIIDSDEVERVKREIEEHLRRSEEDIRRVAEEIKKLVEESRRVIEEAKDRVRRLVERVKK

SEQ ID NO: 2607 - protein, 174 aa, Artificial Sequence; identical to SEQ ID NO: 2606
  Synthetic

SEQ ID NO: 2608 - protein, 174 aa, Artificial Sequence
  Synthetic
SEEDDARRKVEELLRRDKKVVDEVRDELRKLLEELRRLSEEVEKLIRKLEKELREVRKRGEDKDVLRKVVEDIKREVTRLLKELEEANREVEKRVKELLDRLRRTTEEILKEIRKIIKGETVKKVEDEVRDSLRRAKKIIEDAARAIRKHLEESKRRIEEARKRLEELLKEAED

SEQ ID NO: 2609 - protein, 174 aa, Artificial Sequence; identical to SEQ ID NO: 2608
  Synthetic

SEQ ID NO: 2610 - protein, 175 aa, Artificial Sequence
  Synthetic
SREEEAKKEVKRLLDELKKLSDDSRKRIRESHERLKRVIEEVRREAERSHEELERVIRRGEPREVIREVVRRSRELIKKLLKRLEDVARESKRLIEELLKRNKEMVDEIKKVIKDVVESEKDVRKVDRDVDEILKRSEDIIRKVKEDSERLLKEVRERIEEMKKRTDDLLKEAEK

SEQ ID NO: 2611 - protein, 175 aa, Artificial Sequence; identical to SEQ ID NO: 2610
  Synthetic

SEQ ID NO: 2612 - protein, 177 aa, Artificial Sequence
  Synthetic
RKEETLKRAEEKSKETLERNKRLLERIEEESRKTLEKNKDMLRRVKKRVEDLLREIKRDKPEAEEVRKRVEDLLREVKRSSERSLREDERLLREVKESSERSLKRDKDLLDRVKELIKEVPEEELRRVIEDVLRESEKLHREDEELARRVLEESERLHREDEELARRVEKEIRELKK

SEQ ID NO: 2613 - protein, 177 aa, Artificial Sequence; identical to SEQ ID NO: 2612
  Synthetic

SEQ ID NO: 2614 - protein, 172 aa, Artificial Sequence
  Synthetic
SLDELAKKAKEDSERSVRTDEKRLEEIARRIKELIKENEDLLREVKKEIDRLIEEIKDDRVLKEIERLLREVEKHVTRSSEEIKRLLKEVEDHSRESLREDEKLLEDVADMVKRVDEEEARKLLEDIKRRSEELHKRNDELAREVEKRIRKLIKENRELAEEVRRRIEELRR

SEQ ID NO: 2615 - protein, 172 aa, Artificial Sequence; identical to SEQ ID NO: 2614
  Synthetic

SEQ ID NO: 2616 - protein, 172 aa, Artificial Sequence
  Synthetic
RTDETVKKIEEDSRRSLEEDRKELEEVERRSRESIKENERLLREVAERIKRLIEEIDKREVLDEIRKLLREVEKHVRDSSREDEELLKRVKEHSERSLDEDRRLLEEVADLAKRVDEKTLKELADRIKERSEELHRRNEKLAREVLERSKELIKRNEELARRVIEEIKKLKK

SEQ ID NO: 2617 - protein, 172 aa, Artificial Sequence; identical to SEQ ID NO: 2616
  Synthetic

SEQ ID NO: 2618 - protein, 181 aa, Artificial Sequence
  Synthetic
DVEETLKTVEDESRKTIETLRRSLRKSEEESKRSIDRLRESLERSREEVERLLREIERDKPEAKDVVEKVRKLLEDVRREYERVLEDDRRLADDVRRVYEEVLERDKRLLDEVRKEAKRDTREEAVEKLKKLAEDVRRESEELRRELEELSKDVRRVSEELERRLRKLSEEVKKRIKDLKR

SEQ ID NO: 2619 - protein, 181 aa, Artificial Sequence; identical to SEQ ID NO: 2618
  Synthetic

SEQ ID NO: 2620 - protein, 181 aa, Artificial Sequence
  Synthetic
SVEKILRDVEDTSRRTIEELKRSLEESKKTVTKLLEENKDLLRRIKEDVRRRLEEIKRDKPEMKEVVERVERLLKEVEDSADRTTKEIKRLLEELEKVYREVLETDKKLLDEVRKVAEESTSEEAVERLKELAEEVKRVSKELLEELRKISEEIERRIRRLIEENKELADRVREEIERLKK

SEQ ID NO: 2621 - protein, 181 aa, Artificial Sequence; identical to SEQ ID NO: 2620
  Synthetic

SEQ ID NO: 2622 - protein, 179 aa, Artificial Sequence
  Synthetic
DKVDRVIEEARRILERLRKRVTDVVRELEEINRRLKREVDESVKEVDEILKKLEERVRKRKESERLLEDIKETLERVLRKNDDVVRKVEELVKRSDEKLNKVVEEIKRELDEVLKEIDRLEVRKELVEKLDREVKRLLKEARELSEENRRRSKKLLDELRKSSERIREKVEDLVRRIRK

SEQ ID NO: 2623 - protein, 179 aa, Artificial Sequence; identical to SEQ ID NO: 2622
  Synthetic

SEQ ID NO: 2624 - protein, 177 aa, Artificial Sequence
  Synthetic
SEEEAAKRRIDELLKRLKEVSDKVKEDIDELLKDLERRSREVVEEIKKLLEEVKDRVRKRREEEMLKRLEEELARVLREAERLIDEVDKLSEEVLRRVEELVREVSKLIKEVLERVRRDIDSERLKRVTEEAKRLHEENKKLLDDVRREARRLNEDNRRLLDEVRKRVEEVLRRIRK

SEQ ID NO: 2625 - protein, 177 aa, Artificial Sequence; identical to SEQ ID NO: 2624
  Synthetic

SEQ ID NO: 2626 - protein, 176 aa, Artificial Sequence
  Synthetic
DEDRRALEEVRRVLEEDKRVSKRSRDLIEKVLREVEELIKEVTKRAEDVLRRVREIIKTSGGRVEEVDKVIRELERTVDKLLRDMEEVIKEVEKLVRKVLRENRETTDRVREVVERIVKVRELVKKVEDEIKESEDESEDLIRRADEAVKRLRKRVRDVIEKARRDLEKIVTDAKK

SEQ ID NO: 2627 - protein, 176 aa, Artificial Sequence; identical to SEQ ID NO: 2626
  Synthetic

SEQ ID NO: 2628 - protein, 184 aa, Artificial Sequence
  Synthetic
SIEKLIEDVRREVERIEEESKKLVKKAREDVKRSHDHSKRLMEEATRRVRDILRRAEEMPKSEDELEELRRLVEEVEDRIRRLLKESADVDRDVKRLIDEALERNRKLVEDVRRRLDELKDRLRRKELVDDARRRVEELLRRLEDSLRKSERLVRELLKRSKEVDDRIREEVKRLLEELDDRRR

SEQ ID NO: 2629 - protein, 184 aa, Artificial Sequence; identical to SEQ ID NO: 2628
  Synthetic

SEQ ID NO: 2630 - protein, 178 aa, Artificial Sequence
  Synthetic
DTEEILKRIEEEIRRLLEENEKLLRDAEDTVRKSLEEHERILDEVTKRIRKMLEEIARTDRPGVEDVLREVRDLLRRVREVAKRVIDDNRRLLKEVRDSVKETSEEIKRLLDEVRDLMRKVDDETLKRLAEEVLREVERLLRENERLIREVERRADKTVKDLEKLIEEVERRIDELKK

SEQ ID NO: 2631 - protein, 178 aa, Artificial Sequence; identical to SEQ ID NO: 2630
  Synthetic

SEQ ID NO: 2632 - protein, 178 aa, Artificial Sequence
  Synthetic
DSKEIIDKVREDIKRADEENKRLLEEVRDRIRKLLEENETLLKDSERKARELLEELRRKDSPGVEEVLKRIRKLVEDDKESVDRSTKTIKKLLKEVEDSVRESSKEIERLLREVEDIVRKVPEEDLKRLAKEVKDRIRELLERNRELIKEVEKRVRRLLDENRKSSEEIRKEVEDRKR

SEQ ID NO: 2633 - protein, 178 aa, Artificial Sequence; identical to SEQ ID NO: 2632
  Synthetic

SEQ ID NO: 2634 - protein, 174 aa, Artificial Sequence
  Synthetic
SDEERALKLVEDVIRDVKRLNKRDRELIEKVERDIEKLLEDHRRLVDEVRRRVKELEDKVEDKEEVLKRIKDLLDEIHKLVEEILRRIKKLLEDIEESSRRSLEEIRRLLEELRRRIDSELLKEVEERIKKLLKSNKDLLREVEERVRRALERVKRSDEEVHKMARDALRRVRK

SEQ ID NO: 2635 - protein, 174 aa, Artificial Sequence; identical to SEQ ID NO: 2634
  Synthetic

SEQ ID NO: 2636 - protein, 174 aa, Artificial Sequence
  Synthetic
SEDEDAERLVEEVIRRVKELLDTHKRLVEEVERKIRELDKKDAELVKEVEKRAEDLRRKVDDKDDVLRKVEKLLRELEESSKRSLEEIKRLLEDIHRLVKEIEKRIKELLDELRRRIDSELLERAEREIRRLLREVKESDKEVHRRVRRMLEHNKDLLRRARDSIKKVLDEIRR

SEQ ID NO: 2637 - protein, 174 aa, Artificial Sequence; identical to SEQ ID NO: 2636
  Synthetic

SEQ ID NO: 2638 - protein, 174 aa, Artificial Sequence
  Synthetic
SEREDAERVIERVEREIRELNRRDEELIRRVEKEIRRMLEEHKTLVKEVTRELDRLRREVSDKEEVLRRIEELLRRIHELAKEILKRIKKLLKDLEESSKRSLEEIKRLLDEVRKRIDSEDLKRVDKKVRDVLRSNKELLDEARKRITKVLEEVRRSDEEVKRRAEKVLDEVRK

SEQ ID NO: 2639 - protein, 174 aa, Artificial Sequence; identical to SEQ ID NO: 2638
  Synthetic

SEQ ID NO: 2640 - protein, 174 aa, Artificial Sequence
  Synthetic
SEEEDAERAVREAAELAKKANKEDEELARRAAELAKKALREHEELVERAARLADEAEKKAEDKDTALKLIKEAADRAHKAARDALRVIEDAARKADKSSKESLDLIREAADDARKRADSERAKKAEDDARKAAEDNRRLAKRAKEEARRAAEEVKKSDKEAEERARRAAERVRR

SEQ ID NO: 2641 - protein, 174 aa, Artificial Sequence; identical to SEQ ID NO: 2640
  Synthetic

SEQ ID NO: 2642 - protein, 173 aa, Artificial Sequence
  Synthetic
SLERLLEEVTRRSEETVRTNEEILRRAADEVRKAIESNKDLLRKIKKEVDDVKRRLKDEKALRDIERALDEVRRLVEETIERIRRMLERVRKLAEETIEVDRRLLKKVEDLVRRGLPEESVRTIIEEVERTSREMNERLKKIIDEVRRTIEELNKDLKRILEEIRELVKRLET

SEQ ID NO: 2643 - protein, 173 aa, Artificial Sequence; identical to SEQ ID NO: 2642
  Synthetic

SEQ ID NO: 2644 - protein, 173 aa, Artificial Sequence
  Synthetic
SLEETLEEVDRKSKETVKRLKELLDRIRERVEEAIKSNEDILRRIKAEAEEAERRLKDEEMLKEIRRLAEEVEKLVRKTIEEIKKLLEDVKELVERVIRRDKEVLEEVRRLVEKGLDESEVERIIRELERVSRELMELLKKILEEVRKRIKELNDRLEEILRRVRKRIRELEQ

SEQ ID NO: 2645 - protein, 173 aa, Artificial Sequence; identical to SEQ ID NO: 2644
  Synthetic

SEQ ID NO: 2646 - protein, 173 aa, Artificial Sequence
  Synthetic
SLEELLERIKRDSDRTVRELEELLERAEEISRRTEKSNEDSLRRSTKEVKEAEDRLKDEDALKKIRDLLERDRKLVEDTIRDDRRVLDEVRRLAEEVIKRDKDVLETVSRLVERGLPEEVVKKMLDELRDRSEKLLRTLRDIIRRAKERSDDLNRKNKESTEKVREDIRRLEQ

SEQ ID NO: 2647 - protein, 173 aa, Artificial Sequence; identical to SEQ ID NO: 2646
  Synthetic

SEQ ID NO: 2648 - protein, 173 aa, Artificial Sequence
  Synthetic
KLEELLKRIAEESKKTVEELEKLLEEVERISKKTVEELEDSLRRSEEDAKEAEERLRDEDMLRKIREMVKRDAELVKKVIEEDKKVLDDVRRLAEEVIRADEDALRKVEKLVRDGLPEDDVRRILEEVRRLSEELKTRLRKILEDLRRLSEKLKRENEESTKTVRKVIEDLER

SEQ ID NO: 2649 - protein, 173 aa, Artificial Sequence; identical to SEQ ID NO: 2648
  Synthetic

SEQ ID NO: 2650 - protein, 173 aa, Artificial Sequence
  Synthetic
SLEELLKRIKERSEETVKRLEDLLKRVREDIDRAIKELKKSLDDSRKTVEDIEREIKDEDVLRRIRKLLEDDERLVREIIKEVKKLLKDVEELVKEVIERDKKLLEEVERLVRKGLPEEKVKEIAEEVRRRSEKMLEELKKLVDEVRKRLEDLRKRNEDSTEEMKKRVEEEKR

SEQ ID NO: 2651 - protein, 173 aa, Artificial Sequence; identical to SEQ ID NO: 2650
  Synthetic

SEQ ID NO: 2652 - protein, 181 aa, Artificial Sequence
  Synthetic
SEVEKVIKDNKRSVDEIRKTLKRVLERNEKTLRENEKKIRDIIAEVDKRLKDLEREIDDRDEAREIKKEVKKLVDDLRRDAEEIVKESARLSKELKEKLERIVREVEELSRRLSEEAKKGRDDKAIKEIEEEVRRVDDRVRKLVEKLDRDIKEVDDRSRKLTDDLRRKVEEVLRRIKETVT

SEQ ID NO: 2653 - protein, 181 aa, Artificial Sequence; identical to SEQ ID NO: 2652
  Synthetic

SEQ ID NO: 2654 - protein, 174 aa, Artificial Sequence
  Synthetic
REVEEIEKELRKIIRDLKELLRELRERLEKLDRDLKDLLRRLREENREILDRLRKEPKDKDVEKKIEDLLRELKKKNKEVLERIKEIMERSRREVEKVITTIDELIKRVKEKVRRNNLDEKVIRDADRMAKELKKDLRKVLEDNRRTVEKLKRDLEEVDKESDEEARKLREEIR

SEQ ID NO: 2655 - protein, 174 aa, Artificial Sequence; identical to SEQ ID NO: 2654
  Synthetic

SEQ ID NO: 2656 - protein, 180 aa, Artificial Sequence
  Synthetic
SESEKIEREIRKLIDDSRKNSERIRREIEKLIRDSEETSKEIKKEIEDLLRELKEMLDEIKKRDDDRLKEELKKRADDVERRIRELIKKNKDRLDEILERVERLVRENKERLDKIEEDIRRKGVPEEVLRRAKKALEEDKKRNDEVLDEVRKALEEDKKRNDKVLEDARRVIKKIKDELK

SEQ ID NO: 2657 - protein, 180 aa, Artificial Sequence; identical to SEQ ID NO: 2656
  Synthetic

SEQ ID NO: 2658 - protein, 180 aa, Artificial Sequence
  Synthetic
KDEETIRRRIEELLKRSEDNSERIRRTIRELLERSKKLSEEVRKRIEELLKRLDEKVKEIRKREDERLVRDAKRELERILDEVRRLVEKTKRDLEDMLRRIKELVRRNKEEIDRMLEEIRRSGVPEEVLKEAEKRLREDKKRNDEVLKRVTEAVEEDKKRNDDVLEKVERAIREIARKLD

SEQ ID NO: 2659 - protein, 180 aa, Artificial Sequence; identical to SEQ ID NO: 2658
  Synthetic

SEQ ID NO: 2660 - protein, 174 aa, Artificial Sequence
  Synthetic
SEEEKVIRDLERLLEENEEHSRDVERKLRESDKRLREMVKKVSDEIRKLDEEVEELLRRGTDSDRLRKVLEDILKRSKELADKLKKDIDKSLDEVKKLIDRDDEHVKDIEKKVRELRVSEDALRRVKEALERSKKRLDKVLKDHEDSVRELKKEIDDVLKRNEETVREIEKRAR

SEQ ID NO: 2661 - protein, 174 aa, Artificial Sequence; identical to SEQ ID NO: 2660
  Synthetic

SEQ ID NO: 2662 - protein, 174 aa, Artificial Sequence
  Synthetic
EEVERVKRELERLLEENDEHSKEVEKRIRDLDRKAEELLREIEERLRRSDERLKRLLERGTDEDELRKRIKKSEDEVRELIKKLTRVLEEILKRTKELADRDKKHVRDVEKRVRELDVEERVLKKVEDDLRESEKRVEEVLRKNEETVRRLKEELRKVLEDHKRTVEELRRRLT

SEQ ID NO: 2663 - protein, 174 aa, Artificial Sequence; identical to SEQ ID NO: 2662
  Synthetic

SEQ ID NO: 2664 - protein, 174 aa, Artificial Sequence
  Synthetic
SREEEVEKRIREVLKRLEELLADVERRARELNRRLEKVVRDVKKEIEDLDRKLRKLLKDGVDSEELKKVLKEVKKRSTELAKELEELIREVNRRVEKLVRDLREAIKRVEEEVRRLDVREKVLKDVTDMARELERRLEEVLRKHRKSSEDLKRRIDEVLKRNEETLREIDRRLN

SEQ ID NO: 2665 - protein, 174 aa, Artificial Sequence; identical to SEQ ID NO: 2664
  Synthetic

SEQ ID NO: 2666 - protein, 177 aa, Artificial Sequence
  Synthetic
SEREKAKRELERLLEEDRKHLKDVERELKELDEEDERHLREVEKELKELDDRAKEALDRRPDQKDKLRELLKRIKDRSEELVRRHEETNKRIEERTKELLDRHEESNRRIKKRLEELKDVVEEEVLKEVKRLSEKSKTDLEKIVRDNKRSSDDSRRELERVIRENEETLRRLAERIK

SEQ ID NO: 2667 - protein, 177 aa, Artificial Sequence; identical to SEQ ID NO: 2666
  Synthetic

SEQ ID NO: 2668 - protein, 177 aa, Artificial Sequence
  Synthetic
KEEEEAKKELDDLLRRLKDLYRRIREELERLDRRLEEAYRRIKEDLKRLDEELRRLLEKDRDDRERIETLLEEILRRSEDLVRKLKKLNDEINTRTEELLKRLKKLNDDINKRLEDLRDVIDEKVIRDVRKASRDTEREIRKVAEDNRKSSEDSRRKLEDVLRKNKETLDRLRDELR

SEQ ID NO: 2669 - protein, 177 aa, Artificial Sequence; identical to SEQ ID NO: 2668
  Synthetic

SEQ ID NO: 2670 - protein, 177 aa, Artificial Sequence
  Synthetic
DEKETVEEELRRLLEELKKHIEDTERKLRKLDTDLEDVYRRIEEELRRLLEELKKMLDDRKEDREELRRLLEEIERRIRRLAEELKKLNKDINDTTKDLVRKNERLLREILKRLRELRDLVDEKVLRDVEEALRRAKKRSDDVVRENEKSSRRSEERLERVLRDAKRVLKELKERID

SEQ ID NO: 2671 - protein, 177 aa, Artificial Sequence; identical to SEQ ID NO: 2670
  Synthetic

SEQ ID NO: 2672 - protein, 185 aa, Artificial Sequence
  Synthetic
SELEEVLKRVAEVVERVSREDEKVNRKNDAAVKKVTKDDRKVLEDLERKLRELEKDAKDRGVDKELVDRIREKIETIKEEIRDLNKKLKELIEDTLRDNRRLNEEVRRKVERILEKLEEIRRRGSDEDVIRRLEKEVRDVLKDWEEKSKEAEEKNKTVNKRWEDESRRLKKKVDRLIEKIKEDLR

SEQ ID NO: 2673 - protein, 185 aa, Artificial Sequence; identical to SEQ ID NO: 2672
  Synthetic

SEQ ID NO: 2674 - protein, 177 aa, Artificial Sequence
  Synthetic
RSEELLREIEERIKRLKEKNEELVKEIRRRARELEREDDRAKKEIDDLARKVEEKIRRTIRDKDRARELEKRLRDILREIEDLSRKSEKAIRDVERKVEELSEENKRLIEEIADRVRRKRMDDDVVREVRKLIEELDRHLERLVEEVRRVVKELLEISKEILDRVREVITRLREEVK

SEQ ID NO: 2675 - protein, 177 aa, Artificial Sequence; identical to SEQ ID NO: 2674
  Synthetic

SEQ ID NO: 2676 - protein, 179 aa, Artificial Sequence
  Synthetic
SEVEDAVRKIRELAKEIARAIDELLKEHEELIRTVADALEKLVRTSDKLAEDIARVIDGGVSEEALKEALKRWREATEEVRKRLEDVLRRTKEHLREVAETIREALERLERAIRRVEEEGTIGRELLEELKRILEDLERRAKEIVDRARELNKRAEDEIRRLIEDSKRKLEEIRKRIEE

SEQ ID NO: 2677 - protein, 179 aa, Artificial Sequence; identical to SEQ ID NO: 2676
  Synthetic

SEQ ID NO: 2678 - protein, 179 aa, Artificial Sequence
  Synthetic
KEAEEAVKRLRDLVRRVEEETKRLLRESRESLKTLEEITDRLLKRSEESVKEIEKVITRGRPEKDVKDALDKHRDTNREVLKRLTDLNREHKELNEKVARDLERIDEELKKALDEVTRRGTIGRELLTEVTKLIKDHHDKVREILRESDKELDRHHKDVERILERSKRELERLEDEVRR

SEQ ID NO: 2679 - protein, 179 aa, Artificial Sequence; identical to SEQ ID NO: 2678
  Synthetic

SEQ ID NO: 2680 - protein, 171 aa, Artificial Sequence
  Synthetic
SREELLKEIKKKIDDIKRENEKLLRDIERLIRELEKRDKELLDEARKTSEELVRRAGTEDEKVKKLLEESERLIEEVERVSREMVERARRLLERVKRASERLTRKLEDILRRKGADRDVVRDVDRILTEWKKESEDLVEEVKELIKRWKDTSEELVRRVRELNERIDRETR

SEQ ID NO: 2681 - protein, 171 aa, Artificial Sequence; identical to SEQ ID NO: 2680
  Synthetic

SEQ ID NO: 2682 - protein, 178 aa, Artificial Sequence
  Synthetic
SEVETVEEKVKKVIEDLRRLLKEVRDRNRRIIEEIKRLLERVAEKNKRIVDEIRDLLRRRSTEEVLKDIERLLREAHETNKEVLERVKRLADEAHRRNEKVLEEIKRLADTIDKELKDINVDEDIIRRIDELFREILKEVKRLNEESKRRLEKLEEDIKRLDDRSREEAEKLRDAVRR

SEQ ID NO: 2683 - protein, 178 aa, Artificial Sequence; identical to SEQ ID NO: 2682
  Synthetic

SEQ ID NO: 2684 - protein, 178 aa, Artificial Sequence
  Synthetic
SEVEKVARDVEEVIRTSEDKTRKLEKRNKDIIREIKKLLDDLARENKRIADEIKRKLDERREERVLEEIERLMRKLHEDNKRVLKRVDELLRKLHDENRRLNEENKELAERVEDTLRRKNVDKRLIDEIRREMERSHRRDEEVNEKSKREADKLRRDVEKLDEDSARELKKLEDEVRT

SEQ ID NO: 2685 - protein, 178 aa, Artificial Sequence; identical to SEQ ID NO: 2684
  Synthetic

SEQ ID NO: 2686 - protein, 178 aa, Artificial Sequence
  Synthetic
SEVERVERELDKVITDLRRLLDDLKRKNEELVRRIRELLKKVKERNKKIVTEIDDLLRRRKTEEVLKEIKKLLEDAHRDNTEVLKEVRRIVKEAHDLNKKVLDEIKKLLRELLEDLKRLNVDERIIRRIKELADRIEERVKELNERVREEVRKLEEDIKKLDDESREEARKLEDKVRQ

SEQ ID NO: 2687 - protein, 178 aa, Artificial Sequence; identical to SEQ ID NO: 2686
  Synthetic

SEQ ID NO: 2688 - protein, 177 aa, Artificial Sequence
  Synthetic
SSEEIRREIERESEDTRRRLDRVLEDIERLSRETKEHIKESLERVRREHDRLRRELERKAKDKDTVTELAKHIKRSLEEVERIHEELLRDDERVLKEIKEIADELRRRDDEVVKRIRDREMTEEVRREVRKLIEESRRAIDEVKRRVEELIKESRDRNRRIEERVKELVKENAERIR

SEQ ID NO: 2689 - protein, 177 aa, Artificial Sequence; identical to SEQ ID NO: 2688
  Synthetic

SEQ ID NO: 2690 - protein, 177 aa, Artificial Sequence
  Synthetic
KSEEIRRKIEEDSRRTKKELDDILDEIRKLAEKVKKEIEELLRKVRRRHEDMKRRLREKVKDKDTVTELEKHIRRSLDEVRKLAEELKKKIEEVKRELKKLADELRRRDDEVVKRIRDKPVTEEVAKEVKKLIEESRKLLEELKDTVRRLIKRLKELLEELERRVEELIKENEERIR

SEQ ID NO: 2691 - protein, 177 aa, Artificial Sequence; identical to SEQ ID NO: 2690
  Synthetic

SEQ ID NO: 2692 - protein, 177 aa, Artificial Sequence
  Synthetic
RSEDILREIEDLSRETKEKIDEILERIRKLAEEVKRHIDESLKEVRRRHEEADRELDEKMRDKDTVKRLKEHIRRSLTEVEDLHRKLREEVERVLRKVERDIDKLRETDDRVAKRIRSKRADEEVAKEVRDLIRRSEDLLRRILETVDKLIKELRKLNEDILERVRKLIKKNKDDIK

SEQ ID NO: 2693 - protein, 177 aa, Artificial Sequence; identical to SEQ ID NO: 2692
  Synthetic

SEQ ID NO: 2694 - protein, 177 aa, Artificial Sequence
  Synthetic
KSEEIERRIRERSRETRRELEEVDKKVKKRHTELREHLKRSLKKVKEDHDDLKRKLEEKIKDKDTVRRLDEHIKRSLEEVKRLHEELERHLTTSLRKVEEEAKRLKKRDDDIERRIESKPMTEEVEEEVKRLIEESKELIKRLEEEVDKLIRDNKKLNDDILRRVKRLAEENDERIR

SEQ ID NO: 2695 - protein, 177 aa, Artificial Sequence; identical to SEQ ID NO: 2694
  Synthetic

SEQ ID NO: 2696 - protein, 177 aa, Artificial Sequence
  Synthetic
SSEDILRDIERIARKLREDLKRVLKRVKELSDDTRREIERLVEEVERIHERLRRELERKVSDKDTARRLKKHIDDSLREVRKLAEDLERTDKKVLDEIRKLAEDLKRKIDKIVEDVRRKRMDERVADEVRKLIAELEKLIRDLKRRVDELIRRSRELLERIRDRVRKLIEENKRAID

SEQ ID NO: 2697 - protein, 177 aa, Artificial Sequence; identical to SEQ ID NO: 2696
  Synthetic

SEQ ID NO: 2698 - protein, 179 aa, Artificial Sequence
  Synthetic
SKVEEAKREVDRVIKELREDIKRVEEEVDKLIKDHEKLNKELEDESRKLAERVEKLRRDGVPREDVRRALDDWRRRSEEALRRSEESLKRIKERVRELLERIRKLLKEIDDRVEKLREAGVIDEKIVRDIKELLRDLRREVEKVIERIDRLIKRLEEESRRLFEESEKAIRELKRRVDK

SEQ ID NO: 2699 - protein, 179 aa, Artificial Sequence; identical to SEQ ID NO: 2698
  Synthetic

SEQ ID NO: 2700 - protein, 179 aa, Artificial Sequence
  Synthetic
KKVEEAKKEVKEMIRRHRERNKEVEKEVKDLARKHEKENRDVAETSKRLAEKVKKLRDDGVDRKDVRRVLEDWRRRSKELLDRSRKSLEEIRKRVEDLVRESKESLKRIEDRVRELEERGVIDEEIVKDIKREIEELEDESRRILEEIREDIDRLRRRSEKLFEDSRELIERMKREVDR

SEQ ID NO: 2701 - protein, 179 aa, Artificial Sequence; identical to SEQ ID NO: 2700
  Synthetic

SEQ ID NO: 2702 - protein, 176 aa, Artificial Sequence
  Synthetic
DEIEKVRKRAEDLNREDKRLSERAFEESKEVVEEHRRLSDRARRESDRVVEEVEKTLKDKREKKEDLEKLLRDWKRISEKLKEESDKSLKDWEDRTRELMERSKKSLDELEEVLRRIPVDRKILEEIRKAIDRNRDENRRLVEESKKELDELRKEDEELVERSKRKLEELDRRAKK

SEQ ID NO: 2703 - protein, 176 aa, Artificial Sequence; identical to SEQ ID NO: 2702
  Synthetic

SEQ ID NO: 2704 - protein, 176 aa, Artificial Sequence
  Synthetic
SRIETVKDELRRIAEDVRRALEEIEERLKDLNRRDEELTKRIEDTSRDILRRVEEVLRRNREKKEEAETLLRDWDRVSKELKKESDRSLEELRREIERLREEIERLLRELDKLIKDIDIDEKILKEVADRLRELKRRAERLIEEVTRLLKENEKRNKEVVDTSREALREIRDRVRK

SEQ ID NO: 2705 - protein, 176 aa, Artificial Sequence; identical to SEQ ID NO: 2704
  Synthetic

SEQ ID NO: 2706 - protein, 177 aa, Artificial Sequence
  Synthetic
SKEDILREIEKRIRKIEKEAEELLRESRKILEELEERDRRLLERVKREIDRLLEETGEDDDLRRLLRELEKALEDMERVSRTVLREIERLIKESEDNIRELIERLEELLREVERRVRDEELLRRVERELKKLIDEVRKVLKDNFDRNRELAKEWEDLSRELFKRAKELIEKVEEASR

SEQ ID NO: 2707 - protein, 177 aa, Artificial Sequence; identical to SEQ ID NO: 2706
  Synthetic

SEQ ID NO: 2708 - protein, 177 aa, Artificial Sequence
  Synthetic
SKEDILREIKKRIEEIERDARRLLEESKRILDELRKTDEKLLRESEERVEELERKSGRDEKVEDLLRRLKRLIDESKKDSDRMLKEAKKLIEDSKRNIEELLKELRRLLERVRREVRDEELLKRVMEELRELIERVERELRRNARENRELARKWKKLSEENKKKNDDLIREVDEASR

SEQ ID NO: 2709 - protein, 177 aa, Artificial Sequence; identical to SEQ ID NO: 2708
  Synthetic

SEQ ID NO: 2710 - protein, 174 aa, Artificial Sequence
  Synthetic
DEKERIEEEIRRILEELERKVDEAREEIKRMDEELKRRIEEIARRSRELDDELRERVDKDKDKDKLEKIVEDILRTSRKLIEDLKKLIDDILRRSKELVDRLRELVDRVRERVERLPVDEEVRKEAERVLRKIEEDIDRVLRENEDSVRKLRTEIDRVEEENRRSAKRIRERLK

SEQ ID NO: 2711 - protein, 174 aa, Artificial Sequence; identical to SEQ ID NO: 2710
  Synthetic

SEQ ID NO: 2712 - protein, 176 aa, Artificial Sequence
  Synthetic
DEVRDVVTRIRDLLRRIKERLEELTERIRRLLEKIHKTTEDLARRNRKLIDEIRKEIDKGVEKEEVDKMIEELKKHTDETLRRIEELNDRSDKLVKRVLEEIERLIREAEKEVKKAERVIPEDVKREVKELLDKIREDLERVREEAKRSNEENRKRLEEVVEESERLLEELKRRST

SEQ ID NO: 2713 - protein, 176 aa, Artificial Sequence; identical to SEQ ID NO: 2712
  Synthetic

SEQ ID NO: 2714 - protein, 180 aa, Artificial Sequence
  Synthetic
DEVREVLKELKKVLREIEKAVRDVLEEDREMHERIARKVKKVLDENKKSLDDLRRKVDSEKLKEIEKVVEDTLRELKELLDRARELNERTKRRLEKLLDEIRKVIKRLLEELDELRRRGASEKKLKEIADKIRELLERLKDRLEKIAREIRDVNRKLDEDLEDIVRRIRDVDKKLDDKTK

SEQ ID NO: 2715 - protein, 180 aa, Artificial Sequence; identical to SEQ ID NO: 2714
  Synthetic

SEQ ID NO: 2716 - protein, 188 aa, Artificial Sequence
  Synthetic
SVLEEIEREVEEIRRRIEKVLKELNDDDRRVIEDSKRLNEKLEKEVRDIERKARDLLRKLKDTDDDREMKKILREVEKMVEELKRRSDEVVKRTRRVVDRLREKNKDVLRRIEKKIRELKDKIEKISAPREELEKLKRRLDEELDRVREKVEENIRRTDKAVEDSERENERLKRELDEKVKRIRDELR

SEQ ID NO: 2717 - protein, 188 aa, Artificial Sequence; identical to SEQ ID NO: 2716
  Synthetic

SEQ ID NO: 2718 - protein, 171 aa, Artificial Sequence
  Synthetic
SDEEDVERLVKELIDRVRKTDAELERKVDEVIRELKEVIKRIEDHSRDSIRKLRNEPMTEDVLRKAEEVHERNRDLLRKISERIKKLLEDLNKESRKNEDRVRRLVEELERRAKTLRELIKRLRDAVRESEKENKRINERLRRVIEKAKRDLEKILEEDRRVLEEMAERAK

SEQ ID NO: 2719 - protein, 171 aa, Artificial Sequence; identical to SEQ ID NO: 2718
  Synthetic

SEQ ID NO: 2720 - protein, 181 aa, Artificial Sequence
  Synthetic
SEVETIKREIDKLMKELTEKIKRIKEEDDKVHEELKRAVDRSRERLEEVLKELRDRGVPDKKLRELEKLIEELKRRNDDLLRKLKEVNEKTREDLERLLRDLRRLLKELRERLKELKDRNSDEKEIRDLMREIREVAERAKKRVDELLERIRRINTKLKEELKELHKRTEDLIKKAKEEVN

SEQ ID NO: 2721 - protein, 181 aa, Artificial Sequence; identical to SEQ ID NO: 2720
  Synthetic

SEQ ID NO: 2722 - protein, 181 aa, Artificial Sequence
  Synthetic
KEVEEIDERLKRVLEELRRMLEESRKEDERVHDELRKEAEKIKRELDKAVEELRARGVPKDVLRELKRLIDELRKEIKDLLDDLRRVNEETLRENERLLRELEKLVRELEEELKKVKDERRDKKVIDDLLRKIEKLIREMKKRLKDLHEETKRINEELERRLRDLERRVRDLLRRAREEAN

SEQ ID NO: 2723 - protein, 181 aa, Artificial Sequence; identical to SEQ ID NO: 2722
  Synthetic

SEQ ID NO: 2724 - protein, 181 aa, Artificial Sequence
  Synthetic
SEIERIKEEDEEVHKRLKEINDRINKEDKDVHDKLRDEARKIEERLRRVMEELRANGVPKSLLDEARRVIDELRRKLEKVLDELEKLNRKTEEDNRRLHEETRKVNEDTKRKLKEVKDNRSDEKVIRKLLEEIRRINEELERRNRKLMKDIREINERAEEKLRRLAEEIEELIKKLKEEVK

SEQ ID NO: 2725 - protein, 181 aa, Artificial Sequence; identical to SEQ ID NO: 2724
  Synthetic

SEQ ID NO: 2726 - protein, 181 aa, Artificial Sequence
  Synthetic
SEVEEIKREDDKVHEDLKKAADDIRKRDEDVNRKLTEAIEEIRREVDKALEDLERRGVPKDLLDRARRLAEELRRRLKELLERMHKVNEDTKRLLEELLRRLEEVNRRTRKELEDVKRRREPEEVIRRLMEKIRRINAELRKALKRLLEEIEDINRKLEEEVKKILEEIRRVLEELRRRAN

SEQ ID NO: 2727 - protein, 181 aa, Artificial Sequence; identical to SEQ ID NO: 2726
  Synthetic

SEQ ID NO: 2728 - protein, 182 aa, Artificial Sequence
  Synthetic
SEVEELVKELRRLIEEWDRRSKRLMEELKELAERIDKTTKELLKELEDLVEKIKRELDKKGGEDERLKEDVERLLRELREALKRVEDTVDRLNRESEEVLKEVKKTNEELVRRLEELLKRAKENGVEERVAEEVKRAIERAKRESDKIERDVRELNRRNREILKKIKKRVEDVLRKLRKDLE

SEQ ID NO: 2729 - protein, 182 aa, Artificial Sequence; identical to SEQ ID NO: 2728
  Synthetic

SEQ ID NO: 2730 - protein, 174 aa, Artificial Sequence
  Synthetic
DEVEELKERLRRLAETIARRIRELVERLRDSARKIEKRVRELAKKLRDSVREITKVIKDGVDERTIDEMIERHKRTSEEIAREIRDLLRRHKEVSERILEEVRRLIEELDRVVKEVTRTEEIREEVEKAVRDLEELLKELKRESEETIRRIEKLVRDLERESEEAVRRLKEEKD

SEQ ID NO: 2731 - protein, 174 aa, Artificial Sequence; identical to SEQ ID NO: 2730
  Synthetic

SEQ ID NO: 2732 - protein, 174 aa, Artificial Sequence
  Synthetic
SEEEKLKKELEDLARRIEKRLRELVEELERSVREIERRIEKLHKELEESVDRIKKVVDKGVDEDAVRKLLTDHDRISRETVRRIEELIKKHEEDSRRVVKEIEDLIRRLEEVVRRVTRTDEIRRRVEEVVRRLEKIVKELEERSREVLKRLREEIEKHKKRSEETKERIRTRAT

SEQ ID NO: 2733 - protein, 174 aa, Artificial Sequence; identical to SEQ ID NO: 2732
  Synthetic

SEQ ID NO: 2734 - protein, 174 aa, Artificial Sequence
  Synthetic
SEVEELLKRLEDLIRKIEERLKELVKRLKESAKEIEERLEELHRRLKESVDRIREEIEKGRDKEDVKRLVKRHKELSEETVRRIKKLLEDHKRLVDKILREIEKLLKELKDVAERVSRTEEIKKEVKKALERLKKIVEDAKKVSEETMERIRKLVEEHKDTSRKTVEDLERATK

SEQ ID NO: 2735 - protein, 174 aa, Artificial Sequence; identical to SEQ ID NO: 2734
  Synthetic

SEQ ID NO: 2736 - protein, 174 aa, Artificial Sequence
  Synthetic
DEVERLMEELRRLLEEVRKRIEDLIRENRKLVKEIKDRLEKLLRDNERLAREIEEVIRSGTEEEKVRELLERLERSSRKTLKEIRELLEKLRKKNEDSTREIERVLRELEDVVRKVVREERIREEVKRAIEKLKELVEDSNREVTEALKEIEDLLRKLKERSEELLRRIKARTD

SEQ ID NO: 2737 - protein, 174 aa, Artificial Sequence; identical to SEQ ID NO: 2736
  Synthetic

SEQ ID NO: 2738 - protein, 182 aa, Artificial Sequence
  Synthetic
KEVDELDEELKKHAERIDRELERLDRENEKHVEDVRRELERLREENERHARRIEDEVKKRTDEEEVIKRLIDDHRRLSKRTEDEIKKLLDDHRRLSEETKERIKELLKDHRRLLKDVADKIEDRKTLEDIRRKVEKSLRELEKKLEEIDKKNRDTLEEARRELERIRRENEEVIRRLDKRRR

SEQ ID NO: 2739 - protein, 182 aa, Artificial Sequence; identical to SEQ ID NO: 2738
  Synthetic

SEQ ID NO: 2740 - protein, 182 aa, Artificial Sequence
  Synthetic
KEVEELVRKLREHVRDIKRKLEELLKENEDHARRAEDRLRELTKENRDHVKEMEDVLRRDTDSRETIRKLLEDHKRLSKETAERIEELIRDHERLSRETSKRIKELIDDHRRLLEEAAKDIRDKDTLERLEREVRKSIKELEDKLREIRKRNKEVIDKLRDILEKIKKENREALKRLRDTEE

SEQ ID NO: 2741 - protein, 182 aa, Artificial Sequence; identical to SEQ ID NO: 2740
  Synthetic

SEQ ID NO: 2742 - protein, 182 aa, Artificial Sequence
  Synthetic
SEVEKLTEELRRHVEEIERDLDRLRKENERHAKKIKDELKRLLEELEEVARRIEAELERDTDDEDKIRKLLEDLEELLERIADTIRRLIEDHRRLSEETMERIRRLIEDHKKLLDDIARRIRDKDMLRRIEEEVERSIRRLEELLERIRERNEKVIEDLKELLKRIRDRAEEVKDRLRRTRK

SEQ ID NO: 2743 - protein, 182 aa, Artificial Sequence; identical to SEQ ID NO: 2742
  Synthetic

SEQ ID NO: 2744 - protein, 182 aa, Artificial Sequence
  Synthetic
SEVEKLKKELEDHVRDIEKKLRDLMRENEEHAKRARERLKKLLEDNEENVKDIEDKVRKKRDKEEVIKKLIDHHRKLSEDSVRDIEELIKDHKRLSEETSERIKRLIEDHRRLLKEISDKIRDEDTLRKIREDAKRSEKKLEEILRTIRKRNEKVIRDLRRLLEELRKRNREAIERLRKELE

SEQ ID NO: 2745 - protein, 182 aa, Artificial Sequence; identical to SEQ ID NO: 2744
  Synthetic

SEQ ID NO: 2746 - protein, 182 aa, Artificial Sequence
  Synthetic
SEVERLAEELRKHVEEIKKELRKLKEKLEKLARDIERELKRLRDENKKHADDIRDKVEKRKTDEKTIEDLIRDHERLSEETKKRIEDLIRRLEELLREVAKRIKELIEDHRRLLKDVADKIEDKDTLRRIEEEVKKSERELREELKRLEERVRRVIEKLEDLLRRIEKENEEVKRDLERRRK

SEQ ID NO: 2747 - protein, 182 aa, Artificial Sequence; identical to SEQ ID NO: 2746
  Synthetic

SEQ ID NO: 2748 - protein, 182 aa, Artificial Sequence
  Synthetic
SEVDELKRRLDEHAKDIRDKLRKLVKELREHAKRAEDELRRLLKENEDNAREIRELVKTLRDDKDKIEELIKHHKKLSEDSEREIKRLIEDHKRLLEEVEERIRRLIEDHKRLLEDVARKIRDEKTLRDIKRAVEKSIRDLERILEELRKEVEDTIKRLEDILREIRKRNKDVIDDLRRRMK

SEQ ID NO: 2749 - protein, 182 aa, Artificial Sequence; identical to SEQ ID NO: 2748
  Synthetic

SEQ ID NO: 2750 - protein, 182 aa, Artificial Sequence
  Synthetic
SEVDRLVRELDKHVEDIERTLKKLREENEKNVEEIKRTLKKLVDELRKLAREIIDTVDKNRDIREEIEKLIEDLRRMVEEIAKRAKDLLDHHAELSRRTREEIKRLLEDHDRLLKEIARKIKDEKTLRDIKRRVDKSLEDLKRTLEEIKRENERTLEEIKKILEDMEREVRDIERKLREKEK

SEQ ID NO: 2751 - protein, 182 aa, Artificial Sequence; identical to SEQ ID NO: 2750
  Synthetic

SEQ ID NO: 2752 - protein, 182 aa, Artificial Sequence
  Synthetic
KEVEDLVRELEKLIEEIKRRLEELDKELKKHVEDAERRIKKLLDENRENAERILEKLRRDKDDDDKARRLVKHHRELSEESSRRIEELIRDHRRLLEEISRTIEELLDRLRRMLKKIADEIKDEELLRRAKERVREALEDLRRILEEIRRKVEETIRRLEKLLKELRDRNRRVLEELERTLK

SEQ ID NO: 2753 - protein, 182 aa, Artificial Sequence; identical to SEQ ID NO: 2752
  Synthetic

SEQ ID NO: 2754 - protein, 180 aa, Artificial Sequence
  Synthetic
REKEEIKREVEEAKKRLEDLLREIAEEVKRALERLRELNERNNDRARRVLKRLTDELRRVDNEDLKRDARRLLEELKRINRESNETHKKLLEELRRLLREVEKTVERLLRRLDEMLERVERTEPDDRLSERLRRLVREIEETLKELLKALRRLLERIREVSEELHRRSEELVERILRKLK

SEQ ID NO: 2755 - protein, 180 aa, Artificial Sequence; identical to SEQ ID NO: 2754
  Synthetic

SEQ ID NO: 2756 - protein, 180 aa, Artificial Sequence
  Synthetic
REKEDIEEKVKRVLERLERLNRENNKESERLLRRLEELNKRNNEAVKELLDRLREILKRVRDEKKKREVEELLERLRRINEESNRVHRRLLEELRKLNEESNRVHKRLLELLKTLLDEIRKREPDDRLMEELKRLAREAERVSEELHDRTRRLAEEIEKVSKELHKKSEKLAREIKKRLD

SEQ ID NO: 2757 - protein, 180 aa, Artificial Sequence; identical to SEQ ID NO: 2756
  Synthetic

SEQ ID NO: 2758 - protein, 175 aa, Artificial Sequence
  Synthetic
KEAEELIKELKDLAERIRRENRRLLEELKKLVEEIRRRIRELIERSEDSVRKIEETVKRKKEKREELEKLLREHEKLNEEILEEIKKLLDDLRKTVKEAIDRSRKLNKELKDMVEKVSRDEKAERELKKISEDDERSIKELEDLLRKVEEDIRRLLDELRDIMKKTKEKVDELRR

SEQ ID NO: 2759 - protein, 175 aa, Artificial Sequence; identical to SEQ ID NO: 2758
  Synthetic

SEQ ID NO: 2760 - protein, 182 aa, Artificial Sequence
  Synthetic
DEAERVKRELERLVKEIKEENRRLLRELRELSKRSREVLERLLRKLEDLVRKIREVLERLKRVKEVVKRLKEELKKLLDEAEKVIEDLKRENDKLLEEVHRVNEKLDRDLEALLEEVRRINLPKKVLDEIEKEAEEIKRENKDFNRRIEREVRESKREIEEVVKRIREIAERVDRDIDRTRR

SEQ ID NO: 2761 - protein, 182 aa, Artificial Sequence; identical to SEQ ID NO: 2760
  Synthetic

SEQ ID NO: 2762 - protein, 182 aa, Artificial Sequence
  Synthetic
DEEREVKERLRDLTRRIRETIKRLLDKNKDLARRIREVNKETSEELERLARDIERVLEELKDVDEVVKRLKERLRELLRRSEEVNRRLDEENKKSNKETEDVARRLLKELRDLLEEVRRINLPKKVLDEIREAAERVKREIEELLKEVHRINTELNKDNTELNKRNREIVERVKRRIDERAR

SEQ ID NO: 2763 - protein, 182 aa, Artificial Sequence; identical to SEQ ID NO: 2762
  Synthetic

SEQ ID NO: 2764 - protein, 182 aa, Artificial Sequence
  Synthetic
DEVEEVKKALEDLAEKIRDLNRKILEKNKKLADDIRRLNEKLLRELRKLVEEIERVLRKLKDVKKVVKELKDRLKRLLEELERVNRELDERNKKLHKETEDLNRELDERLKKLEDDVRRVNIPKELLDEIRRRVEEVKKDNERVNKEIEELNRKLDEDNERANREIRDTVEKVRRRIDEEEK

SEQ ID NO: 2765 - protein, 182 aa, Artificial Sequence; identical to SEQ ID NO: 2764
  Synthetic

SEQ ID NO: 2766 - protein, 181 aa, Artificial Sequence
  Synthetic
SEIEEIEKEIRRVLEEIERLLRTLKKINDDVKRESEKLVRDDKKKIDDALRELRKLAAERGKDEKVIRDIEKLIRDVKRHSEEVLERLKRLNEETRKTNEEVIRRARRLIDELEKDIRRIRGDEVVRRAEKLLKEIRDTVETALKELEDKNERSERENKRVAEESERKLRKIKEEVDKAAE

SEQ ID NO: 2767 - protein, 181 aa, Artificial Sequence; identical to SEQ ID NO: 2766
  Synthetic

SEQ ID NO: 2768 - protein, 182 aa, Artificial Sequence
  Synthetic
RKVEEIKKRLKELKERLEESVKRIKDRLRKLEEDNRRLAEEVKKRLEELLKRLEDLVKRREGDKTDLRRSVEKVVREIRELIEELKRHTEESADEIRKLLEEHKRLSDEVVREIRELIRDLDDEKAVKELEDELRRIEKTSRDVLKELEDILRRLREESKRVADELRELLRRVKEKVERETK

SEQ ID NO: 2769 - protein, 182 aa, Artificial Sequence; identical to SEQ ID NO: 2768
  Synthetic

SEQ ID NO: 2770 - protein, 182 aa, Artificial Sequence
  Synthetic
SEDDRIRERLKELVDRNDELVKRIKRALDELLRELRKSVEDIKRTLDDLARKLEELARRREGDKTDLRRVVEKIRRDIEKLLKDHEDKSREVVRTIRELLDKLRRHTERTAREIRELIRRQDSREVVEDLKRILRELEKRSEDVLRELKKKLDDVEKESRDVLRELTEKLKKIEEDVRRAEK

SEQ ID NO: 2771 - protein, 182 aa, Artificial Sequence; identical to SEQ ID NO: 2770
  Synthetic

SEQ ID NO: 2772 - protein, 182 aa, Artificial Sequence
  Synthetic
REVEEIERRIRELLETNREIAERTTEEIKRLKKELEDSLEEIKKRLKELVDELRKLATDRRGDKTDLRRSVRRVEEEIRRLLDEHRKLSEEVMRTIEKLNEDSRRHTRETVEEIKELIKRLTIEEAVRRLEELVREIEDRSERLNKENEDELKKIEETSRKALKELEDRLREVKKEVREAER

SEQ ID NO: 2773 - protein, 182 aa, Artificial Sequence; identical to SEQ ID NO: 2772
  Synthetic

SEQ ID NO: 2774 - protein, 181 aa, Artificial Sequence
  Synthetic
DSDRELEKKIRDSLKRLEEALRELEERLKRSLEDDERVHEELRRRAERIRETIKKRLSDKDTLDKLKKEVDKLLTDLERVNRDTKRLNKELLDKAREVVKKLKEDNRRLLEDLKEIIKKPTRSELVKRMKERVDELHKRTEELLERLKEELKKLHDETRDINRELKKRLEDLERKIEEAAK

SEQ ID NO: 2775 - protein, 181 aa, Artificial Sequence; identical to SEQ ID NO: 2774
  Synthetic

SEQ ID NO: 2776 - protein, 181 aa, Artificial Sequence
  Synthetic
KEAEELRRLIEESKRTDKKVHEDLKEEVRKIEEEDDKAHEELRKEVERIKKKIDDDMSDEDTARRLRKEVEDLLRRLKKLNEETKRELERLDEKLRKVNEKTKEDNERLARELEEIIKKPTGSELIKRLKDEVKKLHDETERINRELKKELDDLLRRVRKINKELKEELKKLERKIEEAAR

SEQ ID NO: 2777 - protein, 181 aa, Artificial Sequence; identical to SEQ ID NO: 2776
  Synthetic

SEQ ID NO: 2778 - protein, 181 aa, Artificial Sequence
  Synthetic
SSREELEKRIRESEKRDREMHERLRRTAEKIEKEDKEMHDRLREKAERIEERIDKEVSDEDTARRLKEELKRLLEDLERVNRRTKEELERLLKEAEELNKRTEERNRKLEKEIKDIISRDTKSELIERIAERIERLNRDTERINRELEEKLRRLLKRIREINTELDKRLKELLDRIEEASR

SEQ ID NO: 2779 - protein, 181 aa, Artificial Sequence; identical to SEQ ID NO: 2778
  Synthetic

SEQ ID NO: 2780 - protein, 178 aa, Artificial Sequence
  Synthetic
SSEEKIEKASEDNERKVKEVLREIEELSKKDKTDVERVLRELEKRLEEIKREVDRRDRRREEMERLREEIKRLLDRLRERIEEVDKRITELNKDANDTVRRVVKEIKELNDRLRRRVREVDSEEDLKRELDEIDKRTEELARELRELMREIHERTKRLADDLRRAIDEIRKKIEEDAR

SEQ ID NO: 2781 - protein, 178 aa, Artificial Sequence; identical to SEQ ID NO: 2780
  Synthetic

SEQ ID NO: 2782 - protein, 181 aa, Artificial Sequence
  Synthetic
DELEDLLRRHRELVKRSLERLKDLLERNRELIEDSERRAEELLRELRRLIEEIKKVLDEGIDEKDIKKMLDELRRTAEEILKELEEVNERLNRASRKTLEEIKDSNRKLNDSVKKIEDRIKDKKVLEELKRSNDEANERHKTVLRRLEEENKRANDSHRKIKEELKDLLRRVDETVKEKRR

SEQ ID NO: 2783 - protein, 181 aa, Artificial Sequence; identical to SEQ ID NO: 2782
  Synthetic

SEQ ID NO: 2784 - protein, 181 aa, Artificial Sequence
  Synthetic
SRLEELLKTHKKLVEDSVDEVRRLLERNRKLIEDSKERLKELLRTNEELIRTLKEVLDRGTSEEDIKRLLDELEKHVRETNERSKRSNERLNRHVEETNKRTKELNDELNRSVKEIEDEIKDEEVLRRLKESNKKANEDHRRLNEENKDLNRRANEEHKKVNDRNKELLDRARRTADEKRR

SEQ ID NO: 2785 - protein, 181 aa, Artificial Sequence; identical to SEQ ID NO: 2784
  Synthetic

SEQ ID NO: 2786 - protein, 181 aa, Artificial Sequence
  Synthetic
DEVDELVKTHERLVEESERRIEELLERNRRLIERITERAKELLKENKRLIEEITEVLKRGSDEKDIERLLRELEKHVRETNEESKRMLDELRKHVEDTNRETKKLNDDLNDSVKKIEDRIKDKDVLERLKDSNRKANERHKRMNEENKRLLEDVERRIKELNKRNEDLLREAEKRVRDERR

SEQ ID NO: 2787 - protein, 181 aa, Artificial Sequence; identical to SEQ ID NO: 2786
  Synthetic

SEQ ID NO: 2788 - protein, 181 aa, Artificial Sequence
  Synthetic
SELEELLKTHKKLVEDSVERVRDLLRENKRLIEESEKEIRKLLDELRELIERIIELVERGESEETIKEVVDRLRRTVERIEKRLRDSNRELNDHVRRTNEETKRLNEELNRAVKEIEDRIKDKEVLERLKKSNKEANDEHRRLNDENRELNERANRKHKEVEDRLKDLLRRAEEKLTEDAK

SEQ ID NO: 2789 - protein, 181 aa, Artificial Sequence; identical to SEQ ID NO: 2788
  Synthetic

SEQ ID NO: 2790 - protein, 181 aa, Artificial Sequence
  Synthetic
DEVERLITKHRKLVEDSRRRVEELLRRNAELIKTSKRRVEELLERNRRLAEELRRLLKEGQSEETIKELLERLRKHVKETDDELRESNKRLNDHVKRTNEETEKLNRELNKVAKEIKDRIKGDEVLRRVEDSNRRANETHKDLNRKNKELNEEANRTHEELLRRNEKLLREIEDTVDRETK

SEQ ID NO: 2791 - protein, 181 aa, Artificial Sequence; identical to SEQ ID NO: 2790
  Synthetic

SEQ ID NO: 2792 - protein, 181 aa, Artificial Sequence
  Synthetic
SEVEKLLKELEDESRKSEDDNRRLLEELRRLSEESLRDLRRLLEDLKRLAEEIEREVRKRPEKELLEDLLRKLEKILRDIRRAIRRNIEENRRVLEEWKKRTDKNRRDNEDIVRRIRERIRGDELKKRVDEVLETSRELLRESKRKIEEIARRSEEELKRVKDEVDDTARRIKRKIEEAEK

SEQ ID NO: 2793 - protein, 181 aa, Artificial Sequence; identical to SEQ ID NO: 2792
  Synthetic

SEQ ID NO: 2794 - protein, 174 aa, Artificial Sequence
  Synthetic
DSERRLDEILERAREVNEESSRRLDKLLRETEEKNRKSTEELRKIVEDLKRTVKDESRTDEIEDLVRKIEEEIKKLIKESNDLVEEILRRSKDALRESNERVREILERIRDMKERGEDAETVIRRIEKLLEDLKRVDDKILEEHKDLSKKLDDVDREIKERIKKLIKDLKDTAR

SEQ ID NO: 2795 - protein, 174 aa, Artificial Sequence; identical to SEQ ID NO: 2794
  Synthetic

SEQ ID NO: 2796 - protein, 174 aa, Artificial Sequence
  Synthetic
DSEEELKDILRKAKEDNDRSSDKLRRLLEETEKRNRDSTKRLEELLEETEREVRRRSRREDIERLVREILTRSRKLIEDSNRLVKRILDESEKLLRDSNRLLEEVERRIKDLKDRGEDAETVKERIKKLLKDLREVDREILERHKKMSDDLKRVDEEISKTHKELSRRLKETAR

SEQ ID NO: 2797 - protein, 174 aa, Artificial Sequence; identical to SEQ ID NO: 2796
  Synthetic

SEQ ID NO: 2798 - protein, 174 aa, Artificial Sequence
  Synthetic
SKEEDLKRILEEAEKTNKESSDRLRELMDRTRRENEESSRTLKEIVKDADRRVAEIIRTDELRKLVRDIKETIKELDERSNRLAEEILKTSKKLDEDSNRLVEDVVRRIKDMVDRGEDVERVKEDIERLLDELRKVDREILETHKKLSEELRRVDEEIIKRVKDLIRTLEKAAE

SEQ ID NO: 2799 - protein, 174 aa, Artificial Sequence; identical to SEQ ID NO: 2798
  Synthetic

SEQ ID NO: 2800 - protein, 174 aa, Artificial Sequence
  Synthetic
SSEERLRTILREIEKTNRDSSKRLRDLLRETKRENKESSDELRKLLEETRDEVEKRRRDKEIERLVREILKTSEDLDRRSNREVERILRTSERLDRESNKLATKISEDIKRMTDKGEDSDTVAERIRRLLEELKRVDEEILKTHKDLSDRLRELDEEIKKTHEKLSEELRRAAN

SEQ ID NO: 2801 - protein, 174 aa, Artificial Sequence; identical to SEQ ID NO: 2800
  Synthetic

SEQ ID NO: 2802 - protein, 181 aa, Artificial Sequence
  Synthetic
KEVEEILETHKEIARELREVAEEIIRDHERILRDLEKKIRELRRTHERMVEELDRVAKEGVSEEELKRLLDELHERVKEILETLKRLLDKLHKTVEELKRTLEELLRDLHRLVKELEDRIKDKDALDKLRDSDRRVHEDVRRMLKRLDDSDKRVHDRVRKVLEDLKRSNDELRRTVEERER

SEQ ID NO: 2803 - protein, 181 aa, Artificial Sequence; identical to SEQ ID NO: 2802
  Synthetic

SEQ ID NO: 2804 - protein, 181 aa, Artificial Sequence
  Synthetic
SEVEKILEDHKRIVDELEKEAKKIEETHTELVKRLREEVEKLKEELRRLLEELKDMARRGVREEELRELLDRLREMVERILRRLRKLNEELNKVIEELKRRLEKLLEDLHRRVEELLREIKDEEALRRLKKSDEEVHRRVREILKRLEKSNRDLNDDSRKVEEELKRILRRIEEEAKRTED

SEQ ID NO: 2805 - protein, 181 aa, Artificial Sequence; identical to SEQ ID NO: 2804
  Synthetic

SEQ ID NO: 2806 - protein, 187 aa, Artificial Sequence
  Synthetic
SEAERLLDELRRLLEEIKRRIEELLEESKRSLEEVEKRSKELLDRLEDLLRKIKEEIRKDGTSDEVAKKIKELLERLEDSIRKVKEEDEKMLREHEETNRRIEKEIKDMLRKLEDDIKKVKDRLKDSPEEVKERLERLRERIKREIDRVIRELRELDKRAKEVSKRTKEELEKILEKVRRVIEEVKR

SEQ ID NO: 2807 - protein, 187 aa, Artificial Sequence; identical to SEQ ID NO: 2806
  Synthetic

SEQ ID NO: 2808 - protein, 187 aa, Artificial Sequence
  Synthetic
DDVDRLLDELRELIDRIRKDLERLLKESRDSLEELRRRSEELLKKLEEEIREVVERIRREGTGDEVREKIDRVAKEVERSVRKVKEEDKDLLRRHNELNKDIKRKIDELLKRLEEVVRRIKKRIEKDPDELKRRAEKLLEDLRRVIEEIKRRLDKVNDEVREVSKETTDRLDDLVRKARELIRRVEK

SEQ ID NO: 2809 - protein, 187 aa, Artificial Sequence; identical to SEQ ID NO: 2808
  Synthetic

SEQ ID NO: 2810 - protein, 179 aa, Artificial Sequence
  Synthetic
SEREKLLTDLRDLLKKVVDTLRRLNEELKKSIEESKETLERLNRTLKKLLDEVKKKLEDDGGEDKRVLDKIRDLLRKLRRAVEETKKTNKRLAEENEKLAKKSKEDLKKLLDDLEKVVKEVEETDELRKIVEEIRTELDRVRETNERILKEVRDEHRRVDKTNTDIERDIERVIKEVET

SEQ ID NO: 2811 - protein, 179 aa, Artificial Sequence; identical to SEQ ID NO: 2810
  Synthetic

SEQ ID NO: 2812 - protein, 182 aa, Artificial Sequence
  Synthetic
KKDEDLKKLLKDNEDVMKKAADEVKRLNDENRDLMRRVAEKIEDLLRRLEKLLRDILRRRGEEDERAKRLEELVREILERIERLLRESEKVHRESNERSKRLLEESKKLHKRIAEEIDELRRRGSDSKTVKDRIKRLTDELERVNRELSEEHKRVLDELRKRNKEILDRLKELLKRLKEEAD

SEQ ID NO: 2813 - protein, 182 aa, Artificial Sequence; identical to SEQ ID NO: 2812
  Synthetic

SEQ ID NO: 2814 - protein, 181 aa, Artificial Sequence
  Synthetic
SSEEELERLLEELRRITEEAKERMERSSKELEDVSREAEKRLEKSSRDLDKTVRDIKRRIKDKDTLREIDRLAKELKERNERLLEELRRSSEELKRRNERLIEESRKSSEEIKKRIKDLRRDSDDAEDVKRRVRELIEEHKRLNKELLDESRELLKTHAELVKRILDESRRLLEELEKAAR

SEQ ID NO: 2815 - protein, 181 aa, Artificial Sequence; identical to SEQ ID NO: 2814
  Synthetic

SEQ ID NO: 2816 - protein, 175 aa, Artificial Sequence
  Synthetic
SEREDATRRLRDIIRRLRDLIRRLTEESEESIKEIRERIERIIRTSEESLKELEERIRRNRDKRELLEELLRRHHELNKRLKEELKRILKEHAELNKRIKEELKRILKEAKERIDRLERTEDLERLREEIEDVVRKAEKRLDELHDEIRRTIEDAERRLDESNERAEKVVRDAEK

SEQ ID NO: 2817 - protein, 175 aa, Artificial Sequence; identical to SEQ ID NO: 2816
  Synthetic

SEQ ID NO: 2818 - protein, 175 aa, Artificial Sequence
  Synthetic
SDEERALEKIRRLIEDLRRMVREMLERSKKSLEEHKELAREILRRSRESLERLKDVARRNKEKEEDLKRLLKEHADLNRELKKRLRDSNREHNELNKDLKRKLRELLKELKKRVDELPRSRELDKLREELEEVVRRVEEKLDDSDRRANEVTREIEKTLDDLHREAEEVVKEIRR

SEQ ID NO: 2819 - protein, 175 aa, Artificial Sequence; identical to SEQ ID NO: 2818
  Synthetic

SEQ ID NO: 2820 - protein, 181 aa, Artificial Sequence
  Synthetic
SVEETLRRLLEESERVNRRVKEDLDRIRRESEEVNKRAEEMAKELLDEIRKDIDRVRKRNVDEDTLRKLLEEIKRLVDEWRRLVEENHKRNEDLIRKWEKLVRENHERNKTILKEVEERIRTEELAKEVIKTLRKLIEESKRNHEDLRRELRELIEESKRDHERLLRRLRELIKRIRDTTK

SEQ ID NO: 2821 - protein, 181 aa, Artificial Sequence; identical to SEQ ID NO: 2820
  Synthetic

SEQ ID NO: 2822 - protein, 181 aa, Artificial Sequence
  Synthetic
DEIEDLLRRAEKLIRDLKRKNDKLLKESEELLERLRERAKEVLDESKKLLEELRELVRRRGKTEEIEELVKEINKRNRELLKELSDLVKEINERDKEVLDRLRRDHERTLKTIDDLLKEIRDERAARDVERLKRRNKKVVEDSEDLARKTNKKSEELLREIRKRVEDSNRETKEILDRVRK

SEQ ID NO: 2823 - protein, 181 aa, Artificial Sequence; identical to SEQ ID NO: 2822
  Synthetic

SEQ ID NO: 2824 - protein, 174 aa, Artificial Sequence
  Synthetic
DEDEELLKRLRDLIREVRDRVRRLLEEDKDSLRRIRERVEELLRRSEESLKDLEKKIREGSPEEEIERLLREHEELNKRVLDEIRKLAEDNRDLTRRIKEKVEELIERVRDALRKLTPSEELKKIADKVEEVLREVEKELDKSRRTSDEILKKVEKAVRDLDRRVKEVIDRARR

SEQ ID NO: 2825 - protein, 174 aa, Artificial Sequence; identical to SEQ ID NO: 2824
  Synthetic

SEQ ID NO: 2826 - protein, 182 aa, Artificial Sequence
  Synthetic
SEAEELLKRLERLLRESKKDLERLRKELKDLLEESRKDVTRLLDEIRRLLEEIKRRLDKRNEDEKLDKLRKELKELVDRARRVLERNVRENEELIRDIERNLKKNREDNERAIKEILDELKDLEEVKRMIEKLKKESEEVIRKAKEDLDRVTKESRRVIEEVERRLDELRERLREVVERVKT

SEQ ID NO: 2827 - protein, 182 aa, Artificial Sequence; identical to SEQ ID NO: 2826
  Synthetic

SEQ ID NO: 2828 - protein, 182 aa, Artificial Sequence
  Synthetic
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 2829 - protein, 182 aa, Artificial Sequence; identical to SEQ ID NO: 2828
  Synthetic

SEQ ID NO: 2830 - protein, 180 aa, Artificial Sequence
  Synthetic
SVEETARRLLDENRKLLEEAERIHTEINERNKELLKRADDLHRRVLEDLRKLLDKVAKEIDSRRLERIEELVKRILEKLEKSNRDSNKEHKDTNERSKRSNDESRKVHEKTLKEIEDVTKEGQDADTVVKRIKKVIDELEELNRKSKKELKEVIEDLERRNRDSIRRAEDLLRRLEEEVR

SEQ ID NO: 2831 - protein, 180 aa, Artificial Sequence; identical to SEQ ID NO: 2830
  Synthetic

SEQ ID NO: 2832 - protein, 180 aa, Artificial Sequence
  Synthetic
KDEETVEKLLRELEELLKEAEERAKDLNRRNKELLDEADRRHEELLRRLEDLLRDVRRRIDSERLERLERLAKEIRERIKKSNEESNRLHEETNKRIEKLLRDLRKTVKEVLERIKDMKDRGEDSDTVSERIRKVIREIERLIKEIVKEIEKLIRDLEKRNRESLKEIKDLLKKLKDEVD

SEQ ID NO: 2833 - protein, 180 aa, Artificial Sequence; identical to SEQ ID NO: 2832
  Synthetic

SEQ ID NO: 2834 - protein, 173 aa, Artificial Sequence
  Synthetic
SRKEKLLTELKEILKRLKEEVEKIVKESEKSIEEHHRRSERLKRESKKSLDDLAKILERSDKKVIDEIAKEHHDLNREILREDKKLLDDHHRLNKDLLKTIKELIDEARRRMEELDQDEELEKIRREVEELLRRAEEELRRLNREIEENHKRVKRELEKIDKEMKDLLREAKR

SEQ ID NO: 2835 - protein, 173 aa, Artificial Sequence; identical to SEQ ID NO: 2834
  Synthetic

SEQ ID NO: 2836 - protein, 173 aa, Artificial Sequence
  Synthetic
DRKERLKERLERLLKEHHDRSRELLRTSEESIRRHHEESRRLLRRSKESLDRLRDELRRLREEDIDKLMREHHKLNRDLLKEDEDLLDTHHKLNRKILREDEELLRKIREEIEKLDKDEELRKLERRARENHKRVREALERLNRRIEENHKRVRRRLEDLDRAAEELLREAKR

SEQ ID NO: 2837 - protein, 173 aa, Artificial Sequence; identical to SEQ ID NO: 2836
  Synthetic

SEQ ID NO: 2838 - protein, 173 aa, Artificial Sequence
  Synthetic
SRKEDLKRRLEEIIKRLEEVVRRILRTSEESLKDHHEASKRLLEESEKSLKRLEEELKRKDERVIEELVRRHHDLNRRILEDDKRLLEEHHDLNKKLLEAVDKLLKEAEDVLRKLDKDEELRKIEERIRELAKRAREELDKLDKEVRKNHERVKRRLEELDRRAKELVREERR

SEQ ID NO: 2839 - protein, 173 aa, Artificial Sequence; identical to SEQ ID NO: 2838
  Synthetic

SEQ ID NO: 2840 - protein, 173 aa, Artificial Sequence
  Synthetic
SEKEKLLKEIERLIEELRRVVKKAVEDSKESIDRHHERSRELLRRSRESLKDLERRLKDSDESVIEKLVKEHHDLNRRILKEDRDLLREHHELNKKLIDKIRRLVEDVRRKLEELRKDRELEELEKRVRELERRIRETLTRLNEEIEKNHRRVEERLRDLNREAEKLAEEAKR

SEQ ID NO: 2841 - protein, 173 aa, Artificial Sequence; identical to SEQ ID NO: 2840
  Synthetic

SEQ ID NO: 2842 - protein, 173 aa, Artificial Sequence
  Synthetic
SEKEDLSRRLAELLKEHHDRSKKLLDESRDSLRKHHKASRDMLRRSDESLKRLDRVRKERDDEVIKELVKRHHELNRELLERDKKLLKEHHDLNEEIARRDETLLREIRKKLEEADKDEELDRIRKEVKKNHDRARRALEKIDKEAKENHERVREALRKLNEDLEKLEREKRK

SEQ ID NO: 2843 - protein, 173 aa, Artificial Sequence; identical to SEQ ID NO: 2842
  Synthetic

SEQ ID NO: 2844 - protein, 173 aa, Artificial Sequence
  Synthetic
REKEELIKRLKRLIDELRRVVKTLLADLERLLKEHHDRSRRILEESKRSLEELEKTLRRSDERVIEELLKRHHDLNRRLLEEDRELLRRLTEMIDRILEELERLLKELDDEVKKLDKDDELRKLKEELEDLARKARKEIEDIKEKLRRNHERVKKALEDLNRTAEELLDRARQ

SEQ ID NO: 2845 - protein, 173 aa, Artificial Sequence; identical to SEQ ID NO: 2844
  Synthetic

SEQ ID NO: 2846 - protein, 173 aa, Artificial Sequence
  Synthetic
SREEKLLKELKDIIDTLRRRVEEILTESEKSLRDHHRESRKIVEELRKLLEDLRRLLERKDERVIEEILKRLAERIRDLTRKDEKLVEEHHRLNRRLIDEIRKLFEELKEVLDRLDKNRELDKIEEEARELVKRAEEKLREIDKRARDNHKRVRDELKRILDELKKLIDERRK

SEQ ID NO: 2847 - protein, 173 aa, Artificial Sequence; identical to SEQ ID NO: 2846
  Synthetic

SEQ ID NO: 2848 - protein, 188 aa, Artificial Sequence
  Synthetic
SVEDSIDKIDKELEKNSERTKRTIDRIREESRRLIEEIKDRVRRLLREAERTIEDVKRKLKDDERARERIKELEEKVRRLIEKVRRRIKENLDRNDKLLREVEKVDKELNERLKELIKEVEDVLRKTRERRVVEELRERLKRLLEKHHDLMRRLTEDLKRLLEESERDARRLVKELEDALREIREDTR

SEQ ID NO: 2849 - protein, 188 aa, Artificial Sequence; identical to SEQ ID NO: 2848
  Synthetic

SEQ ID NO: 2850 - protein, 180 aa, Artificial Sequence
  Synthetic
SREDKVRELEERLKRLNERLNREVKKVNEDNRRLLKRAEDTARRLAERIRRLLERVDREIDSERLERVRRTVERIERELKRLLDELRKHVRETDEESRKVNEELNEMSERTLRELRKLKDNNVPDEELERRVEELLKRNEKLIREVKKRLEELLRRNEELIRRILEEVEKLLKDLEDKVR

SEQ ID NO: 2851 - protein, 180 aa, Artificial Sequence; identical to SEQ ID NO: 2850
  Synthetic

SEQ ID NO: 2852 - protein, 180 aa, Artificial Sequence
  Synthetic
RREERVKEALERIRRLNKRINERVEEVNRENKRLLDEAKRTHEELEKEADRLLDDVRRKIDSERLERIERKVKEIKERIRESNKRLKEHVEDTDRRSKELNERLNRSSEKTLEDIKRMKDSNVPEEELEKEIRKVLETNRKLAEDVRRDLERLLRRNRRLIEESKKEVEKLLKELEEDVR

SEQ ID NO: 2853 - protein, 180 aa, Artificial Sequence; identical to SEQ ID NO: 2852
  Synthetic

SEQ ID NO: 2854 - protein, 180 aa, Artificial Sequence
  Synthetic
RRDDKVRKLEKELRDSNRKANDESKKLRDELRRLNEEANRRVRELERRIERLLEKVKDDIDSEELERIERKAREVKKTLEDLNRKLNDTSRRSEEELKELNRELNRVVRELEEELRAMLENNVPEEELKKRVEEALEEHRRLVEEVRRRVERILERNDELIKRIEETVEDLLRRLEEEVR

SEQ ID NO: 2855 - protein, 180 aa, Artificial Sequence; identical to SEQ ID NO: 2854
  Synthetic

SEQ ID NO: 2856 - protein, 175 aa, Artificial Sequence
  Synthetic
SEIDEIVKEVERLLEKLKEDSRRTVEEVKKLLDELRKHSEDSVREIEELIERLRREIERDGDTEEVEKKIRDIKRRIEELLRRNEKLVKEIKDRLKKLLDENRERLKKIEKELRDKARAEEKLRRLEEELREILKRSEDLARKLDEDLKRILERTRREIKRLEEDLDRLDEEVRR

SEQ ID NO: 2857 - protein, 175 aa, Artificial Sequence; identical to SEQ ID NO: 2856
  Synthetic

SEQ ID NO: 2858 - protein, 175 aa, Artificial Sequence
  Synthetic
SESDEIIKEVDELIKRLRKHSKETVKEIEEILTRLEERSRKSVKEIEDEIRKLEDIVRKRGNTEEVRELIKKILEDIERMLEENERLAKEVKDRIEKLLRDNERLVRDIKRKLREKLSVEEKARTLERKLDKILEETKREAEELKKRLDELVEKTRRLIEELKRRLKELLDRAET

SEQ ID NO: 2859 - protein, 175 aa, Artificial Sequence; identical to SEQ ID NO: 2858
  Synthetic

SEQ ID NO: 2860 - protein, 175 aa, Artificial Sequence
  Synthetic
DESRKIVRDVEELIKRLEEHSRETVKRADRVLREDHKKSRDSVREIEKLIRDVKDKIDKRGRTEEVEKLLRDIIRKVEKLLEENRRHNRRVKEELKRALEENRRLLEEIKKEIEKKASVEEEVRRLKKELDDLLEETKDLIRRLEEKLDKNVKETEDEIRRLIEELKKILEDATR

SEQ ID NO: 2861 - protein, 175 aa, Artificial Sequence; identical to SEQ ID NO: 2860
  Synthetic

SEQ ID NO: 2862 - protein, 175 aa, Artificial Sequence
  Synthetic
REIDEIVKEIEKILRELKKRSDETVREIERLIEEDHRKSRKSVRDIEKLIDDLRKDVERRGDTEEVKKLIEDIDRRIKELLDRNRKHNTRVLKRIEDLLRENERLAREVEKRLKDDMRAEEKLRKLEEELRRLLEESKREADRLKKELRDNLKTTDELIKELKERLDKLKEDIER

SEQ ID NO: 2863 - protein, 175 aa, Artificial Sequence; identical to SEQ ID NO: 2862
  Synthetic

SEQ ID NO: 2864 - protein, 175 aa, Artificial Sequence
  Synthetic
DESDRIVEEVRRLIKTDHDNSRRSVRKIEELIARDHKKVKEIVDEIRRLIRELEELIRRDGDTREIEKLIRDIEETIRRALEELERHNERVKREVEKMLRDNEEHNKEVKERIRRKLRVKEKLDRLEEEIDKNVKRTREEIERLKRELDKNLEDVRRLAKELEDELRKLDEDAKR

SEQ ID NO: 2865 - protein, 175 aa, Artificial Sequence; identical to SEQ ID NO: 2864
  Synthetic

SEQ ID NO: 2866 - protein, 175 aa, Artificial Sequence
  Synthetic
SEIDRIIEDAERLLRELERNSDRSVEEIEKLIRDDHDNSRRTLEKIEKVIRELRKDVKDRGDTEEVERKIREILREIEELLRRNEKHNREVKERIKEVLRRNKELLDEIKKRLEDRVSSREKVKRLEEELRKILKKTREKAEELKRRIDRNVEETRRRARELKEELDRLLKEART

SEQ ID NO: 2867 - protein, 175 aa, Artificial Sequence; identical to SEQ ID NO: 2866
  Synthetic

SEQ ID NO: 2868 - protein, 175 aa, Artificial Sequence
  Synthetic
DESRKVIKEIEDLLEEWKRRSERMIRESEKLIEELRERVDKILEDIDRLIRTLDELRKAGVPREEIRKLAEEVRKRIEDLKREIKKLAEDIKRTDEKLLKESRDIVRKIEEIIRRKLSVEEEAKRLKDELEEILKESEDLSRRTKKELEDLLREVEKEIKKLEDKLKKLLDETDK

SEQ ID NO: 2869 - protein, 175 aa, Artificial Sequence; identical to SEQ ID NO: 2868
  Synthetic

SEQ ID NO: 2870 - protein, 175 aa, Artificial Sequence
  Synthetic
SETEKVIREIEKLIDDIRKESERSIEESRKLLKELEEIVEKAIRDSRRLLEDLRRLVEDGVDRDEIRKLAEEVERSDRELVKRIEDIARELKKRDEELLRENEKIVRTLEETIKRELSSEEKADTLRRKLEKLLEDTKRMSEKTKKEIEDLLKRVRELSEETKRRLDRILEDVER

SEQ ID NO: 2871 - protein, 175 aa, Artificial Sequence; identical to SEQ ID NO: 2870
  Synthetic

SEQ ID NO: 2872 - protein, 175 aa, Artificial Sequence
  Synthetic
SESDKVVKEIEELLRELRKRVEEIIRESEALIETLKKRVDDAVRESRKLIKDLRELIERGVPEKDIRKIAKDLEEKNKKLTDEIRRLAEELRDRDRRLLEEIEKLLRDIERTVDRKLSVREKAKKLREELRKLMEEVRRLSKETKDKLDELLKTVEELSKELRERLKRLLDEAET

SEQ ID NO: 2873 - protein, 175 aa, Artificial Sequence; identical to SEQ ID NO: 2872
  Synthetic

SEQ ID NO: 2874 - protein, 175 aa, Artificial Sequence
  Synthetic
SESDEVAKRIKELIDRLEERSRRSIRESDRLIKELEKEIEKAVRESEKLIRDLEELIRRGVDTREIEKLARELKKRNDDLTRKIEDIARKLKKRDEELLKENEDLVKEIDDSIKAALSVEEKMRTLEEDLKRLLEETRDMSRKTKEKLEELLKRVRDLSKKLAEDLRRLLEEVRR

SEQ ID NO: 2875 - protein, 175 aa, Artificial Sequence; identical to SEQ ID NO: 2874
  Synthetic

SEQ ID NO: 2876 - protein, 175 aa, Artificial Sequence
  Synthetic
SETDEVIKTLEELLERIKRRVEELVKRNKDLIKALEEEVRRIIKESKKLIDDLAELAKEGVPKKDIEKIARDLEKRDEELLDRIRKLAEELRRRSKKSLDEVRKIVRELEEEIDRRLSDKDKADRIREEIRKLEEEVKRLHDELKKELDDLLRRVEEDSKRTKERLRKLLTDVKK

SEQ ID NO: 2877 - protein, 175 aa, Artificial Sequence; identical to SEQ ID NO: 2876
  Synthetic

SEQ ID NO: 2878 - protein, 179 aa, Artificial Sequence
  Synthetic
SEVDDLIRRLEKLLEDIKRRVEELVRRDEKITKDWERESERLIRELEELLKTIADLVRRRKESKEEVEKVIRDAERKIREILETSKELLRRSKKHTKEVLEEVERLIDEARKMIEEVRKRNVDKKKLDEIRKRLEEILKRVRELLERLDRENEDLARKSKELADRIRKELKRILDEVRR

SEQ ID NO: 2879 - protein, 179 aa, Artificial Sequence; identical to SEQ ID NO: 2878
  Synthetic

SEQ ID NO: 2880 - protein, 179 aa, Artificial Sequence
  Synthetic
DEVDELVKELEESLRRSREEIERLVREDEELTKTIREEVKKLVKTDEDLSKKIEDTVRRRREADEKIKEMIDRSKKHTDEVLERVEELIKRSKDHTKEVVDRVEESIKRNDERLDEIRKRNVDKDKIKELKERNDKLLEEARRLAKELKERNDTLLKEVREELRRLRERNDRILKEAKK

SEQ ID NO: 2881 - protein, 179 aa, Artificial Sequence; identical to SEQ ID NO: 2880
  Synthetic

SEQ ID NO: 2882 - protein, 179 aa, Artificial Sequence
  Synthetic
DEVDKLIRDLEELIRRIRKRLKELVDRDRELTREIRRRIRELIEESKEALERIDKRVKERKEVREEVEDLARELKRLNDEVLKEIEDLLRESKKHTDDVRREVERLIKEIREKLEEIRKRNVDKDKIKKLKDDLDRLLKEAEDRLRELEERNKRLLDEARKEIEKSDRRLEEILERVRR

SEQ ID NO: 2883 - protein, 179 aa, Artificial Sequence; identical to SEQ ID NO: 2882
  Synthetic

SEQ ID NO: 2884 - protein, 179 aa, Artificial Sequence
  Synthetic
DEVDELIKTLKKLLEDIRERVERLVTDSKRSLDEIRETVRDLVRRDKELLKRIEDTVRERKEVREEVEELIKRSEEHTEDVERRVRKAIEEHKRLNDEILREVEELIKRIEEAIREVAKRNVDKDKLEKIKRDLEKILTEVREALRELDERLKKLAEEAKRLLEELRKRNRDILEKVRK

SEQ ID NO: 2885 - protein, 179 aa, Artificial Sequence; identical to SEQ ID NO: 2884
  Synthetic

SEQ ID NO: 2886 - protein, 179 aa, Artificial Sequence
  Synthetic
DEVDKLIKEIEESLRRSEKEVRDLVRESERSLKEIEKRVRELVKRDEDLLKEIEEVVRKKKEAREEIEEMAKRSEEHTEEVRKEVEELARRHKERNKEILKRIRESMKRNDELIDEIAKRNVDEEKLKRLRKENKDLRDRVEEELRRLDKELDELLETVRRLLDELRKRNKKLLDEARK

SEQ ID NO: 2887 - protein, 179 aa, Artificial Sequence; identical to SEQ ID NO: 2886
  Synthetic

SEQ ID NO: 2888 - protein, 179 aa, Artificial Sequence
  Synthetic
RLEEEIERLRREVEELIERSKDLIRRSHTKSRKLIEDVKRELDRLRREVEELIKRAEDRTRREEVDKKLKDLLRELEKILEEIDRNIRRNMKENEDLNRRWKEVTEELLKELEEILKRIRDRVEDRVVREAEKLIRKIAEDNRKALEESDELIRRSEKDVRDMVRRAEELIEEIKRRVD

SEQ ID NO: 2889 - protein, 179 aa, Artificial Sequence; identical to SEQ ID NO: 2888
  Synthetic

SEQ ID NO: 2890 - protein, 181 aa, Artificial Sequence
  Synthetic
SKDEEVERLKEELDRLLEEVRRLSEESKKRNDELLKRAEEIIEELKKELDEIREEVERRGLPEEKLERIERLVKRIKERIEDLLKKSREEHEKSKRRDEELLRRLEEVAKEVKRRLDEMARKGEDKDTVVRRAKKVIDELRKDVERVKRESDEVLKELEKLNREIEREVRKLLKELRDTVR

SEQ ID NO: 2891 - protein, 181 aa, Artificial Sequence; identical to SEQ ID NO: 2890
  Synthetic

SEQ ID NO: 2892 - protein, 181 aa, Artificial Sequence
  Synthetic
RSEEEARKLERENKKLVDDARKLSEESRRRNDKLVEEARRIAEELKRELDRLLEEVDRRGLPEERLRDIRRLIEEIKRRVEELLRRSKKMHEDSKKRDDDLLRRSEELHEEIRKAIEKMRKDGEDTKTVVDRVKKLLDDLREVNREILRESDKVLRDLKRLNDEIKREVEELLERLEREVR

SEQ ID NO: 2893 - protein, 181 aa, Artificial Sequence; identical to SEQ ID NO: 2892
  Synthetic

SEQ ID NO: 2894 - protein, 181 aa, Artificial Sequence
  Synthetic
SAEEDAERMKDRNRRLLEKVRRLSEESKRRNDKLVEDAKKLSEDTRRKLEDIARKVRKRGLPEDKLRRIEELVKEIEKRNRELTKRSEDAHRESKKRDEKLLRDSEKRHREVLKRIEDLLRRGEDKDRVSEEIDRLLRDLERRNREILKESKEVLDRLKKLNEEILKESEDLLRRLEEEVR

SEQ ID NO: 2895 - protein, 181 aa, Artificial Sequence; identical to SEQ ID NO: 2894
  Synthetic

SEQ ID NO: 2896 - protein, 176 aa, Artificial Sequence
  Synthetic
SEIEKVVKDVDKLLKELEDHTRKSLEDSKRLLDELRKHTEDTSREVKELLERLEEVIRRNKEMKEELRRIAKKIDEDIKRLVERNKKIADDIRREDKKLLDRNRELVDRIREEIDRRIRSKEDADRLRERLDRILEESERLSRETKEELDRLLEDSKRKIRELEERLKKLLDDAER

SEQ ID NO: 2897 - protein, 176 aa, Artificial Sequence; identical to SEQ ID NO: 2896
  Synthetic

SEQ ID NO: 2898 - protein, 176 aa, Artificial Sequence
  Synthetic
DDSDKVLKELEKLLEDLERHTRESLRESDELLKELKEHTKTTLRRSERLLRELKRLVDENKEAVERIEEAARRIEEEDRKLLKRNEELVREIEKRDRELLERNRKLAEEIKEAIRRKVRVEKDVEEVRRKVEELLKDSERLSKETKERLRDILRDSRRLSRETKEELKRILKEVRD

SEQ ID NO: 2899 - protein, 176 aa, Artificial Sequence; identical to SEQ ID NO: 2898
  Synthetic

SEQ ID NO: 2900 - protein, 176 aa, Artificial Sequence
  Synthetic
RESEEVIKEVEKLLEELKENTKRTLKESRDLLKTLEDHTRETKKTVEKMLKELEDKVRKRKESEEEIRKVVEDIKREIERLARENERIAREIEERDRELLDRNRKLAEDIEEKIRRKIRVEEEADRLRRELKKILDRSRELSRKTKEDLKKLLKESEDIIRELDRRLEEILKEVER

SEQ ID NO: 2901 - protein, 176 aa, Artificial Sequence; identical to SEQ ID NO: 2900
  Synthetic

SEQ ID NO: 2902 - protein, 176 aa, Artificial Sequence
  Synthetic
EEIERVIKEVKDLIEELRRNTERTLRESEELLKTLKKISDDSKEEVERMLRELRELVKSNKEAKEEIRKVADRIRKVIKRLMDENKKVADEIRKRDEDLLDENRKLIDRIRREIDKKIRSKEDADRLRREVDKLLEESKRLSEETKRELDRILEETKRTLERLKEELDKILEEVER

SEQ ID NO: 2903 - protein, 176 aa, Artificial Sequence; identical to SEQ ID NO: 2902
  Synthetic

SEQ ID NO: 2904 - protein, 174 aa, Artificial Sequence
  Synthetic
SEKEKLVEEVRRIIERHKRVTEELLKELRRILKEWEDVSRDIERRVREILERLERAARDGEDKRLVRELVKDIERLLKKLLDDSKKIVKEIDEVLKELLKTDEELVRRIREKLERADKDKDLEELKKELEDSARRSKKLADDVREELKTLLRESERIIKELRKELEKLLREVEK

SEQ ID NO: 2905 - protein, 174 aa, Artificial Sequence; identical to SEQ ID NO: 2904
  Synthetic

SEQ ID NO: 2906 - protein, 178 aa, Artificial Sequence
  Synthetic
TLEEVLKEVKRRVERVNEEDKRVLDESRKRAKEINDEDRRLLEESKRKAEELLERLRRKDKDAKEVEEKIKRVLEELAREHEKINERIKEEVKRLEEEHKKINERTKRLLEDLKRLVESGLDEDRLRREAERILREIRELSRELKRKNEELLRTIRRVSEELRKKNEEILERVDREIK

SEQ ID NO: 2907 - protein, 178 aa, Artificial Sequence; identical to SEQ ID NO: 2906
  Synthetic

SEQ ID NO: 2908 - protein, 173 aa, Artificial Sequence
  Synthetic
SAKELLDDLRKKIEDNVRETEKLLRRLREKVEKIEREIKELVRKLREDLERLLEKVKRRGVEEEVERLIREIIKKIEELVKRLEELLKEILERIEKLAEDNRRHNEEVKKDIDDKRIEKEVVDTVRELIERDHKKSRDSVRRVDELIDRARKDVRRVVEEVRKDLEKLDEDVK

SEQ ID NO: 2909 - protein, 173 aa, Artificial Sequence; identical to SEQ ID NO: 2908
  Synthetic

SEQ ID NO: 2910 - protein, 175 aa, Artificial Sequence
  Synthetic
REVEEVLKDLKRLIDEAKKRVEDAIREIDRLIREWERLNREMLREIKKSNDEVRELVKAGVPKEDIERLLREDNKLIEELLRRSEEIARDIERKIRKILEDLKRIIEELKKRVKDALRVEEAVRDVERRLEKLLKEIKDLIDRLKEKVDRVKREVERSIEELKRHNEEVLKEVRK

SEQ ID NO: 2911 - protein, 175 aa, Artificial Sequence; identical to SEQ ID NO: 2910
  Synthetic

SEQ ID NO: 2912 - protein, 175 aa, Artificial Sequence
  Synthetic
KEVEDVLEELDRLIETWARLNRELVERIRRLLEEWREENRKVVEEVRRSNETLRELVERGVPKEDIRRLAKEDNERIEELLKRSRKIADDIRRAIEEIVRRSREILRELEKRVDDKLRVEEVVRRVKDKLREVKREVEETARELRERVDDLLRKVEESVTRLKRHNEDLLREVER

SEQ ID NO: 2913 - protein, 175 aa, Artificial Sequence; identical to SEQ ID NO: 2912
  Synthetic

SEQ ID NO: 2914 - protein, 175 aa, Artificial Sequence
  Synthetic
SEVEEVLRDLKRLLEEWKKRNEDLVRDVERLLREWKEANDRALKKSRDSNKELERLARDGVPEKDVEELAKRDNEENKRLSEESARIVERIREKIEEALKRSTDIVREIEKRVEKALRKKEMVERVRREIKRLEEEVKKTITDLKERLKKLKEDADRSSRESEEHNKKVVEDVRR

SEQ ID NO: 2915 - protein, 175 aa, Artificial Sequence; identical to SEQ ID NO: 2914
  Synthetic

SEQ ID NO: 2916 - protein, 175 aa, Artificial Sequence
  Synthetic
REVEEVLKELDRLIDELRKEVEKIVREVERSNDEWRRRNKELVDEVRRELDRLRKLVDDGVDKKDIRRLLDEIRKLIERVLKESRDILRKDNERIKELADRIRRLVEDLERKIEEKLRVKEVVDDVKRKLEDLKRRVDELVRRLEEHNKDLRRKVEESAKDLRRKLEELRERVER

SEQ ID NO: 2917 - protein, 175 aa, Artificial Sequence; identical to SEQ ID NO: 2916
  Synthetic

SEQ ID NO: 2918 - protein, 176 aa, Artificial Sequence
  Synthetic
SEKDEVRKTIERLLKEVEKMIRRVLKEVEDLLRELKKRTEKLKRELDESHRRVKEVIERRKEDRDLLRRLIEENERLIEEAKRELDEVDERVRRRIEELLKELEKIVRDVEDMLRRLNLPRELLEEVERALKKLKEDVDKVIEELREKLKRHHEDVKRAIDRVREESKRLKDEAEK

SEQ ID NO: 2919 - protein, 176 aa, Artificial Sequence; identical to SEQ ID NO: 2918
  Synthetic

SEQ ID NO: 2920 - protein, 176 aa, Artificial Sequence
  Synthetic
REDEEVVKTLRELLREAKERTDRLLRELREIIKTMRKRLRDIEEDLRRSHREIEKLIRDRKEKREELRDIVRRNDELIRRLTEDLERLIEEARKVLKDIERDLERVDEELEDTLDKANLKRELLEEVRKELERHHREARRAVEEVKKLIDDLMREVRKLIDEVRKDSERLRREVER

SEQ ID NO: 2921 - protein, 176 aa, Artificial Sequence; identical to SEQ ID NO: 2920
  Synthetic

SEQ ID NO: 2922 - protein, 176 aa, Artificial Sequence
  Synthetic
DEDEEVKRRLEKLLEDADRVTEKIRKDLKETHDRVKRAIDELKKELEKSHRTIKEVIERRKEKRKDLTKIVRDNERLIEEVKKRLEELIRKNEEIIKELEKELKKIDDDLDKKIKDANLKRELVEEVRDRLRKHHKKVRDIVDDVDKRSKDLERTARRVIEDVKEKSDRLKEEVDR

SEQ ID NO: 2923 - protein, 176 aa, Artificial Sequence; identical to SEQ ID NO: 2922
  Synthetic

SEQ ID NO: 2924 - protein, 174 aa, Artificial Sequence
  Synthetic
EDEERVKEKLKRLLEKAEEALRRSKRRNEENKKEHERVLKEIDERLKRLEEKVRRGNLERRTVEEIRRILEDIKRKLDKLTKESEDLHRRNDERVKEVFRRIEKLIRDIEEDIKAGRSREDIERLLKELDDRIRRIIEELKRSDEELHKENRRKIKELEDLVREADKRIEDKRK

SEQ ID NO: 2925 - protein, 174 aa, Artificial Sequence; identical to SEQ ID NO: 2924
  Synthetic

SEQ ID NO: 2926 - protein, 174 aa, Artificial Sequence
  Synthetic
DDEKEIKDRLDDNKRKDDEMTKRAEDELRKNLETTKEALRDIKRKLDRLREKVERNNLDEKTLKEIEDVLRTIEEEARRLLEDSKRVHREIEERMKRLNDDSKRVHEDIKRALDGGVRREELEKIVRDLHKRNKEVIDDIRRLIDELHKRDRETIKRLEEIVRRADEKIKEKAR

SEQ ID NO: 2927 - protein, 174 aa, Artificial Sequence; identical to SEQ ID NO: 2926
  Synthetic

SEQ ID NO: 2928 - protein, 174 aa, Artificial Sequence
  Synthetic
SDEERIEERLKRNEETDKRATDENEKRNDDLLRRAKEALDRNRERNDELRDKVRKENLDDETVKRIEKLLRDNDRRLKELLRELEKRLRDNREKLKELNKESKKRHEEVRERLRAGVRREELSKLVKELHDDNREKIKDSDRSDDDIRREIERMIRETNKSDEDIARAIDESAR

SEQ ID NO: 2929 - protein, 174 aa, Artificial Sequence; identical to SEQ ID NO: 2928
  Synthetic

SEQ ID NO: 2930 - protein, 174 aa, Artificial Sequence
  Synthetic
SERERVEERLKELAKRVEDAIRRLKKDLERTKEEHKEADRRVKEKLKRLKEEVDRANVDEDLRRKIEELLKRAKDENKKLNEEVERILRELEKRYEELKRRIDRLLDTLRKKLEEGTRDTEVEELLKDVKRKIEEMIKELKRLNDELNKRSEEMIRRNDDLIKRLEEEIRKDSK

SEQ ID NO: 2931 - protein, 174 aa, Artificial Sequence; identical to SEQ ID NO: 2930
  Synthetic

SEQ ID NO: 2932 - protein, 176 aa, Artificial Sequence
  Synthetic
SSEDEVRKTVDELRERSERTIRDLERVDRELKKEHEELIKELREIVKELREKVKRASKEPTSEREIERLKEELERTMRELHKKNKRVREKHEELLEELRRRNRKLNEEVKKTVREMRDKVDKRIEEELRKLHKENKEAVERSERTNRDILRRNDEADKEIEKELRELIEKLERDRK

SEQ ID NO: 2933 - protein, 176 aa, Artificial Sequence; identical to SEQ ID NO: 2932
  Synthetic

SEQ ID NO: 2934 - protein, 175 aa, Artificial Sequence
  Synthetic
SEKEDLKEKLKRNEEEHRRAVEEIRKRLDENRRRHEKVIKEIEDALKKDEDDVDKENLDEELRKELKRLHDEIRRRLEELNRRSKKRHKEVEDKLRRLDEESEKMHRRVEDLIRRGELDKDELTREIEKLHRTNREMVRDLRETLKRLHEENKRLVDELRRLLEELHRRTREASR

SEQ ID NO: 2935 - protein, 175 aa, Artificial Sequence; identical to SEQ ID NO: 2934
  Synthetic

SEQ ID NO: 2936 - protein, 174 aa, Artificial Sequence
  Synthetic
SEEEEVRKALERLRRELKRVLERSEELLKEWEDRLRRVLEESRRLLERWREELEKDGIDEDVLRELEKDIKKVKEDHDRDAEKLRRIIEEIRKRHEEVFRRLEDLLRKVRERLERGRRREELKEILKRLEDTLREIEKEAKRLNDELARVLEEIRRKSERENRRLKELIDRLRK

SEQ ID NO: 2937 - protein, 174 aa, Artificial Sequence; identical to SEQ ID NO: 2936
  Synthetic

SEQ ID NO: 2938 - protein, 171 aa, Artificial Sequence
  Synthetic
SDRERLEEMLKRLKEELEKVRRDNERSLEEIKRSVDRVLEEHKRTLEELKREVDRANVDEDLKRELKELLEDSKRRVEELKEKHERLLRKNKKELDELKKRLDDLLKKIRDDDVRGEEADEVVKRLADVLEKAREDLKRSDKRLRDSNRESRKELEKINRDLRRKLEEAKR

SEQ ID NO: 2939 - protein, 171 aa, Artificial Sequence; identical to SEQ ID NO: 2938
  Synthetic

SEQ ID NO: 2940 - protein, 171 aa, Artificial Sequence
  Synthetic
KDEERLETVLREIETRAEKVARDHRDSLRRIREELERVLKENKDTLKRIREELEKTNVDEKLKTEADRLEEENERRLRELEKELDELLKRSEDTLRKLLKELRELLKRVRDRQVRGEEVKRVLKELRDLLEEIRKRLEDINRDLKRKLDEIEEELRRSDEKLKRDLEEARK

SEQ ID NO: 2941 - protein, 171 aa, Artificial Sequence; identical to SEQ ID NO: 2940
  Synthetic

SEQ ID NO: 2942 - protein, 171 aa, Artificial Sequence
  Synthetic
SDEDKLREDLRRLEEELKKVLDDHRKSLKEIEDSLRRVLEENKRTLEKLKRDAEKANVDEELLERLKKLLDDNRKRVEELEERHRRLLKESEERLRRLVEEFKRLLEKIERDQVRGEEAKKVVKALEDVLREIRERLKRINDELRERNKKSSDELRKSDERLKRELDKMRK

SEQ ID NO: 2943 - protein, 171 aa, Artificial Sequence; identical to SEQ ID NO: 2942
  Synthetic

SEQ ID NO: 2944 - protein, 183 aa, Artificial Sequence
  Synthetic
DADKELEKLLREWEKRSEELRKRLEDINRRWEEESKRLKKELKDINADLRRKVEELRRDEDKDRVREVVKRLSERNDEVDRKVKKTSEDIADRNRREDKKIREDSKKIKEDLERALEELREKVSSDVIRRAKEELDRIEKKDRDVLDDNRRLIETWRREDKKVNDDNRRSNEELKRELDKTRE

SEQ ID NO: 2945 - protein, 183 aa, Artificial Sequence; identical to SEQ ID NO: 2944
  Synthetic

SEQ ID NO: 2946 - protein, 183 aa, Artificial Sequence
  Synthetic
SAEEELKELLERWDRDSKRAEEELRRLLEESRERSEKVLRDLKRLLDEMEDAVRKLKRDSDKDRVRRTVEELTKTVRKKLEEIERRTREIKKELERTLKRIEERSREIKKDLERSLERLRKDVSSEVIERFKDVLRRIEKRNKEVIDRAKEVIDEDEKRNREVIERVERKVERLRKEVEDREK

SEQ ID NO: 2947 - protein, 183 aa, Artificial Sequence; identical to SEQ ID NO: 2946
  Synthetic

SEQ ID NO: 2948 - protein, 184 aa, Artificial Sequence
  Synthetic
EEKERMREVLKRLEEEAKKVLDDNRRAVEEIEKKDREVHKRNRDLLERWREEMEEILRKARERVDKEDLDRLEETLRRLIEDNRRKDEEIRKVSEDVKRDNRKKNEDIKRRLEELKKTVADVERKNSREEELKKIIERAREELEKVRRELEEHLKRWDEISKKLSKDLERHNEEVARTLKRSRD

SEQ ID NO: 2949 - protein, 184 aa, Artificial Sequence; identical to SEQ ID NO: 2948
  Synthetic

SEQ ID NO: 2950 - protein, 181 aa, Artificial Sequence
  Synthetic
SVLEEFKKRIEELHRRDRKVLEDHRRRLKEWEEELKRVLDEHRESLKRIKERVDRVKKDLDDEELKRVDKKLKDLEKKSRDLVREVEKILRELRKRSKDAEDKVKKVNEDVRRRAEKLARDLREDSDALRELLREWDKLSKELEKELRDLNREVERSIREAKKKLEKANEEMRRTLEKDRK

SEQ ID NO: 2951 - protein, 181 aa, Artificial Sequence; identical to SEQ ID NO: 2950
  Synthetic

SEQ ID NO: 2952 - protein, 181 aa, Artificial Sequence
  Synthetic
STEEDAERALEELKEELRRVEKENRDSLKRIREKLKEVEDEHRKTLEELKKELDDVMRKIKDERKKRKVEKLRRELEKAKRDSEKLLRDLERKIDEVEKTSKKMLEELERDLRKILDDVRKAKLDKDSLKRLLDEARKKLEELKRRLEKLDRDLDESLKRLKEDLDRLDRELRRLLDELDK

SEQ ID NO: 2953 - protein, 181 aa, Artificial Sequence; identical to SEQ ID NO: 2952
  Synthetic

SEQ ID NO: 2954 - protein, 181 aa, Artificial Sequence
  Synthetic
SVEEEARKALDDLRRRLEEVTRRHRESLKELREELDEVRKENEKSLKKIKDDLEAVRRRITDERKKRKVDEARERIKEVEERSRRKLRRLEEEIDKAEEESERLLETLKEELKRLMDEVEKAKRDEEELRRLLKKLEDDLRRLKKRLDELDRRLRELVKRLLEDLKRLDDELKKLLEETER

SEQ ID NO: 2955 - protein, 181 aa, Artificial Sequence; identical to SEQ ID NO: 2954
  Synthetic

SEQ ID NO: 2956 - protein, 175 aa, Artificial Sequence
  Synthetic
SAEEELKRLLEEHKKESEDVKRRLRDLLRELEDIHRRMTERLRELLKRLDDILRRRNSDDETLKRLVDELRKEIKKVEDDDHRNLERLREELRRLEEDLKRRNEETKEEVDRVRKKGSLTEEILKKLEEISRRVREKVKKELDELKELIRRHARKLEKILEEIRRLIEDLERRAR

SEQ ID NO: 2957 - protein, 175 aa, Artificial Sequence; identical to SEQ ID NO: 2956
  Synthetic

SEQ ID NO: 2958 - protein, 184 aa, Artificial Sequence
  Synthetic
SEAEEVLKRIRDILETLRREHERILKEIRELNEEFKKEVEKALRKIKRELEELEKDAEREGTTEELRKKVEKLLRDIKETLRRLEEKSRELEERIRELLKRLHETVRTLEERIKDLREELRERVDERVEKKIEELLREIRKVNDEVHKRIRKLLEDHRRTVDEARRRIEELLRRLKKTLDDIDK

SEQ ID NO: 2959 - protein, 184 aa, Artificial Sequence; identical to SEQ ID NO: 2958
  Synthetic

SEQ ID NO: 2960 - protein, 181 aa, Artificial Sequence
  Synthetic
SDKDELKRLLDDHERTSTRARESLEKLSREHRKTSREVEERLKRLVDAIRDTARRVDSRRREVEETLKEIEKRLRELKRELEELDKEFEDSVRKLKRELERLNEEVRKRVEDLKRRMAEGTDEEVVRRILRELRELNERAKEMLERILRKLEELNREYKKKVREILERIKELLRDLRRKAN

SEQ ID NO: 2961 - protein, 181 aa, Artificial Sequence; identical to SEQ ID NO: 2960
  Synthetic

SEQ ID NO: 2962 - protein, 181 aa, Artificial Sequence
  Synthetic
SADDEIRKLKKEAEDILRKAREDRERLKEKNRKIDEDMRRTLKKLHEETRELEKKVRREKGEDERVKELLDDLRRKDDDMRKRVTELHEENKKIDDEVRREVERLEEEIRDTIRKLDEDVKRDGVTEELVKEIRELLRRLEEKIEELRRRYEKKLEELKRKVDELIRRYKRKLERVAEEVK

SEQ ID NO: 2963 - protein, 181 aa, Artificial Sequence; identical to SEQ ID NO: 2962
  Synthetic

SEQ ID NO: 2964 - protein, 175 aa, Artificial Sequence
  Synthetic
SEEEELVRRVEEKIKASEKHARELVEETRKKLDESRKKWKDLARRSRRLLEELKDKVDKGTDKKRLAEEIKRVLDEHEDENRKLADEDRELRKRHKEKNKEHEERNRRLREELERRLDETEELRRLEKELRDLNKRVKEESRKLEEDLKDIHERAKEDSKRLKRELEKIKEEVER

SEQ ID NO: 2965 - protein, 175 aa, Artificial Sequence; identical to SEQ ID NO: 2964
  Synthetic

SEQ ID NO: 2966 - protein, 181 aa, Artificial Sequence
  Synthetic
DAERILRELEERLKRLLDEHREISKELRKRNKDLLKEHKERSKRVKEELKELVKEVEDGGKPREDVDRLRKSAEKVEEELDRMDEEFERDNRELDRRLDELDKEIEELVETVRERLERAEERGEPIEELVKEVEKLIKELREKSREVEREVDKMIRDNARKSEKIVRDAKRLLEKLEREVR

SEQ ID NO: 2967 - protein, 181 aa, Artificial Sequence; identical to SEQ ID NO: 2966
  Synthetic

SEQ ID NO: 2968 - protein, 181 aa, Artificial Sequence
  Synthetic
RSEDILRELRERVKRSEERHEKISRDLERKNRELLKEHRERSEKLKRELEELVKRVEDRGLPEERLKELRKIAEEVDRELEEMDRRVEEMNERLDRRLEELDDENRKKVKEIKRKLDEDAKRGEEAEDLARRVDETIKDHERHSEEVKRDVTEKIKENEKLSRDIVRRVEKLLRDLEREVR

SEQ ID NO: 2969 - protein, 181 aa, Artificial Sequence; identical to SEQ ID NO: 2968
  Synthetic

SEQ ID NO: 2970 - protein, 181 aa, Artificial Sequence
  Synthetic
SREDILRDLRRRLEELLRRHKRISDELRKRNKKLLDDAEKRAKELREELEKLVREAERRGLPEEELKRLKEIADEVKKRLDELVKELRRDNERLDKTLDDLNREVEELVRRVEDELRRAAERGEEIEELVKRVDKLIKELKRKSEEVMKRVDELIRRNERLIREIVKEVEKLLEDLEREVR

SEQ ID NO: 2971 - protein, 181 aa, Artificial Sequence; identical to SEQ ID NO: 2970
  Synthetic

SEQ ID NO: 2972 - protein, 181 aa, Artificial Sequence
  Synthetic
SAEETIERLKEEIEKLLREAEEILRRLRERNRRLLEEHKDISRKLEEELRKLMEKVRRGGLPEDRLRELERRLKEVEDRLKDLNRKVEEKNKELDRRLDKLAEELKKEIRDVERELDDLRRKGTEVEELVRRVRELIKRLRDMAKEIEERVDETIRRNRRLSEKVARDVERLLRELEERVR

SEQ ID NO: 2973 - protein, 181 aa, Artificial Sequence; identical to SEQ ID NO: 2972
  Synthetic

SEQ ID NO: 2974 - protein, 181 aa, Artificial Sequence
  Synthetic
DAERILKELEERLDRLSEEAKKILDELRRENEELLREHDERVKKLKEDLKRLEKKVEDGGLPEERLDRLRKLVEKVRKRLEDLNKRTRELNKELDERLERLLEELKRTIEKVKDELRKEAEKGTEVEELVKRVTKLIEDLRRLAKKISDEVRKLIEENRRASKRVEDEARELLKRLEDAVR

SEQ ID NO: 2975 - protein, 181 aa, Artificial Sequence; identical to SEQ ID NO: 2974
  Synthetic

SEQ ID NO: 2976 - protein, 172 aa, Artificial Sequence
  Synthetic
SEIEKMVKDVRDLLKRLKDEVKKISERWEDSLRKLKKRSEDTVKRVKEILEELRRRNLPRDEVREEVKKIKEELDRLNEEFKKRNEEDRRDLERAAEEIKKLLKDIEDELRRRLRKRDALRELERELDKLRKEIKKELDRLRKENREVNERHKELSKRLEEELERVKRELDT

SEQ ID NO: 2977 - protein, 172 aa, Artificial Sequence; identical to SEQ ID NO: 2976
  Synthetic

SEQ ID NO: 2978 - protein, 176 aa, Artificial Sequence
  Synthetic
DEVRELVKTVKKVLDDIRREVEETLRRYEKLVEDLKRRSDKSVKDVDDEIKRAEEEGDKDKELIDRIREEMEDLKRKHEDEHRRIEEELKRLNDEVKKILDELRERLKRLDEDLRRKRLDEELIKRLREEAEKLIRRAKEEHERLEEESKRLLEENEELLDRLDKKVRTLLDKLEK

SEQ ID NO: 2979 - protein, 176 aa, Artificial Sequence; identical to SEQ ID NO: 2978
  Synthetic

SEQ ID NO: 2980 - protein, 179 aa, Artificial Sequence
  Synthetic
SEEDRVRETVKKLLEDHRRKTEKVTEDVRRLLKENREKVEDAVDKARKLLKRLEELRREGELSEDDLRRVIEEIKRRIDEVERRLRKHHDDIRRTLEELDRDNDETLRRIEKELKRLVDEKVDDEKLKRIEEELRKSRERTKRLLEEIRKELEDSKKEVEDLLRRLREELKRLKDEIER

SEQ ID NO: 2981 - protein, 179 aa, Artificial Sequence; identical to SEQ ID NO: 2980
  Synthetic

SEQ ID NO: 2982 - protein, 182 aa, Artificial Sequence
  Synthetic
SEVEELVKRAEELIRELKKLSEDSVRELEKLLDEYRKTTEKLKRELEELLKEVEDVVRKLRDQDDDEKIRKTAEELVKRLEDILRKLEEVNREKKERAKRLLEKHEELLRRLDRRLEDLRRKIKVDEKLLRKIEEDVRRLKETNERLLKRVDEELKRLDEESRRVLKEAKERLKELKDRERK

SEQ ID NO: 2983 - protein, 182 aa, Artificial Sequence; identical to SEQ ID NO: 2982
  Synthetic

SEQ ID NO: 2984 - protein, 178 aa, Artificial Sequence
  Synthetic
DEVEKVLDELEKVIREVEERIKTTNKRLREVVERVERRIDKSDRELEEMIERVERKLEDDERARRLIERLRDLLRRLRKRSKELIDELRKLLKDLEDRSRDLLRELRELLERIKRKVEAGTPSEEVRKEVRRLDKRVKEIVEESRKLVKELAERVEEIVEESKRLVEKLAREVDETRR

SEQ ID NO: 2985 - protein, 178 aa, Artificial Sequence; identical to SEQ ID NO: 2984
  Synthetic

SEQ ID NO: 2986 - protein, 178 aa, Artificial Sequence
  Synthetic
SEIEKALKEAREAIEDAKKKIDDTDRENEKASRDAERRIDKSDKEAEEAVRRAEEEAEDDERARKLIEDLRKLLKELKETSEKLKEEIRRSTEEHRRRSEELKKELEKLADEIEKAARAGRDKDEVTKAARKAADDAREAAERSRKLAEENARRAKKAADDSRKLARELAKEAKKAAD

SEQ ID NO: 2987 - protein, 178 aa, Artificial Sequence; identical to SEQ ID NO: 2986
  Synthetic

SEQ ID NO: 2988 - protein, 175 aa, Artificial Sequence
  Synthetic
KELEDVLDTVRRAIERVKRESKKINDELEKELKKVKDELDKSHEEVRRAVEDVARKLKDVEEVKRDLERLLKEDRELIKRIVDRLRKLLKESKDHSREVVKDLRRVLEELRKLVEEGLDVKDIEKLVRDVVRRAEKVVDDDRKLVRDIVRDAKRVVRDSERTVRDIVKKADENTK

SEQ ID NO: 2989 - protein, 175 aa, Artificial Sequence; identical to SEQ ID NO: 2988
  Synthetic

SEQ ID NO: 2990 - protein, 175 aa, Artificial Sequence
  Synthetic
SKLEKILKDLERAVREVARELERTHRELEEAVKKVKKRLEDTNRRLTEALKRVKDKLDKVEDVKRKLDKLNEDDRRLIREIVEELRRLLEENKRKLDKIEEDLRKLLEDLDKLVKDGLDVSEIKKLVDDIVRRLRKVVKDSEREVREIMKRADDVVRTSEKTVEDIVKEAEDDAR

SEQ ID NO: 2991 - protein, 175 aa, Artificial Sequence; identical to SEQ ID NO: 2990
  Synthetic

SEQ ID NO: 2992 - protein, 175 aa, Artificial Sequence
  Synthetic
SELEEAAKRAREAAKKAKEALKRSLKEAEDAAREAEEDLKRSNDKNRKATREAEERAKTARELLKRLRESTKKHEEDTKKLAEDIRRLLEELRKRSEELAREIDKLLEDLERLIRAGLDAEEAKKAADDLARKAKEAADESKRLSEELAKKAKEAAKTSDKLAKENAEEAKKAAK

SEQ ID NO: 2993 - protein, 175 aa, Artificial Sequence; identical to SEQ ID NO: 2992
  Synthetic

SEQ ID NO: 2994 - protein, 175 aa, Artificial Sequence
  Synthetic
DELERVLEDLKRVMEEVERKLRESNKELEKAVRRVEELLKRSNEKNRKVTREVREKAKTDRELLEELDDSTRKHEEETKKLVKEIRDLLEELRKTSERLVEDIRRLLKELKELIEAGLDAKDVEDLVRRLMEKLERIVEESERLSDELRRRAEEVVKTSEDLVRENAKRVDDAAK

SEQ ID NO: 2995 - protein, 175 aa, Artificial Sequence; identical to SEQ ID NO: 2994
  Synthetic

SEQ ID NO: 2996 - protein, 175 aa, Artificial Sequence
  Synthetic
DELEEIEKKLRDVVREVEEKLRETNRRLREVVKRVEERLKKSNEDLRRAVRKVEESVKTLEEDLRRLKELLRRLEEESRKLVEEIRKLLKDLERRSKELVDRIRKLLEELKRLIEAGLDAKDVEKLVKELMEEAEKIVEESRERVDRLMKRLDDIVRESERLSKELADRADEVEK

SEQ ID NO: 2997 - protein, 175 aa, Artificial Sequence; identical to SEQ ID NO: 2996
  Synthetic

SEQ ID NO: 2998 - protein, 179 aa, Artificial Sequence
  Synthetic
RELEEILRTLEEMIERVKEKHERSKRELEKVITEVKEELRRSNEELRRVIEEVERKLGKESEEAKDVVDEARRLLREHEELVREVEKTARDLLRENEKLVEDSERRVEKLRRELKRLVEEGVPVDEVRKVVEDIVREAEKSVRENEELVKAIMRELKRVVKEAEELSEEIVRRLEERTR

SEQ ID NO: 2999 - protein, 179 aa, Artificial Sequence; identical to SEQ ID NO: 2998
  Synthetic

SEQ ID NO: 3000 - protein, 182 aa, Artificial Sequence
  Synthetic
KELEDVKRRLEKVHRDVNEASKEIVTRLREVHKRANDESKKIIERLDTVLREVARRLADRRRDKKVEKLLRDIAREAEEIKKRVKRLNDENRKRVEEVEKRVTKLNDENRKKVEDLLRVIDRGDLDAEEVERRVRELEKDVRRLVEDIRRLVEELMRNAKEIVDTAEKLVRELERKLEEVVR

SEQ ID NO: 3001 - protein, 182 aa, Artificial Sequence; identical to SEQ ID NO: 3000
  Synthetic

SEQ ID NO: 3002 - protein, 182 aa, Artificial Sequence
  Synthetic
DEVEDIIRRLEKFHREVNEESKRIIEELERVHREVNRKSEEIVRKLEKVLDEVREKAKRRSRSEEVRKRLEEIADEVRRVKEEVERLNRENKREVDRLKKEVEDLNRDNRKKVEEVIKVVEDGKLRAEEVEEVVRRLVRHAEAVVERIERLVEELVRNAEKLVEEVKRKADRLVEEADRTVR

SEQ ID NO: 3003 - protein, 182 aa, Artificial Sequence; identical to SEQ ID NO: 3002
  Synthetic

SEQ ID NO: 3004 - protein, 175 aa, Artificial Sequence
  Synthetic
DELEEVKRRLDEVNKRVEDEHRRVEEELRKVLEDVAREHEEVIKELERVLEKVRRAKGGDEEVLRRLTKKVEDISRDSKRLLDELREDIKRIIEDSKRLLEDNRRHSKEIKDTIDRDKKSDEARKLVKENERRVEETVRRSEKLVRDAMKKAKDTVRRSAELVKELMDRVERVVR

SEQ ID NO: 3005 - protein, 175 aa, Artificial Sequence; identical to SEQ ID NO: 3004
  Synthetic

SEQ ID NO: 3006 - protein, 171 aa, Artificial Sequence
  Synthetic
SEVEKVKKEAREMLKRVTDLLKEVNDRLKEVNKRVREEIRRVIERVREVLKRVAREVDKREMLERLEERVRRAEERVEELLRENERHSKKVSDDSKRLLDELRKIIKEIEDANLPLEDLRRVVEELEKRARDVVEESRRLVDEDRKHVEDVVRRVRDVVRELEERAERITR

SEQ ID NO: 3007 - protein, 171 aa, Artificial Sequence; identical to SEQ ID NO: 3006
  Synthetic

SEQ ID NO: 3008 - protein, 181 aa, Artificial Sequence
  Synthetic
SEVEKVVEENKKSVKTVRERVTELVKRNRDSVEEVKRRAEEMVRRNRKSVEEVRELLARGVSEEVLRKAKEDNDELNKRVRETLKELVKRNDDLLKRVTDDLDKLRRDNERLVEDIDRKNLPEEAKRRVDRVSEELEEVLRRVEEELRRVSKDLRRVLDEVKKEVDRVSEDLERVLRKDTT

SEQ ID NO: 3009 - protein, 181 aa, Artificial Sequence; identical to SEQ ID NO: 3008
  Synthetic

SEQ ID NO: 3010 - protein, 184 aa, Artificial Sequence
  Synthetic
DEVDEIVRRIEEIVRESEEMAERIVRDIKRVVEKSRKDVEDNVDELRKIVEKVEETAKRTRDEELLERLAREVEEVIKKSEESLKRINDTSKRVKDELEKKNTDLNDRTRRVAEELKKEVSRLRDRDAERKVRDLLRDLERVNTEADEKSKKLIKELEKVNKEAEDKSRKLIKELEDVLREARR

SEQ ID NO: 3011 - protein, 184 aa, Artificial Sequence; identical to SEQ ID NO: 3010
  Synthetic

SEQ ID NO: 3012 - protein, 184 aa, Artificial Sequence
  Synthetic
SSVDEIVKEAEKVVEDSREEAREIVERAEEIVRDSARKVDENVRRLEEIVRKVKEVADRTRSDELLEALAREVEEVEKESKESLRRIDEKTRKVIEDLKKLLEELDRKSEKVVRDLERKVDRLRDRDAERKVREVIERLKKVNDEVRKKLDELTRRLEDVNRKANERSTDLVRKLRRVLEEARR

SEQ ID NO: 3013 - protein, 184 aa, Artificial Sequence; identical to SEQ ID NO: 3012
  Synthetic

SEQ ID NO: 3014 - protein, 178 aa, Artificial Sequence
  Synthetic
SADRKIEEMRKEIKRSTDEARRLVEELIRKIERSNEKVKRDVEKLIEDIRRVIRRVREDNTLDEKDVKRVEDEVEKIIRKLEEDLKRISEETRKLLEELKKRLKEIEEKSKKLIEDLEREPNSEELKKKLEDIVREDEKLVEELTRLAEDIVRRDTKLVRELLERAKRVVDRVREEVK

SEQ ID NO: 3015 - protein, 178 aa, Artificial Sequence; identical to SEQ ID NO: 3014
  Synthetic

SEQ ID NO: 3016 - protein, 178 aa, Artificial Sequence
  Synthetic
DAEELVRELEERIKRSHERLEELLREVKRLIERSHEELKRLNEEVLRELDRVLDEVRKRKKDVEELLRELEERVRRIKERSKESYRRSKESLDRAKEVLEELYRRSKRSLEEFERELREKGVDKDVVRELERIVKENSELAERVFREVEKIVRENTKLAEDSVRELKRLVEELKKRVK

SEQ ID NO: 3017 - protein, 178 aa, Artificial Sequence; identical to SEQ ID NO: 3016
  Synthetic

SEQ ID NO: 3018 - protein, 176 aa, Artificial Sequence
  Synthetic
SDVEDVVRKLRELVKTNLKKVEDRVRKLKEEVEENVRRAEKIVRELEEEVERLLKLVADGRVDKDELRRLVERIKRELKRVLDEDKKTVDEIDKEVKRLVEEDRETVDRIREEIKKRVRGREVAEEVERRLERSHRESRKLADEVRRALEKSNRKTRELLRRVDERVEEVREELDR

SEQ ID NO: 3019 - protein, 176 aa, Artificial Sequence; identical to SEQ ID NO: 3018
  Synthetic

SEQ ID NO: 3020 - protein, 177 aa, Artificial Sequence
  Synthetic
SMEELVDKVEKELEESSRRSKELLDEVRRLLEESNKKTEDLLREVEELLKDVEREAEEKGSSEEKKDRLRKLADRIRDELKKVRREDEKSLEEIEDRLRKAEKEDRDSNREIRDKLRKDGVDEDVVRDVERLVEENRERVKRIADEMRKLVKENEDRARDVVRRLRELVKRLRERVE

SEQ ID NO: 3021 - protein, 177 aa, Artificial Sequence; identical to SEQ ID NO: 3020
  Synthetic

SEQ ID NO: 3022 - protein, 175 aa, Artificial Sequence
  Synthetic
KELEDIARDLERLLRENKKLIKEIVDRLRRLLEDNTRKVKKIVDEVKKLLDDLDKLRKDGVDEKEIEDVVREIAERLKRVLEEIEESIRRIEKVIEEVARESEKLSEDIEREIRKKITGKEVADKVREDLERSNDEMRRVIEKIREDLRRSLKEAKERLDEIKERIDRLLDAARK

SEQ ID NO: 3023 - protein, 175 aa, Artificial Sequence; identical to SEQ ID NO: 3022
  Synthetic

SEQ ID NO: 3024 - protein, 181 aa, Artificial Sequence
  Synthetic
KLEELLTEVRRRIEEVSRDLERVLREVEEDIKRTSDELDRVNRKVETEIKEVTERAEEKGVDRRDLKRLKDEVDKMSKESRDRNEKTIREVRELLKRIRDENRKSNEEVRRVEEDIKRKVRDEELVREVIERLKELVKKDKKLVEDVLRELKRLVDEDRKLVEDSLRRAKEIVDRARERVK

SEQ ID NO: 3025 - protein, 181 aa, Artificial Sequence; identical to SEQ ID NO: 3024
  Synthetic

SEQ ID NO: 3026 - protein, 179 aa, Artificial Sequence
  Synthetic
SIEDVLREVERLLREVIERNRKVHEEVNERSREVERELKRVHDEANRESEEVIREAKRKGIKDIERVEEKVKELNRENAERIKRVVEEVRELNERNRESSERVEEEIKKLLKTLADLVRAGVPVEELERRAREIVKRVRELVDTHRENLERIVERAKELIKELEENLRDIVREIRERVR

SEQ ID NO: 3027 - protein, 179 aa, Artificial Sequence; identical to SEQ ID NO: 3026
  Synthetic

SEQ ID NO: 3028 - protein, 176 aa, Artificial Sequence
  Synthetic
KEVEEVADRSRRVVEESKRRLDDVVRRVKEDSDRLRRDIERMVKRIKEIVKRVREEIGKDKRELVERVREEADKVVETARKLLDEVEKHARDIVRRIEELARRDKRSVERSEEEVKRVDDRKILKELLDRDRKSVKESEDEVKRLLDSNHELSRRIREELKRLLEKVKELVDRVRT

SEQ ID NO: 3029 - protein, 176 aa, Artificial Sequence; identical to SEQ ID NO: 3028
  Synthetic

SEQ ID NO: 3030 - protein, 176 aa, Artificial Sequence
  Synthetic
KEVEDVKRKLEKIARDSEEALRRVVDELRKIVTESKKKLDKAVKEVKDDSKRVEETIGKDKREVVDEVRRHAEEIVKRIEDLAKKDKDLVDEVVKTIEKLMTDDKRLVDEVVRRLEKTRDRDIMRKLLEEVKRSIDESKKRVKELVDEVRDSVRRSEEEVERLLRSNHRLSDEVRK

SEQ ID NO: 3031 - protein, 176 aa, Artificial Sequence; identical to SEQ ID NO: 3030
  Synthetic

SEQ ID NO: 3032 - protein, 176 aa, Artificial Sequence
  Synthetic
DDVERVIEEVKRVVDDSKRRAEEVVEESRKIVTDSERKVREMVRDVRRIVKEVEERIGKDKKDVVEEVKRVAKEVVETAERLVREDKRSSEDSVRKIRRLVTEDERLAREVAERLKRTRDRRIVKKLLEDVRKSVKESKDTVDKLVEENKRSVDRSLRELEKLLKEVEDLIREVTR

SEQ ID NO: 3033 - protein, 176 aa, Artificial Sequence; identical to SEQ ID NO: 3032
  Synthetic

SEQ ID NO: 3034 - protein, 176 aa, Artificial Sequence
  Synthetic
DEVDEVVKRSRDVVTESEKRLRDVVRRSKEIAEDSRRRVREVVERLKEIVREVEERIGKDKKDVVREVRERVKKVVEELERLVKEDEDSSKRSVEEIRRLAERDKRSADESVKELRKTTDRRVVEELLRRDEKSVEDSLRRVEKLVEDNRKTSEDIEREVRRLEEEVRKLVEDVTK

SEQ ID NO: 3035 - protein, 176 aa, Artificial Sequence; identical to SEQ ID NO: 3034
  Synthetic

SEQ ID NO: 3036 - protein, 177 aa, Artificial Sequence
  Synthetic
REVDEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRESTSRDLVREVEKRVRDIVEESRKLAEETRKKVEDIIEKSKRIAEDTLEKNKEMVERLER

SEQ ID NO: 3037 - protein, 177 aa, Artificial Sequence; identical to SEQ ID NO: 3036
  Synthetic

SEQ ID NO: 3038 - protein, 175 aa, Artificial Sequence
  Synthetic
REDELVERLVDKVRRSSKEVRDRAEEMVRRNEKLVRDVEEDLDRLVEENKKLVDSVSRLRGEKAEEAVRRSKKVVDDIRERVKRALDRSRKVVEESREELERLLKRDKELVDEIKERVRIKEVVDRLRELVERSEKDVRKVVEEDKRITDKLEKRVREVVKRNEEITDELRERVR

SEQ ID NO: 3039 - protein, 175 aa, Artificial Sequence; identical to SEQ ID NO: 3038
  Synthetic

SEQ ID NO: 3040 - protein, 188 aa, Artificial Sequence
  Synthetic
SSIERVAKLVEEVERHVRKSIKDVEKLVRDVERHIEESVKTVSKLVEDVKRAVEELRRKVKEKEELDELVREVKRRIEDVVRRSRDLVRKNEELLRRVAEEVRRLVDENRELAERVVEEVRRIGTSEDVERLVREVVKRLEEIVERSERLVREVEERLKEIVERSRRLSKENEDELRKIEKEVRDRVK

SEQ ID NO: 3041 - protein, 188 aa, Artificial Sequence; identical to SEQ ID NO: 3040
  Synthetic

SEQ ID NO: 3042 - protein, 173 aa, Artificial Sequence
  Synthetic
KDVEDAERRLKELLDRLKRFVEESVKTSKKIVDDSKRVVEESAKRSRDIVREVKDRVPEDLVREVEKLARDTERRSEKLVTDNAEIVKRTVEESKDLLKKVEEVVREVVKRARDENVREKIEELVKEVDKLIKDVVRRMEKLNREVKKSADDSAREVEELNRRVREVVERVRT

SEQ ID NO: 3043 - protein, 173 aa, Artificial Sequence; identical to SEQ ID NO: 3042
  Synthetic

SEQ ID NO: 3044 - protein, 173 aa, Artificial Sequence
  Synthetic
DEVEEVEKELRELVKRSEEVAREVKDRLRKLVEESERVVRESRRKSREIVEEIRKKVREDLVREVEELVKRTIERSTELMEDNKRLVEEVEDRARKLVKENEDLAREIVKEVRDRNVKDEARRLVEEVKRSVEKSVKELEDLVEEVKRSVEESVKEAKELNDRVDETVKRRAT

SEQ ID NO: 3045 - protein, 173 aa, Artificial Sequence; identical to SEQ ID NO: 3044
  Synthetic

SEQ ID NO: 3046 - protein, 173 aa, Artificial Sequence
  Synthetic
RSVDEVEKELRELVERITRFVEKSVRDSRKIVEDSKREVEKVKDDLRKIVEEIRRKVPEKDVERVKRVVEEVERRVETLAEENRKIVERTERRSKELVDTVREVVREVVEKVRKDNSEEDAKRLVKEVAELIKRVVEEMKKLNDEVEESARRSVEEARRLVEEVKRLVDEVAT

SEQ ID NO: 3047 - protein, 173 aa, Artificial Sequence; identical to SEQ ID NO: 3046
  Synthetic

SEQ ID NO: 3048 - protein, 184 aa, Artificial Sequence
  Synthetic
EVEELVERVLRELERLVRENKESSDRIKEELRKLVEDNEKSVRDTKRTAEKLVDDLRRKKDEERVEELARRIAKTVEKLVEEDRKSVEDTIKRVEDLVREDEKSVRDSVRKVRELVKRVEENVKDERVVRKVREDVKRVERLSKEIVDDSKREVEKVVETSRRIAEKSTDVVRRVKRELEEITR

SEQ ID NO: 3049 - protein, 184 aa, Artificial Sequence; identical to SEQ ID NO: 3048
  Synthetic

SEQ ID NO: 3050 - protein, 180 aa, Artificial Sequence
  Synthetic
SMKELIKRVKDLVDEVRKKVERLIEEVSKLVDDVKRHIRELIETVKRLVKEVADLLRAGREKEEVVKLLEEVVRRVKKLSKENEERLRTVVERSKKLVDDLRRDAERVAEEVRKLVEDVNDEEARRLVEKVERDLKDIVRRVEELSRRNVERLKEIVKESRELVKEVVERLKRIAEEVTT

SEQ ID NO: 3051 - protein, 180 aa, Artificial Sequence; identical to SEQ ID NO: 3050
  Synthetic

SEQ ID NO: 3052 - protein, 175 aa, Artificial Sequence
  Synthetic
KEKEDVKRRLEELIRRLEEHSKKVKRDLERVIKELDDEVRRVKERHEDVIRRLKDRDTSEKVLRDEAERIRRESEEINKRLEEKAERIKKEADDLLRENEERVKKIERELERLRTEGKLDDDVVRRVKELLRRVLEHTRKVVEDVRRLLKRIREKLEEISRKLDELLRRIEEKRR

SEQ ID NO: 3053 - protein, 175 aa, Artificial Sequence; identical to SEQ ID NO: 3052
  Synthetic

SEQ ID NO: 3054 - protein, 177 aa, Artificial Sequence
  Synthetic
DREDEVRKDIERIERELRRVVDELRKEVEDSMRKLDEEVKRLEEHIRESVERLEERVSEDRDDRVVKTIVKEADRDHKELERELDRLRKEVKKTNDDLERKIRKLEKEAEDVLRELAKRGIDEKVLRDLKRVVDEVRKELKDVLDRHNKVVREVERKLEEVIDKHRKAVEKVKRDAK

SEQ ID NO: 3055 - protein, 177 aa, Artificial Sequence; identical to SEQ ID NO: 3054
  Synthetic

SEQ ID NO: 3056 - protein, 177 aa, Artificial Sequence
  Synthetic
SREEELKKEVERLVREAEKHVEDNRKHVEDSVRELEKLVKELADKARESADRLDKKVKEDRDKRVVEKILREAEKINKDLKDTVKKILDEIREDHKRLEDNIRRLEEELRKVLKELKDRGIEERVLEELKRVVDDIRKKHKDILKRHRDVVRKVEKELRDILREHNEVIREVKDKLE

SEQ ID NO: 3057 - protein, 177 aa, Artificial Sequence; identical to SEQ ID NO: 3056
  Synthetic

SEQ ID NO: 3058 - protein, 183 aa, Artificial Sequence
  Synthetic
SEVERILKEAKRRLDEVVERLRKSAETLRRMLERVSRELKKSHDELDRVLRRVEDALRKRNLDEKSVRRIKKEIDEARKKSKKVLDEIEERAERVKRESREVLERIKKRIEDVIRRLAEIVREQRRDAEELRKEVEDMVRDLERLVREHSDRVRKIVTDLDRLVKEHNEEVRKIVERLDEEVK

SEQ ID NO: 3059 - protein, 183 aa, Artificial Sequence; identical to SEQ ID NO: 3058
  Synthetic

SEQ ID NO: 3060 - protein, 179 aa, Artificial Sequence
  Synthetic
SELDEILERLKEVLERVKRKLEESNRRLEEVLDRVLKKLTESVKRLEDELRRVLKELRENNRPDDRLKEKVERVREESEEMRDRLRRLIERVREESKRILEELERRAREVKKRAEDVRRRGKPIEEIKKDVERIVRELEDLVRRHEKRVEDIVRELEKIVRDHNERLKEIVRRAEEDVR

SEQ ID NO: 3061 - protein, 179 aa, Artificial Sequence; identical to SEQ ID NO: 3060
  Synthetic

SEQ ID NO: 3062 - protein, 179 aa, Artificial Sequence
  Synthetic
RELEEILKRLEEVLERVLRELRKSVERLRKELERVLKELRDSNRKLDKVLREVLEELRKKNKDATDLKRRLDEARKESKDVIKTLDERVKRVKEESDEMLERLKELLDRVREEAERVARRGEPAEDLERRVKEIERRLKRLVDEHNRRLREIVRELEEIVKRHKERVEEIVRELKRRVD

SEQ ID NO: 3063 - protein, 179 aa, Artificial Sequence; identical to SEQ ID NO: 3062
  Synthetic

SEQ ID NO: 3064 - protein, 179 aa, Artificial Sequence
  Synthetic
SELDDIVRRLDEMLKRVEDELRKSDERLDELLKRVKKELEKSNRDLERALREVLKELEDRNRPNDELKRRIDEVREESRRVIEELDRTVKEIKRRSEEMSKELKRTADEVRKRADEVRKRGKDARELEEEVERIVRELEKLVEEHKEELERLARKLEEIVRRHEERVRRIVKELEDRVK

SEQ ID NO: 3065 - protein, 179 aa, Artificial Sequence; identical to SEQ ID NO: 3064
  Synthetic

SEQ ID NO: 3066 - protein, 179 aa, Artificial Sequence
  Synthetic
RELDEILRRLREELKRVREELEKSLKRLEDELRKVEEDLRESNERLERMLERVLRELRKRNRPDDELKKKLDKVRKESEDMSRRLKETADRVREKLKDSKRKLDEKVKRVEKRLEEVRRRGKDVDELRKELEKIAREAREYVKRNKDDLRRIVEELRKIVKKHKDKVEEDVRRLKKDVD

SEQ ID NO: 3067 - protein, 179 aa, Artificial Sequence; identical to SEQ ID NO: 3066
  Synthetic

SEQ ID NO: 3068 - protein, 173 aa, Artificial Sequence
  Synthetic
RELEEILKKLEEVVRTVEELHKRTNEKLEKAVDEVRELHRKTNEDLKRAVDEVEKAGLPKELVDRLRELLKDNKRRSDEIIRKIEKVLEDNKRKSEEIVKRLREELKRLADVIKDLEKDRLDEEVKRLVEEARRSVEDDDRNIRRLVEEAKDSVRRDEETIKKLVDELREATR

SEQ ID NO: 3069 - protein, 173 aa, Artificial Sequence; identical to SEQ ID NO: 3068
  Synthetic

SEQ ID NO: 3070 - protein, 173 aa, Artificial Sequence
  Synthetic
SDLERILKRLREVIKRAEELHRKTNEEDERVVREVIELHRKTNEDLREVIERVARGGLDEKMIERLERLLKENTERSKEISERLKRETEENIERSKRIVEDIERLLEELRRVVKDLDKEELRKAVEELEEKLERSVREDKKTSDDSARRAKKSVEDDRRTIEKLVEEAERSRK

SEQ ID NO: 3071 - protein, 173 aa, Artificial Sequence; identical to SEQ ID NO: 3070
  Synthetic

SEQ ID NO: 3072 - protein, 183 aa, Artificial Sequence
  Synthetic
KDLEKLLDDIRKVLEEVTRRLKRISDELRRVLEEIKKRLDKDNEDLKRVIDEVKKLLDKKVRDEKRVKDLVDRAREIHRRHAEEVKRLVDKLREIIRRDEKSVEDWKRRLEKILEDLKRVVDRNERSREEIEKEIRDVEEELRRAVEENAELVKRVKEDAERVVRDSEKKSKEVAEELKDAVR

SEQ ID NO: 3073 - protein, 183 aa, Artificial Sequence; identical to SEQ ID NO: 3072
  Synthetic

SEQ ID NO: 3074 - protein, 182 aa, Artificial Sequence
  Synthetic
SELEKILKELKDASREVEKRLRDILREDKKMLKKVVEELEEILRRLDEEVKKVKERLKNKEVLERLEEEVRRLKERIKKLIEDLKRESERLEDTIRKLIRELRENTKRLEEKIRRLKKKGEPREEVVDRAKKEVDDHVKKAEDVVREVEKRSRESVKRLRDIVEELERLVKRLVDEAEREVK

SEQ ID NO: 3075 - protein, 182 aa, Artificial Sequence; identical to SEQ ID NO: 3074
  Synthetic

SEQ ID NO: 3076 - protein, 175 aa, Artificial Sequence
  Synthetic
SETEKLLEEVRRIIEEIKKRIDRSLEEVRRSVEEAKRRIEKSLEDVEKSVRRVKKILDEGDSSERLKRENDEHLKTHHEVVKKILKDNREHLRRHHETLKDIKRRIDKVVEDLRRAGLDDRVLKEVEDLAREVKKRIDEVDKRVAELHKEVEDRLREVDKTVEELHRRVKKRADD

SEQ ID NO: 3077 - protein, 175 aa, Artificial Sequence; identical to SEQ ID NO: 3076
  Synthetic

SEQ ID NO: 3078 - protein, 180 aa, Artificial Sequence
  Synthetic
SIEDVEREVKRLIERTKRHNDRVLETIRRLLEETKKHNEKVLREIRELIKRVEDTMRRRGVDERLRDELRKILEDLERESRKLKEDNKRALEELARMSKKLKDDNDRALERLKDTVKEERSEETIKRLLDEVREYVRKSEEDSERLLRDVERYVKESKERSERILKEARRLVKEVEDKIR

SEQ ID NO: 3079 - protein, 180 aa, Artificial Sequence; identical to SEQ ID NO: 3078
  Synthetic

SEQ ID NO: 3080 - protein, 180 aa, Artificial Sequence
  Synthetic
SIEEVLEEVRDLLRKTKEDTKRILDEIRRLLEETKKRLEEVLREATKLLREVEDLVRKSGVDERLLEEIKRIEDELRKKIETIRRRNDEALKRLTDLVEENKKRNDDILRKLKEERDEDRDEEEVKRLLEKARKLVEESKRESKEILDRARKYVKESLEEIERLLDELRKLIEELRRRIE

SEQ ID NO: 3081 - protein, 180 aa, Artificial Sequence; identical to SEQ ID NO: 3080
  Synthetic

SEQ ID NO: 3082 - protein, 176 aa, Artificial Sequence
  Synthetic
SSEEILKEVKELIEESNRASEEVLKEVKKLLDESKKRSDEVLEEVERELKRLEESASRIDDEKRLREVRDVLRRIRERLDRVRKENEKILKEVKDTLKKVKEDNEDISRRLEEEIKKKGADEDVVREMRRLVEEDKRRIKEALDRLRKLVEDDKRRIEEVLREMRELIRELEERIR

SEQ ID NO: 3083 - protein, 176 aa, Artificial Sequence; identical to SEQ ID NO: 3082
  Synthetic

SEQ ID NO: 3084 - protein, 175 aa, Artificial Sequence
  Synthetic
KEIEDILERLKETIKEIEDHIRRDLEELKKVIEELKRSLEEWKKRAERLIEELERLIRETGPTKELEKEARDRLRELEEAMKRNVEKIDKIKRENEKNSEDLKRRLERVLRELRKSGLEERVLREAEERIRRLEEKLKEVNKRSEEMLRRLKEEHERVLREVKELIREIDDKARK

SEQ ID NO: 3085 - protein, 175 aa, Artificial Sequence; identical to SEQ ID NO: 3084
  Synthetic

SEQ ID NO: 3086 - protein, 182 aa, Artificial Sequence
  Synthetic
GEDEVLRKVEKLLREVKERAEKSVERVERLLKDVEDKLKESHDRAKRLLEEVKKAADRGDLREEELDRLRKKIEDAYKRSEDILREIKKEIKRVLDRSRETLKRVEEELKKVLDTLADLVRRNEEDLKDLDRRIEEVVKRLEDEVRRHTKEVEEMVKRLRELVREHTERVKKIVEDLKREVD

SEQ ID NO: 3087 - protein, 182 aa, Artificial Sequence; identical to SEQ ID NO: 3086
  Synthetic

SEQ ID NO: 3088 - protein, 175 aa, Artificial Sequence
  Synthetic
SEVEDVERRIREIIERLRRIVERHKEEVKKIIEKLEKLVRDHTERAKRIIERLKEVVDRKMPRELIKEELDRVREDSKRVLDELRRKLEEVRERSRKALEDIKRRLDEIRDELRRRISNEEVLKEVERLLEEVKELVERSHKEAEDLLKRVLDAMKRSVDEVEKLLEELKRRADK

SEQ ID NO: 3089 - protein, 175 aa, Artificial Sequence; identical to SEQ ID NO: 3088
  Synthetic

SEQ ID NO: 3090 - protein, 175 aa, Artificial Sequence
  Synthetic
SKVEKVEEDIDKIIRRLEELVEEHRTEAEKTVKKLDDDVRRHNEKVEKIIRDLEEVVRRRKPEKDIEDKLRRVKEESERVLEEMDRRLRRVEEESRRLHERAREELERVEDELRKKIENRKVLEDAKRLLERVMDEVRRSNEELKKLLEEVKRKLKKSVEDAERLLDEVRKRVEK

SEQ ID NO: 3091 - protein, 175 aa, Artificial Sequence; identical to SEQ ID NO: 3090
  Synthetic

SEQ ID NO: 3092 - protein, 175 aa, Artificial Sequence
  Synthetic
SEVEEVDKRIREIVTTLKRLVEEHNDRARKIIEKLRRLVKKHEDEVEEIVRRLDEAVERRLPREEIERKLREVEERSKEVHKRLEDELEKVKRESEKMKREADERLKKVEKDLRDTISNEEVLKKVKELLKEVKRRLERSLEELERLLEEVLKLMKESNDKAKELLERVREKVER

SEQ ID NO: 3093 - protein, 175 aa, Artificial Sequence; identical to SEQ ID NO: 3092
  Synthetic

SEQ ID NO: 3094 - protein, 177 aa, Artificial Sequence
  Synthetic
DFVERVKEEIKRIVERLKRLVKEHEDEVKRILDELRKLVETHKELSKDSLRKLEEVGDGSEDDIRRLLEENKKMDKEVNDKVRKLAKDVRDIDRRMNERVERLLREIEKTLEDLRRENKVDERVLEELRRLVKEVKERADRSSEKLNELLRKAEEDAKRSSEENNRRLEEVERRVRK

SEQ ID NO: 3095 - protein, 177 aa, Artificial Sequence; identical to SEQ ID NO: 3094
  Synthetic

SEQ ID NO: 3096 - protein, 181 aa, Artificial Sequence
  Synthetic
DEERKIEEIIDKSRRDWERLLREAREIIKRSEDEWRELLERIKRLIEETRKRAKDLKKADGRERVVEEIEERVRRINEETKKLVRELLEKDRKLIEDLRKKLRELREKDKRLIERIKEERDTEEIRRLLEEMDKLSREASKRVEDILRELEERSRRMADEVRKLNEENKKLLEEAKKELKD

SEQ ID NO: 3097 - protein, 181 aa, Artificial Sequence; identical to SEQ ID NO: 3096
  Synthetic

SEQ ID NO: 3098 - protein, 181 aa, Artificial Sequence
  Synthetic
DKEEIKEKLEELVERVVRELEKLLKELEDLSREVARRIKKIARDLEKLTKEVEEKLRRRPKTEELTELVKRLKEHSERLRRRIEELLRRLEEDSRRLVERIKKLVKDLRDDVRRLKELIDRGELSEEELERLIKELVDRARKLLEEVKKLIEDHREKLKRVLDEIKDLLRKHKETLDRTDT

SEQ ID NO: 3099 - protein, 181 aa, Artificial Sequence; identical to SEQ ID NO: 3098
  Synthetic

SEQ ID NO: 3100 - protein, 181 aa, Artificial Sequence
  Synthetic
SKEDILRELRDRVERIKREIEKIFRDAKRLSEEVKRRIEDLLRKLKKVSDDVRERLARKPDTEELRKLVEELERDSERLKKEIKDLVRELDEHSKELLTRIRKLLKELEERVRELEELIKRGDLSEEELKELIKRLVEDAKRILEELKKLLDDHERKARRILERIEKLIKEHEDKARERER

SEQ ID NO: 3101 - protein, 181 aa, Artificial Sequence; identical to SEQ ID NO: 3100
  Synthetic

SEQ ID NO: 3102 - protein, 181 aa, Artificial Sequence
  Synthetic
SEVEKLEEEVERSVRDLERELRDSEEKSKELMRRLDELVRRAKDHVRRSVEELRKTLSKGLDEDEVRDLERRVREDHEKLKEDLKRIVREAREALKKHRRRVEEIVKRVKERLEELRRRIGDDEEVRRILRDAERVIEEIKRRLEEDHKRLEEVIRRVEEKLRRILDEHDKVVKEIKEALR

SEQ ID NO: 3103 - protein, 181 aa, Artificial Sequence; identical to SEQ ID NO: 3102
  Synthetic

SEQ ID NO: 3104 - protein, 181 aa, Artificial Sequence
  Synthetic
SEVEEAEKEVEDIMRRLKRKVEENKRHVDESVKEAEKLLRDSETRTRDIARRLKEELDKGLDEEEVKRLAREVDRLLREHREEVKKIIERIDRDNDRNREHVEKVVREVEELLRDLERKIGRDKELTRILTRLREVIERVKRALEKSHDDHRRAVEEVRKELKRDHDDLRRVIEKVRRDLK

SEQ ID NO: 3105 - protein, 181 aa, Artificial Sequence; identical to SEQ ID NO: 3104
  Synthetic

SEQ ID NO: 3106 - protein, 181 aa, Artificial Sequence
  Synthetic
SEVEEAKRRVDDIVRKLEELLKDSRRESERIMRELKRLLEELKRHVEDSVRKLREVLSRGLDEEKVERLIREARKDNERLKRELERILREVEKALKRHRERVEKIDREVRERLKDLERRIGDDRELREILRRAKEVIDKIREDLERDHDRLREVIEEIKKTLDRIHEEHRRVVKEVEDTLK

SEQ ID NO: 3107 - protein, 181 aa, Artificial Sequence; identical to SEQ ID NO: 3106
  Synthetic

SEQ ID NO: 3108 - protein, 181 aa, Artificial Sequence
  Synthetic
SEVEEAEKEVREIMKELDKLLEDSKRESDDIRRDLDRVLEENKRHVDKSVTDLERVLSRGLDEEAVRELLRRAREDNRRNKEHVDRLVKKAKDKLDEHKKKVDDIIEKARRELKRLEDEIGDDKELRRILRELEEVIKRVERTLREDHKELKRVIDRMKEDLERSHEEHERLVEEVERKLR

SEQ ID NO: 3109 - protein, 181 aa, Artificial Sequence; identical to SEQ ID NO: 3108
  Synthetic

SEQ ID NO: 3110 - protein, 181 aa, Artificial Sequence
  Synthetic
SEVEEAKKDVERIMRELEKLVRDNKKHVDDSVRKLKKLLDDLRKHVEDSREELERVLRRGLDEELVKELRKRAEDDNRRLKEELDKIKEEADRDNEENAKHVKKVVDRARKMLEDLRRKIGDDRDLRKILEDLERIIRRVEEELRRSHERHKEVVDRIKKVLDEIHRRHREVVKEVEKELR

SEQ ID NO: 3111 - protein, 181 aa, Artificial Sequence; identical to SEQ ID NO: 3110
  Synthetic

SEQ ID NO: 3112 - protein, 181 aa, Artificial Sequence
  Synthetic
KEVEEAEDKVRRIVEDLKRKLEDLERHVEESVRRLEDLLRRSKKKSDDIMEKLTRTLSKGLDEEEVKRLTEEVERLLREHRRELRRIVEEARKDNERLETRLRKIKREVEELLKELEREIGDDKELRRILKRMKDAIERVERELRRIHTRHKEAVDRVREELKRNHDELAKVIRKVREDLK

SEQ ID NO: 3113 - protein, 181 aa, Artificial Sequence; identical to SEQ ID NO: 3112
  Synthetic

SEQ ID NO: 3114 - protein, 181 aa, Artificial Sequence
  Synthetic
DEVERADEDVERIVRELRRVLEENRRHVKESVERLERLVRKSKKDSKKIMEDLKRVLDRGLDEESVKKLRDDARKELEKHREELRRIEEEAEKDNRRNEEHVRRLEKRVEEELRRLETEIGDDTELRKILKKMKDAIREIKRTLDESHREHRRVVEEVKEELERNHKELKEVIDKVAKDLE

SEQ ID NO: 3115 - protein, 181 aa, Artificial Sequence; identical to SEQ ID NO: 3114
  Synthetic

SEQ ID NO: 3116 - protein, 176 aa, Artificial Sequence
  Synthetic
DEVEDILRRVREAVERARESLERIHREHKKVVDEVRKALEKVLEDHARVVDEFRRKSGSESEEAKKILDELRRDHEELKKRLEKIEREVREDNERLERELRELEERVRRKLEELERRNVRKDELKKEVEKLEEELKKELKRLKDHVKKSKEDLRRKLEDLKRHVERSVKRAEEEAR

SEQ ID NO: 3117 - protein, 176 aa, Artificial Sequence; identical to SEQ ID NO: 3116
  Synthetic

SEQ ID NO: 3118 - protein, 176 aa, Artificial Sequence
  Synthetic
SEVEKVLRDLERAVKEVSERHRRNHEELRKVIKRVKEEHDRIHDEHRKVVEDLKRKIGTESEDAKRILDKLEEDNRRLKKHIDDSKERVDRVVKRHKEHLDRSLKRVKEMLDELRKANVPREEIKKEVDRLKKELDENLKRLERDSERLKKELEDNLKRLEEHVRRSKEEAERDAK

SEQ ID NO: 3119 - protein, 176 aa, Artificial Sequence; identical to SEQ ID NO: 3118
  Synthetic

SEQ ID NO: 3120 - protein, 176 aa, Artificial Sequence
  Synthetic
SDLEEVLKRLEDVVRRLEEELRRIHKEHRDVVRRVTEEHKRILEELKRVVERAREKDGEESREVKEILRELEEVLRDLKRHIERSRKELEDDNRRLKKRLDEILKKIREVLERLRRKNVDRDRVTKEVRDLEEELRELLERLRAHVKRSEKKIEENLRRLEKRVEDLKKKIDDRTR

SEQ ID NO: 3121 - protein, 176 aa, Artificial Sequence; identical to SEQ ID NO: 3120
  Synthetic

SEQ ID NO: 3122 - protein, 179 aa, Artificial Sequence
  Synthetic
RELEDIKRKHKKVVDDVREKLKESHRRLKEVIEEARRRLDEVRKKLEKVIREILTSAGTEDERLKRVEETVRRVLEELEELIKRLDDKAKRMLDEHRKILEEIVKRADKSHKELDEMIKRRLPIEDLKRYVEEVKRDLDDLIRRSEELVRRIKEDLDRALKELEELVRRIKKKLEEDRK

SEQ ID NO: 3123 - protein, 179 aa, Artificial Sequence; identical to SEQ ID NO: 3122
  Synthetic

SEQ ID NO: 3124 - protein, 182 aa, Artificial Sequence
  Synthetic
SELDELRERVERHSRELRRTLEEAKKLVDDHKRTLREVLERIKKRVEDVKRELEKLVRDGVDERFLERLKKKLEDIVRDIERRNKELNEHSKKLAEELRRILKKLEDHSRELEKRMREEGGELREELKKIIDELRRVNEEAAKTLDEIIKRLEDVNREVNRTSKEVIDRLRKVLEEAERRTK

SEQ ID NO: 3125 - protein, 182 aa, Artificial Sequence; identical to SEQ ID NO: 3124
  Synthetic

SEQ ID NO: 3126 - protein, 182 aa, Artificial Sequence
  Synthetic
EELDRIRKEVEDHERKLREVVKDIERKVEEHAKRLKKVIEDDERRVKEWKDTLEELIRRGVSEEVLKRLAEELEKHKERSKKLNRELNKHSKELVDELRRRLKRLKEHSDELEEKIRRRGGELKDEVRRVIKELRDVNRKVADALRKVEEKLKRVNDEMNKESKRTLDELDKALEEAERRAR

SEQ ID NO: 3127 - protein, 182 aa, Artificial Sequence; identical to SEQ ID NO: 3126
  Synthetic

SEQ ID NO: 3128 - protein, 182 aa, Artificial Sequence
  Synthetic
DLLRELEARVRKHKRDLEEVLKKIEEEVRRHKKKLEDVLEELRRLVEDLMRELKELLEKGVPEKVLKELADKLRRLVEDARRLLRELKEHSRKLEEDIRRRNTELNKHSEKLEEDMRRKGGELREELKRIIDELREVNERVNDESRKVIKELRDANKEADKKVRDIIRRLEDILRKAAEDTR

SEQ ID NO: 3129 - protein, 182 aa, Artificial Sequence; identical to SEQ ID NO: 3128
  Synthetic

SEQ ID NO: 3130 - protein, 182 aa, Artificial Sequence
  Synthetic
KDLERLEKEVKEHKEDLERIVREAEKLVEDHERELEKVLRELEKTVRDVKRELEDLLRRGASEDVLRELAKKLKKIVEDMEKKNEDLNRHSEELLRRLDKILKELNKHSEDLMRKAREEGGKLKEEVDRVLDELRKVNKKAADDLERVIRELEDVNRRVNERSREIIETLKRVLDEVREKTR

SEQ ID NO: 3131 - protein, 182 aa, Artificial Sequence; identical to SEQ ID NO: 3130
  Synthetic

SEQ ID NO: 3132 - protein, 182 aa, Artificial Sequence
  Synthetic
DELRELKRKVDEHTRELERILKEIEDRVRRHKEKLDETVKRDKDRVDEWLRRAEELVRRGVSEEVVKRLAEELEKHKRTSEELNRKLNEHSKKLEDDIKTKLDELNKHSKELTEEMRRRGGELREEVEKIERRLREANKRAADALKKVIDELRRANEEVNRKSEETLKTLDKILEDVERKTR

SEQ ID NO: 3133 - protein, 182 aa, Artificial Sequence; identical to SEQ ID NO: 3132
  Synthetic

SEQ ID NO: 3134 - protein, 182 aa, Artificial Sequence
  Synthetic
DDLERLAEEVKRHSEDLDRIVEEIRDRVRRYKEKLDEVVKEDEKRVREWRDRLEKLVRAGVSEEVLRKLAEDLEKHKEDSDRTNEKLREEVKRLEEEIRKTLEDLNRHSKELVERARRRGGKLKDELDKIITRLEEANRKAAEDLRRVVEELRKAHEEMNRKSEKTKKDLDEVLEEAERRTR

SEQ ID NO: 3135 - protein, 182 aa, Artificial Sequence; identical to SEQ ID NO: 3134
  Synthetic

SEQ ID NO: 3136 - protein, 182 aa, Artificial Sequence
  Synthetic
DDLERLKRRVEEYRRKLEEVLKTIEEEVRRYKKEAEKVLDEDRRRVEDWKRKLDEMVRRGVSEEFLERLARALEDHKRKSDRDNDRLREKVRRLEEKIKELNDRLRKEVEEIVKRARDRGGSLEEDVRRIIDELRRVHKRANEDSKRVVDELRDVHRKVNETSEETKKRLDKVLKEAEDRTR

SEQ ID NO: 3137 - protein, 182 aa, Artificial Sequence; identical to SEQ ID NO: 3136
  Synthetic

SEQ ID NO: 3138 - protein, 182 aa, Artificial Sequence
  Synthetic
KKLDDIRREVERLTDKLEKIVKRIKELVDRYRRKLERVLEEDDRRVKEWKRRMEELLRRGASEDVMREIAERLERHKEESKRLNDELREELKKLEREIEKTLRDLAEELEKLKEDIKRKGGELKEEVDKVLKDLDRALKKAADDLKRVIDELREVHERINRTSERTLTKLDRALEELEKRLR

SEQ ID NO: 3139 - protein, 182 aa, Artificial Sequence; identical to SEQ ID NO: 3138
  Synthetic

SEQ ID NO: 3140 - protein, 182 aa, Artificial Sequence
  Synthetic
KELDEIRELVKRHKDKLKKIVDEVKERVDALKRKLKEILDEDRERVKKWVRDMEELVRRGVSEEVLKRVAEELEKHKKKSEEDLRRLAEDLRRLEEEIRKRVEDLNRHSKELVEDIERKGGKLKEDVDRVIRDLERVNEEANRRAKKVIDELRRVLEEAERTLRKTLEDLDRALEELARATK

SEQ ID NO: 3141 - protein, 182 aa, Artificial Sequence; identical to SEQ ID NO: 3140
  Synthetic

SEQ ID NO: 3142 - protein, 183 aa, Artificial Sequence
  Synthetic
DEAEKILEELRKVVRELEEELRRNHEELKRVIEDVERKLRESNRRVEKVIKEVTDEKGSEDDEARKVLKELKEKLDEHKKRVDEVKKKLEEELEKHKRKLDKVVKEVEKFLREAEDRLRKEGTDEDVVRELEKLVEELKRRVTEVVETVARDSERLREELRRIVEESKRLVEELKRRAEEASR

SEQ ID NO: 3143 - protein, 183 aa, Artificial Sequence; identical to SEQ ID NO: 3142
  Synthetic

SEQ ID NO: 3144 - protein, 179 aa, Artificial Sequence
  Synthetic
SELERVVEDLRRAAKKLADDLKRVIEEHRKYARDNKERLKKVLERLKRLAEELKKELERDGKSDEVRKRLEELLDRLRRLVEEAIRENKKSVDDSRKNSKRVEDELRDRLRKLDEKLKRDVKDSREVLEDVRRLIEDLERLITELRKENERVIRESEKLSRDIEREVERVIRELEETIR

SEQ ID NO: 3145 - protein, 179 aa, Artificial Sequence; identical to SEQ ID NO: 3144
  Synthetic

SEQ ID NO: 3146 - protein, 171 aa, Artificial Sequence
  Synthetic
KEVEDVKREIDKVLEDARRLLKESDDTLKKILDKARRDLEESDRRLKEILDKVRKDGLDEELLRRIEEYAKRHHDRNREILERLRELVKRHHDRNRDIVRRLEELVDKLKKDNIPFEELKDTVDKLRREIERRITESRRHVEELRRRVEEMLERSERNVREAEKKLEEDKK

SEQ ID NO: 3147 - protein, 171 aa, Artificial Sequence; identical to SEQ ID NO: 3146
  Synthetic

SEQ ID NO: 3148 - protein, 182 aa, Artificial Sequence
  Synthetic
DEVERVEEELKKSDDELRRRMEEVKRALDKDNEDAKRMLDEVKKELEKILRKVEKEVKDKESVDRLRKKLEDIKRELERILEELSKIHEDIKKRLDDLLRESEEHSRRLIEEIRDLERRGSDKKEVVERLDKLVKEHHERNKRIVEEAKRLVEDSREKTRRIAERAKELVRRLKELVDRLSK

SEQ ID NO: 3149 - protein, 182 aa, Artificial Sequence; identical to SEQ ID NO: 3148
  Synthetic

SEQ ID NO: 3150 - protein, 182 aa, Artificial Sequence
  Synthetic
DRIEDVKRKVKEIKEKVDRLLEESSKKVDDLNKKVRDLLTESNKRIEDIVRELRELAKRDLKEEELRKVLEDLRRRIEKIIKDNEEINREHEKVVRDIVKENKEINDELRKEIERIREELGTESEEAKEVLERLKRILEESRRASEENKKKLEKSHEELKRASDENKRKLERILDELREALR

SEQ ID NO: 3151 - protein, 182 aa, Artificial Sequence; identical to SEQ ID NO: 3150
  Synthetic

SEQ ID NO: 3152 - protein, 171 aa, Artificial Sequence
  Synthetic
SAKEKIDKTLKDIYRKHEEVVRRVEKKHRDIHREHEEVVRRVEEEHRRILDELRKAPVDEDVIRKIEKNVEEVKREIDKSDDDIRRNIKEVKDEMDKSNEELKRKIDELRKANLPEEEAKKFLDKLDKEVRDSMKRLEDHVRETKKRVEESVRRLEEHVKRTEEEVRETAT

SEQ ID NO: 3153 - protein, 171 aa, Artificial Sequence; identical to SEQ ID NO: 3152
  Synthetic

SEQ ID NO: 3154 - protein, 171 aa, Artificial Sequence
  Synthetic
SVEDEVRRDLKRIYEKHEEAVRRVEERHERSNERLEDVIRKVEDKHREILKKLEDEPVEEEFIKELEKNVRTVKKKAEDKLRESEKNSRDLKRKIDESNKRLRDKIEELERANLPEEDVKRVLDKLDEEVKDSVRELEEHVEKNERDVEEIAKDLERHVEETRKEVDKTAK

SEQ ID NO: 3155 - protein, 171 aa, Artificial Sequence; identical to SEQ ID NO: 3154
  Synthetic

SEQ ID NO: 3156 - protein, 171 aa, Artificial Sequence
  Synthetic
KVEEKVRETLRRIYERHRKIVKEVEEKHRESNERLRREIERVKRKLDEILKKLEEAPVDEDVIRRLRKELRDLEEKMERKLRESERNSEEVKRRAEESNKRLRDKIKTLEEANLREDRVAEVLKKLKDDVDKSAEELERHVKRNRDEVRKIVEDLDRVLEELRTKVDEEAR

SEQ ID NO: 3157 - protein, 171 aa, Artificial Sequence; identical to SEQ ID NO: 3156
  Synthetic

SEQ ID NO: 3158 - protein, 171 aa, Artificial Sequence
  Synthetic
SVEDKVRESLERIYKKHEKVLRDVERTLKEIHEEHREAVERVRRELERIKRKLEELPVDKDMIRRLEELIKELERRADESDDDLRRKIDELRRRAEESNKKLKRDIDRLREAKLPDKDVERVLKKLDDDVRKSVKELTDVLKRLREEVKRSVEELEDVLRKLDKEVDDTAK

SEQ ID NO: 3159 - protein, 171 aa, Artificial Sequence; identical to SEQ ID NO: 3158
  Synthetic

SEQ ID NO: 3160 - protein, 171 aa, Artificial Sequence
  Synthetic
DVEDRIRKSLEEIYRRHETEVRKIKRKHDESHRRHEKVVREVTEDLERIKRRLEELPVDEEAIKKLEEDIKRLRERIKESDKRNEDNIREVEKEARKSNDELRKDIEKLDRDRLPEEDAKRVLDELEEKVRRSVKKLREHVEENEKRVEDSVEELKRILEELRKAVDETTR

SEQ ID NO: 3161 - protein, 171 aa, Artificial Sequence; identical to SEQ ID NO: 3160
  Synthetic

SEQ ID NO: 3162 - protein, 182 aa, Artificial Sequence
  Synthetic
SKKDEVEKLLKESERHSKKLVEDAKRLSDESKKHVEELVRRAEEELEKSDRDVKKVKDDNRPKDELKKVVEDLERENERLNRKIKEELKRHKDENERLTKELRELVKRHTDEVKEITDRLNVPEEVMDRVRRRLERDIRELRKALKRVEDTNEEITRELEKAMKEVKDTSDRILEKLRRARK

SEQ ID NO: 3163 - protein, 182 aa, Artificial Sequence; identical to SEQ ID NO: 3162
  Synthetic

SEQ ID NO: 3164 - protein, 182 aa, Artificial Sequence
  Synthetic
SVKDKLKELLKDSKRNSDRLVERAKELLDRSRKHSKELEDRARKLLEDSRRKVEELERANLREDELTRVVRKLEEENKRLNTELEKLVRDHERDNKRLVDELTKLSKEHEDRVREIAKKLDVEREVLEKARRDLERDLRENKKALDEVRRTLEEDSRRLREVLEEVKRISTKIIERLREIRR

SEQ ID NO: 3165 - protein, 182 aa, Artificial Sequence; identical to SEQ ID NO: 3164
  Synthetic

SEQ ID NO: 3166 - protein, 173 aa, Artificial Sequence
  Synthetic
SEKEDAEKKLRDILTDLARIVREVEEALKKILDDIRKVSEESKRASDESLKRARDAGIDEKLLEELERHNRKLKRDDDRLLKELEEDIRRLKEDIDRLLEEVAREVDRLREELDRLRGEELEELLRRLEEAVRRIAERLRKLLKELEEKARRLAEESKKLLEKDKEDVKRAAE

SEQ ID NO: 3167 - protein, 173 aa, Artificial Sequence; identical to SEQ ID NO: 3166
  Synthetic

SEQ ID NO: 3168 - protein, 173 aa, Artificial Sequence
  Synthetic
SEKERIKEESKKSLDDLRRASERSKEELDRILKRIDEASKRSKEESDRSLKEVKDRGIDEELLRELKRHNEELKERDDRLLEELKRKVEELKRTDDDLLRRSKEKHEKVERELKDLDGEELKDVLRELRETNRKLVEDSRKLLEELDRDVERLADESRKLLEDDKRKVREVAR

SEQ ID NO: 3169 - protein, 173 aa, Artificial Sequence; identical to SEQ ID NO: 3168
  Synthetic

SEQ ID NO: 3170 - protein, 173 aa, Artificial Sequence
  Synthetic
SDEERIDELSKKSLEDLKRVSDDSKRKLDDILKKIEDASRESEDKLRRILEKARRDGIEERLLTELERKVRELKKDDRRLLEELRKKVERLKERDDELLDRSRRKHEEVKRRLKDLDGRELERILEELRTDNDRLAKESDKLVKELEEEVRELIKRSETLLEELRKDVEELAK

SEQ ID NO: 3171 - protein, 173 aa, Artificial Sequence; identical to SEQ ID NO: 3170
  Synthetic

SEQ ID NO: 3172 - protein, 171 aa, Artificial Sequence
  Synthetic
DAKERVDDALKKILDDHRRVLKKVEDDHRDSHREHRRVVEEVKRELEKVLKKLRDAGVPEEIIREAKELVEELVRRAEESDKRNEDNIREVKERAEESHRRLRRLVEEIRKANLPKEDLDRMLEKLREIVERSRDKLRRHLEKNKREVDDSKRRLEKMLRDLEKKVRDAER

SEQ ID NO: 3173 - protein, 171 aa, Artificial Sequence; identical to SEQ ID NO: 3172
  Synthetic

SEQ ID NO: 3174 - protein, 171 aa, Artificial Sequence
  Synthetic
DDEERVKRKLEEVLRKHKEVVDEVIERHRRSHKRHRDMLREVDKKHRRILTELEKAGVDEKIIREAKEHVDRSREKLKESDERNEENIKKVTKELRESHKRLRDKVKELAEANLPVEDLKRVLEDLDREVRESKERARKHVEDNERKVEESKKRADDNLRRLERKIREAAR

SEQ ID NO: 3175 - protein, 171 aa, Artificial Sequence; identical to SEQ ID NO: 3174
  Synthetic

SEQ ID NO: 3176 - protein, 171 aa, Artificial Sequence
  Synthetic
SVEETVDEELKKIHETHKRVVDKVRREHEKSHKKHRDILKRVEEVHRRILTDLERAGVDESIIKEARDHVERSREELRKSDEDNKRNIETVDDKARRSDEELKKDIDELRKAKLDKKDLDEMLRRLKRKVDESERDLKKHLDDNKRAVEKSREDAERNLKELRDKIREVKR

SEQ ID NO: 3177 - protein, 171 aa, Artificial Sequence; identical to SEQ ID NO: 3176
  Synthetic

SEQ ID NO: 3178 - protein, 180 aa, Artificial Sequence
  Synthetic
REEEEARKVLEELKRDVERNERESKEILDKDKRDVEEWVKELEKMLEESKKLVDDVRKAKKDLREEELEREVRRIEDTNRKLNTDVEEIVRRHVDKSEKLVERDKRLVEEWERKAEEIKKRLSTIEELKKAVEDIIRTLREVLEKSRKTLKDSNDRLRRALEKAREDSKRSIRRLREELR

SEQ ID NO: 3179 - protein, 180 aa, Artificial Sequence; identical to SEQ ID NO: 3178
  Synthetic

SEQ ID NO: 3180 - protein, 185 aa, Artificial Sequence
  Synthetic
SVREDAKRLLEELERAVRELVERLKKLIERHRRASEDTRRELEKLLRELEKAVEELKRGNKEEEKVRDVLRKLKERAEEIKKRLREIHEELRKHSEDLKRRLTEALDTLRKDIERIKRELTRDVRGTKALEDVKEALDRILERVKRAIEEARKKLDDVDEHNREVIERVEKEIDRILKDVEDAAR

SEQ ID NO: 3181 - protein, 185 aa, Artificial Sequence; identical to SEQ ID NO: 3180
  Synthetic

SEQ ID NO: 3182 - protein, 185 aa, Artificial Sequence
  Synthetic
SVEEEARELIERLRKLSEDTMRRLTELLKEHERLSRETKKEAERLLDELRKKVDDLTRDNRDDEEVRRVDEKLKRDVEKIKRDLRKIHEEVKKHSEELRRELEKIHKDVDDTVKEIKDRLDKKVKDDEVLERVKRELDRILDHNKKVVDEAERALRRVDKHNEDVLREVEKTLERILDKVKESAR

SEQ ID NO: 3183 - protein, 185 aa, Artificial Sequence; identical to SEQ ID NO: 3182
  Synthetic

SEQ ID NO: 3184 - protein, 178 aa, Artificial Sequence
  Synthetic
SVEEKLEKIVRDLERRVRKSEEDLRRMVEEVERTVEKHREELKRVVDTLRKIVRDKGADEDLIRELEKLKDDLRKRNDEARRRAEELKRRLEDLIRRSREESERLRKELDDVIRDDVKDEKVARDIKDKVREIIRRNEEVLEEVDRRARELIERLERTIEKSERDVERIIRELRERAK

SEQ ID NO: 3185 - protein, 178 aa, Artificial Sequence; identical to SEQ ID NO: 3184
  Synthetic

SEQ ID NO: 3186 - protein, 176 aa, Artificial Sequence
  Synthetic
SKEEEAEKLVRDLEDSSRKHKDRLRKLVRDLEELVKEHERDLKRIVEELKKLVDDASRSKREDVLKTVEDRLRELEEKLERSTRTIREVVKRVEEDLDRSTEEHEKLVEDIRRELEKRGGIKELEEELRRNLKEVREVTEDAKRKLRDILRKVEDASRRVKEMLDKILKRVEEEIR

SEQ ID NO: 3187 - protein, 176 aa, Artificial Sequence; identical to SEQ ID NO: 3186
  Synthetic

SEQ ID NO: 3188 - protein, 177 aa, Artificial Sequence
  Synthetic
KLDEDIRKLLKEALDRNKEMLERLKKTLDEALEKVKKLLEDLRRVNKEVEDELRRAGLPEDSLRKVKKESDRSLREIEREVREAERRLKEILDELKRVLDRSKEILDELKKDLDRVRGEDVLREVIRRIRKVIEDTDRTWKRLIDEIRKEVKDVLDKARRLIRESEKLMEDIKRRTK

SEQ ID NO: 3189 - protein, 177 aa, Artificial Sequence; identical to SEQ ID NO: 3188
  Synthetic

SEQ ID NO: 3190 - protein, 177 aa, Artificial Sequence
  Synthetic
DMEKRIEKLLKDMLDRVRELHKRVREVNKEVNKRVKELHDEVRKVNEKVNKAVKDRGLPEELVERVRRKSETTRKTNEEKLERINEESRETERTNEKLLDDIRRRLEELRRDLERVRGEEVLARVIERIRKDVEKVLREAEKHIEESRRLARKVLEELRRHIEENRRLLEEVDRRRR

SEQ ID NO: 3191 - protein, 177 aa, Artificial Sequence; identical to SEQ ID NO: 3190
  Synthetic

SEQ ID NO: 3192 - protein, 171 aa, Artificial Sequence
  Synthetic
EVEKKVEELLKRIEDDNKRVADRSRKLLRELKKRLEDVVRESRELLRRILKKLKEAGGRDEVEREVRRVVEENERRLEEILRRVEEVVKRNEDELRKSHDRLRKAVEKMRRAKIREDEVADRLRKLRKESEEVVERSDRHLKDLERRIEEMAERSRRHLKRLEDKIREDAR

SEQ ID NO: 3193 - protein, 171 aa, Artificial Sequence; identical to SEQ ID NO: 3192
  Synthetic

SEQ ID NO: 3194 - protein, 178 aa, Artificial Sequence
  Synthetic
SMEDRVREMLRTIKRVIEEAHERSKKILDEDRKVLKAVEDAVRDVLTKIKKLLDDARRRGQVSDDLVREITEKIKRILDEVRRIIEKNERELERWRREDEEILKDLERLLRELEKDVRTTKVDEEVVKRAKKLLEEIEKLARESLERLRDNLRKTEKLLKDLLDEAKRLLEEIKETVD

SEQ ID NO: 3195 - protein, 178 aa, Artificial Sequence; identical to SEQ ID NO: 3194
  Synthetic

SEQ ID NO: 3196 - protein, 178 aa, Artificial Sequence
  Synthetic
DIEEEVKKILDEIRERIKKMKRDLERLSKEDEDVLRKVKKDVDEVLKRAEESLRDVKRRGRVDDEVVERLKRRLDRLREDVRRIVEDNKRRLKEWNERTEEVIRRLKKRLDDVRREVRTTKVFEEVLRKLEEILRDIKRKADELRKRYRENIEETERLLEELLRRAEELLRRLDETAR

SEQ ID NO: 3197 - protein, 178 aa, Artificial Sequence; identical to SEQ ID NO: 3196
  Synthetic

SEQ ID NO: 3198 - protein, 181 aa, Artificial Sequence
  Synthetic
SEAEKLLEDIRRIIKEVKENVERSLEKIKRLIEELEKNARDLVRRIRKLIEDLERKVRRDGNTEELRREVEKLEEELREHVKRHEEKTEKLAEELKEHNERHKTESEKVERKLREDLKRIEDEKVIRDIEKLIEDLKRISEKANEDNKRLIDDMRRISKEVARTIKELIERLRKIVEEARK

SEQ ID NO: 3199 - protein, 181 aa, Artificial Sequence; identical to SEQ ID NO: 3198
  Synthetic

SEQ ID NO: 3200 - protein, 181 aa, Artificial Sequence
  Synthetic
SEAEELLERIKKLIEDLKRDAERLLREIEEMIKDIRRHVEEDLRRLREVIKEIKRLVDERGNTDDLERRVEEISRRNEKNIKDLEDKVREIVRRLEEVLKKHKEDTDRLVEKLKEDLKRIKDEEVEREIRRLIEEMKRISEEVRKEIKRLIDELEEIVRRAKEALKKLNEELKRIVDEAKR

SEQ ID NO: 3201 - protein, 181 aa, Artificial Sequence; identical to SEQ ID NO: 3200
  Synthetic

SEQ ID NO: 3202 - protein, 178 aa, Artificial Sequence
  Synthetic
SKVEEVLKRLERLIRELKRLMDEVREDNREVLERLERYAERNERENRELLKKLEDVARRRSPREELRRELKEIHDRNRKSIEELEDRLRKVHERNRDIIRRLRETLRKIEEDLKELTKDGVSKEELDKMLKTAERVLREIEKDIEKLDRDLKRVVERIRDRSRRLDEAAEEIVRRIED

SEQ ID NO: 3203 - protein, 178 aa, Artificial Sequence; identical to SEQ ID NO: 3202
  Synthetic

SEQ ID NO: 3204 - protein, 178 aa, Artificial Sequence
  Synthetic
SKMEEVLKRLEKLLRELEEYVERNERENRKLLEELEDYVRRNEKRNKEILEELRDVVRRRSPREDLRRKLEEAHKENRKSIEDLRRKLERIHERNKRSVEELRKRLDEIKKEVDELRRDGVSDEELRKALERLRRVVEKVEDISRELDDRLRRVVEKAEEISRRLDEEIKEVVDRAEK

SEQ ID NO: 3205 - protein, 178 aa, Artificial Sequence; identical to SEQ ID NO: 3204
  Synthetic

SEQ ID NO: 3206 - protein, 178 aa, Artificial Sequence
  Synthetic
SKVEKVLDDMRRIIEEAERLLEEVKRRHDEIIERVKRYAEENRRRNEELIEDLKRVAEKRGPREDLRDKLRRIHKENEDSTRELRDRVRRVNEESRELVERLERKLRDVARRVDELRKDGISKDDVRRLLEELRKVVEDVKRLSKKMNDRIEKIAKEIEEESERLDRTIAEIVKEIEK

SEQ ID NO: 3207 - protein, 178 aa, Artificial Sequence; identical to SEQ ID NO: 3206
  Synthetic

SEQ ID NO: 3208 - protein, 181 aa, Artificial Sequence
  Synthetic
DEVEKVLEELRRLLKEDEDIVRELLKRLKELLEDIDRIAKETEKEWRKILREIEELRRKPIPEEDVKRLRERVERVLRESEKRVKELRERLKELLKKIEEDLRRSEKRLKELRDDIRRKGLPEDAEREVDRVVRTIEESTKDAREKVKRMADEIERIIKEVEDLNRKLVEEIERVIREVER

SEQ ID NO: 3209 - protein, 181 aa, Artificial Sequence; identical to SEQ ID NO: 3208
  Synthetic

SEQ ID NO: 3210 - protein, 173 aa, Artificial Sequence
  Synthetic
DSEETLRELVKTIEDSSRKVKKRNEELARELRRRIEEAREANDRLVETIRKEIRELPVPEETVRRLEELIKTLKERSEELVRKLEDKIRRILEKSEKLLRETKKELKELTDKLKDLRREELEKTARKLIEDDEKKARDTEREWEELIRDIERLVRESLEAWKRLREEIRETVR

SEQ ID NO: 3211 - protein, 173 aa, Artificial Sequence; identical to SEQ ID NO: 3210
  Synthetic

SEQ ID NO: 3212 - protein, 173 aa, Artificial Sequence
  Synthetic
KSEEELRKLVRELEELIERMERTNEKLLRELKEVLDRARERNEELVRRLEDLIRRLPVDKDTVEELKRLIEELKRKSEEILRRLEKKLRDHRREVKKLADDLRRKIKELEDKLKDLREEELRKEAEDLIREIEEKVRRSKRNLEELIREIRELVERSEDEWRKLIKRIADAVK

SEQ ID NO: 3213 - protein, 173 aa, Artificial Sequence; identical to SEQ ID NO: 3212
  Synthetic

SEQ ID NO: 3214 - protein, 173 aa, Artificial Sequence
  Synthetic
SSEETLERLLREIERVLEEARKRNEDLVRKIREVIKEALERNKRMLEEIKKEIDRLPVEEELVKDLRDKLDKHRREVEKIITELKRLIDELKKESDDLLDEIRKKLKDLKDLLKDLRSEELLRTAKRLLEDIERIVRETLKKWRDLEREIRKLVRESTENLKRIIEEIRERAR

SEQ ID NO: 3215 - protein, 173 aa, Artificial Sequence; identical to SEQ ID NO: 3214
  Synthetic

SEQ ID NO: 3216 - protein, 174 aa, Artificial Sequence
  Synthetic
SKVDEVIRDLARLLDELRRHVDDSVRRMDEVVKRSTREADELAKRLDELVKEVEKKPGDKRVERMVREIERLVREVLEELKKKYEKLKREVEENLRRLEETVRDIVEKARKVTEDGVSKEKIDRIIRELERILEEAKKKHEDVLRRLEDSLRRVAELLKAALDRLREIVDRLRR

SEQ ID NO: 3217 - protein, 174 aa, Artificial Sequence; identical to SEQ ID NO: 3216
  Synthetic

SEQ ID NO: 3218 - protein, 174 aa, Artificial Sequence
  Synthetic
SKADDVIRKLRELLEELRTHVEKSIRDLRKMLEDSTRHAKRSIEELERLLEEVRKKPGDEEVRKTVEEISRRVKENVKRLEDEYRRLEEEVKKNLDRLRKRVEDIIREVEEMRKDGVDEEKLKDLIRKLRDILRRAAEAHKKLIDDARESLERAKREHEKLIDRLKKILEELER

SEQ ID NO: 3219 - protein, 174 aa, Artificial Sequence; identical to SEQ ID NO: 3218
  Synthetic

SEQ ID NO: 3220 - protein, 174 aa, Artificial Sequence
  Synthetic
SKVEEVVRTLDELLKRLEEHVKESIRRIKKVIDDSNREADELIRDIDRLLKELEKKPGSKELTDEARKIAEKIRDVLRRLKEKYERLEKDIRDNVRRITEEVKRIEEDVERLKEDGVDKDRVERIIRELRRILEEIRDLHRKLEEELRRSLKEVEDRLRELLKKLEDILRELRR

SEQ ID NO: 3221 - protein, 174 aa, Artificial Sequence; identical to SEQ ID NO: 3220
  Synthetic

SEQ ID NO: 3222 - protein, 180 aa, Artificial Sequence
  Synthetic
DEVEDLLRKLKDTIRRLKAHADRDLKKLEEILEKLRRHVEKNLRDLERILKELKDLSRTIDDEELRRRVEEVIKKDRDNNRRLNDESRRASEENRRNLETLAREVERVVKELEDELSRVRVEEVAERVRRVIKELRKLLEEIARALEDVNKKAKEINDKADEDSKRVNDELKRIIKEIRD

SEQ ID NO: 3223 - protein, 180 aa, Artificial Sequence; identical to SEQ ID NO: 3222
  Synthetic

SEQ ID NO: 3224 - protein, 180 aa, Artificial Sequence
  Synthetic
SEVDELRRRAEESSKKIRKIAEELTKRLKDLLETIRRLMRKIEEDMKRTSEEIKDLIRRGNTEEVLKRLEEKSRDLLEKVRKILEELKRELERLEKEVEERLEKLKRESEDLERRVSNATDDRLRDVVKKLHKKNKDILDEIRDIVRRLKEEVDTILKEIKERLEELHKNNERLLREAKR

SEQ ID NO: 3225 - protein, 180 aa, Artificial Sequence; identical to SEQ ID NO: 3224
  Synthetic

SEQ ID NO: 3226 - protein, 181 aa, Artificial Sequence
  Synthetic
SAKEKLEDLLRKLKRILDELEKTSREMKERVERIIRELEKTVREVHERIKRLIDEALKRNRGDDRVREIVEEIRKKSEDVNRETEEIAERLRRELKKLDDEDKDILRRLKERIEELRRKAEETSISEELKKELEDLLRKIEKLIKESEEKWRRLLEEIKREIERLRETYAEILRDVKRRDK

SEQ ID NO: 3227 - protein, 181 aa, Artificial Sequence; identical to SEQ ID NO: 3226
  Synthetic

SEQ ID NO: 3228 - protein, 181 aa, Artificial Sequence
  Synthetic
SAEETVRKLLEEIKEIIKRMEDRVREVLEENRKSIEDLEERVRRLHEEVERIIREALEDLRGDKRVDEIVKELRERSDRLNKRVEEILRELKKESEDLDREVKKIVEELRKRLEDAAEEVKRTKIDDEVKRELKRILEEIEKLIEELLRRMKESNKKIRKLAEDLTREYKRLLDEIRKRRK

SEQ ID NO: 3229 - protein, 181 aa, Artificial Sequence; identical to SEQ ID NO: 3228
  Synthetic

SEQ ID NO: 3230 - protein, 174 aa, Artificial Sequence
  Synthetic
REVEEVVKRAEEVIRRLEKEVEDIVRRVAKHLKDNEDHARRSVERLRRDIEELKKEDGDDEVRERIRRLKEDVDRDNKELRDNVERVKREIDRMVDELRKKLEDLKRRIDDVRRRGLLDELVKEVKKKIDDVLKKAEDLARKLKKEHDEVVARITEAHDEVKKRVEKVLKELED

SEQ ID NO: 3231 - protein, 174 aa, Artificial Sequence; identical to SEQ ID NO: 3230
  Synthetic

SEQ ID NO: 3232 - protein, 174 aa, Artificial Sequence
  Synthetic
SKVEDVIREIRELIKRLEKHVKDSVREVRKHIEDNKRKVEKLVKEVEDVIRELRKEDGDERVEEKVERLKRRIDEMLKDLEENLRRVKREVREDNRRLKKLIEDVKKKITDVERDGLMRELAEELRRRLDEVLEKATRLHRELEKRHDDVLREAEKRLRDLKREIDKVLDDLRR

SEQ ID NO: 3233 - protein, 174 aa, Artificial Sequence; identical to SEQ ID NO: 3232
  Synthetic

SEQ ID NO: 3234 - protein, 175 aa, Artificial Sequence
  Synthetic
EEVERVVKELRDHLAETKKKIDEIIKRLDDHIEENRERVERMVEELRRILKEIRDSNVREDEVRKLVEELLRRAREVLRESEKNIRDVKKEAEDVLRDLERNIRDSERKLEEVLRRGLAREVVDEVRKEHRDVLREAEELIKRVEKDHEKSHREVKKLIEDVERRLREVLKELRD

SEQ ID NO: 3235 - protein, 175 aa, Artificial Sequence; identical to SEQ ID NO: 3234
  Synthetic

SEQ ID NO: 3236 - protein, 175 aa, Artificial Sequence
  Synthetic
KEAEDTIRKVSKHIEDNKRKVEEMIKKLKEHLKETEEKIRRIVKKVRDEVRKLEENNVPEDEIKELVDRLRKELKDVLDDLKRNIEEVEKEAEDILRESEKNIRDVEKELEEMRRNGLDEKLVRDLKRRHKESHDEARKLIEEVRREHEEVLKRAEDLIRELDKRLKEVLDKLRK

SEQ ID NO: 3237 - protein, 175 aa, Artificial Sequence; identical to SEQ ID NO: 3236
  Synthetic

SEQ ID NO: 3238 - protein, 175 aa, Artificial Sequence
  Synthetic
SEAEEVVRRVEKHIRDTEKKIRDIVRRVKEEVDRNSERVREMVERVRKEIEELERAQVPEDRIEEEAKRLEEELKRILEEDKRNIDRLKEELDRELEDLRRNIREVERRLDELTRRGLKKEVVDELKKRHREVLEEARRLIEELKERAERSHRESKKLIDELREEIRRVLEERRR

SEQ ID NO: 3239 - protein, 175 aa, Artificial Sequence; identical to SEQ ID NO: 3238
  Synthetic

SEQ ID NO: 3240 - protein, 178 aa, Artificial Sequence
  Synthetic
SEVEDIVTKLRDKVERHREEVKRIIDTLKKLVEEHKRRVDDEVKKLDDTVKRLREANVDEETLREVEERIDERLRRVLDRSREVKKRLDKALDEVRKRSKEVHEELRRALEEVRKRSRDKRVDDLLREVEERLERSNREARKLLEEVKREMEESHRRLKKLLDEVREKVRRVVEELRK

SEQ ID NO: 3241 - protein, 178 aa, Artificial Sequence; identical to SEQ ID NO: 3240
  Synthetic

SEQ ID NO: 3242 - protein, 177 aa, Artificial Sequence
  Synthetic
KVEELVKEVDERIKKVLDDLRRALEDVRKKAEDSVRRMEELSEKVKRDLDRVIAKAEEKGLDEKDLDELRRILERLRRENKKLNEESRRDLEEVRKELEEVLKRAEEMVKRLKDTLRRDGVDEEVVKRLEEILRRLKETIDRVLERLKRRVEDHDRKVEKRVRENEKAVEDLKRRID

SEQ ID NO: 3243 - protein, 177 aa, Artificial Sequence; identical to SEQ ID NO: 3242
  Synthetic

SEQ ID NO: 3244 - protein, 179 aa, Artificial Sequence
  Synthetic
SVEEVLEEARKDIDRLIRRMEEISERAKEKIERLIDELRKISEEANKKNEEVLRELREKGGDNKERVDEIEERLKRHNEEHRRRTEDLERKLRKHVEEHKERTREIKEELKRLLKELEEANIPREDIKREVDRLLEEIRRLIERLRENVKKLLDEIRKLIEELDENVKRSLKKLRDDIR

SEQ ID NO: 3245 - protein, 179 aa, Artificial Sequence; identical to SEQ ID NO: 3244
  Synthetic

SEQ ID NO: 3246 - protein, 188 aa, Artificial Sequence
  Synthetic
SLDDILREVRRTSRELNEESRRIVDRAKRESEELLKELETILRDATRRLDDLLRKLDEKRQDEEVKKILRDLREEIKKLREDVKRELDRLRKHTEDLVRKVEELNRRSEEHLKKLEEEVDKAKKEGQDRETVVKELEDKVREHLRTNRELIERLEKEMRDHLREIKRKIEELERRIRKLVEEVKRRID

SEQ ID NO: 3247 - protein, 188 aa, Artificial Sequence; identical to SEQ ID NO: 3246
  Synthetic

SEQ ID NO: 3248 - protein, 175 aa, Artificial Sequence
  Synthetic
DELEDLVRKAEKLVRESEKKIKEIVDDARRLIEDSEREIREIVKKLRELSKRVEEELRRDGPTEELEKKLRRITEELDKLLEDLRDKNRRINEKLRKDIKELERENRDINRELTKRVRMKDLLKELRDKSKRVLEKLRRLLEEINKRSRDVLEKLKRLADEVRESNREVLDRARK

SEQ ID NO: 3249 - protein, 175 aa, Artificial Sequence; identical to SEQ ID NO: 3248
  Synthetic

SEQ ID NO: 3250 - protein, 172 aa, Artificial Sequence
  Synthetic
RELEEIVKDAERLVKKDTEDIRDKVRRAEEVVKKDTEDLEESVKRVKDKVKELEDANIRRDEARKVAEEMKKELKEVLDDNERKSRDLKTKLRKVLEENKKKVDEIREDLERRMKSEELLREIEERIKRSLDESRKLVREIEKKVDESNERSRKLVEDVEREIEEVLKRLAD

SEQ ID NO: 3251 - protein, 172 aa, Artificial Sequence; identical to SEQ ID NO: 3250
  Synthetic

SEQ ID NO: 3252 - protein, 177 aa, Artificial Sequence
  Synthetic
SSEDILREVKKLLDDSLDKLRRLIEKIKEDLDRSVDRHRKLSEEIRRRHERVREAVERRGSSEEKKERIERNIREVEEEIKKVDEESKRIVDKLEKELREVLRKSEETIKKIRKDIKDEGVDEDVARKLRELVREHSKEVEDKVRRAARLVEEHTERSDRVADKLRKHIEETKKRID

SEQ ID NO: 3253 - protein, 177 aa, Artificial Sequence; identical to SEQ ID NO: 3252
  Synthetic

SEQ ID NO: 3254 - protein, 177 aa, Artificial Sequence
  Synthetic
SKEEILKEITDRVRESRKRTKKLLDDVREELERSHRRLEKLIREVEKRLREVKRKVDESGQSEEMVKRVEDVVRTLTEELKKVLKENRDEIRRIEKRIKEIDEENDRTIRRIEDRIRREGADEDVVRDLRRLVKEDTDRARKVVRELEREVERDKEEVERIVDKAEKKVRELEERIR

SEQ ID NO: 3255 - protein, 177 aa, Artificial Sequence; identical to SEQ ID NO: 3254
  Synthetic

SEQ ID NO: 3256 - protein, 178 aa, Artificial Sequence
  Synthetic
DEVEKAVADLRRLNEEHTRDIDKAARDLERLVKKHTDEVRKLVRDLEKLVKDLKDANLREDEVEEVVRRIDETLKRILKRSEDVVREIERELDKIRRKSEEAVKRSEDMLREIARRSRDEKLEELLKEVEETTRRSLRRLEELLRKVERAVRESHKELKKLLDEVREKVKKVLEELRR

SEQ ID NO: 3257 - protein, 178 aa, Artificial Sequence; identical to SEQ ID NO: 3256
  Synthetic

SEQ ID NO: 3258 - protein, 178 aa, Artificial Sequence
  Synthetic
DEVEKAVRDLEKLNEEHTRRVEKVVTDLRDLVRRHTEEVRKLVDELRELVERLRRAKLDDKTVKKVADDLRKKLRDIEERSKEMVKKAEETLRRILEDSKRAVDESRDRLREIARRRRDKKLEKLLDDVRKTTETSHERLKRLLEEVEERVRRSHEELKDLLRKVKELVEKVLRELKE

SEQ ID NO: 3259 - protein, 178 aa, Artificial Sequence; identical to SEQ ID NO: 3258
  Synthetic

SEQ ID NO: 3260 - protein, 178 aa, Artificial Sequence
  Synthetic
SEVEKLAKELRDLVREHTKRVRELIDELKKRVEDHTRKVEEIVKRLKKLVDDLRDANLDKDEVRKALEEAKRRLDDVRRRSKEVTDRLDKTLKDIERESERAVREMDRRLREIERRSRDKKLEKLLKEVRELVKRSHDELKKLLDRVREAVEKSKRRLEKLLDTVRRLLEKVVRDLER

SEQ ID NO: 3261 - protein, 178 aa, Artificial Sequence; identical to SEQ ID NO: 3260
  Synthetic

SEQ ID NO: 3262 - protein, 178 aa, Artificial Sequence
  Synthetic
SEAEKLVEELRRLNERHTRRVEEVVRRLDEEVKKHRKDVRELVRELRKLVDELRKANLDEDTVRKVAEEAKKRLDEIRRKSERVVERMRRELKKIKDESEEMVKESRKRLTEIARRSRDEKLEELLREVEETTEKSHRDLKRLLDRVREKVEDSHKELEELLKEAKDRVDRVLEELRR

SEQ ID NO: 3263 - protein, 178 aa, Artificial Sequence; identical to SEQ ID NO: 3262
  Synthetic

SEQ ID NO: 3264 - protein, 178 aa, Artificial Sequence
  Synthetic
SLEDKVRDDVRKLLAEAKKVADDLRKVVEDHRKTVEDVIREIRRRVEEHLKKLKELIDAGVDERVLEELKRHSEKLVEDIERLLRELNKHSERLLREAEKILRELEKKVRDTKKELRDRGVDDRVLKRIEEEIRRLLKELREIVKDLERLDRELTDELRKLVEEVRRLSETVLDEARK

SEQ ID NO: 3265 - protein, 178 aa, Artificial Sequence; identical to SEQ ID NO: 3264
  Synthetic

SEQ ID NO: 3266 - protein, 182 aa, Artificial Sequence
  Synthetic
SLDEDVAEKMKELEKENKDLLDTIRRLIEELEKHARELLKRIEDLIRELTEDAKRLEDSNLREDELKRELDRLRDKVRKVRKEIEELLKEHEDRSRKVVRDIEEKLKESNRKVKELLEELKTRGVDRRILEEIRRTNEELTERVRDLVEEMRKTSEELLKEVRKIADEVRRTVEEALKRLEK

SEQ ID NO: 3267 - protein, 182 aa, Artificial Sequence; identical to SEQ ID NO: 3266
  Synthetic

SEQ ID NO: 3268 - protein, 179 aa, Artificial Sequence
  Synthetic
DEAEKILRDAKRLVEELSKKLEDNLREIKEVIDRLSEELDRNLKEHRDLIRKLEEDMDRKGVDDKEKKKLREDHDRYRKEVEERKKKLRDELKKYKERVEEMIEKLKRRLEEIEKRIRDEGKITEERAREVEEDIKRAEEEVERSIRESKKRTRDAEREVRESKKKSEDHIREVEKRIR

SEQ ID NO: 3269 - protein, 179 aa, Artificial Sequence; identical to SEQ ID NO: 3268
  Synthetic

SEQ ID NO: 3270 - protein, 183 aa, Artificial Sequence
  Synthetic
SELEELLKELKEIVERSADHLRRSNDDLRKIIEEVTKTLEKILEDLKRIVEEVVDRARKKVSDKDRVRELKKRLEEDLRRVEKKVRDIKKEAEDSLRKSEEDVREYKRKLKEDLDRLKEIIERNEDREEELKKKLKELKDRAKETNERHRRDVERLMEKLRRDLERLDREVKDLEKKLREEEK

SEQ ID NO: 3271 - protein, 183 aa, Artificial Sequence; identical to SEQ ID NO: 3270
  Synthetic

SEQ ID NO: 3272 - protein, 172 aa, Artificial Sequence
  Synthetic
SDREEIKRRVEEEAKKSRENLKETLREVDERVRDSERNLKRHHEEVKKAIDDLRRSDVPREEITKRLRELLRRSEKKIEEAMRDHDRILKEIKERADKAERDHDDRLRKLEERGLEKRILDDVRRLLEELKERYRRIVDEIKKLLERLKEAYKRNLDRVRELIERIEKEIRD

SEQ ID NO: 3273 - protein, 172 aa, Artificial Sequence; identical to SEQ ID NO: 3272
  Synthetic

SEQ ID NO: 3274 - protein, 180 aa, Artificial Sequence
  Synthetic
SELEEVKERIERLVRRHKEELEKVRREIEREVKKHEKDLEDLERRSREHIETAERLLAENRVREDEVRRILKENRDEAREVEKKSREHLDRLKKRLDKLREDSKRHLEDVERDLKRLKDRGDVDDRILEEARRLLDRLREENEKVLKEAEDMLKRLEDENRKMLEENEKLLKELKKEVDK

SEQ ID NO: 3275 - protein, 180 aa, Artificial Sequence; identical to SEQ ID NO: 3274
  Synthetic

SEQ ID NO: 3276 - protein, 180 aa, Artificial Sequence
  Synthetic
SEVEEVLKTIEKKDEEHKRELERVKEEVDEDAKRHRERLKKVDRDVKEEIKRLRKLLEDRTVDEEEVREELRKLTERLDKLRKDSEKHLRDVEDKLRRLRERSERHLDTVRKELEDMRRRGDIEEKILEEIKRRLDELRKRNEDLLRRVKELLDELREENRRLLEDAKRLLEEVLKRARD

SEQ ID NO: 3277 - protein, 180 aa, Artificial Sequence; identical to SEQ ID NO: 3276
  Synthetic

SEQ ID NO: 3278 - protein, 180 aa, Artificial Sequence
  Synthetic
SELEEVEKKVREDARRHKEELRRVEEEVKRNAEKHRDELRRVREDIERKIRTLRELLKERRQSEEDVKRRLDKLRDELKKLKERSKKHLDDVERRLEELRKESERHLREVEKELEELRTRGDVSEEILRRVKKLLDELRDENRRLLERVRELLERLREENERVLREVKKLLDEVKREAEK

SEQ ID NO: 3279 - protein, 180 aa, Artificial Sequence; identical to SEQ ID NO: 3278
  Synthetic

SEQ ID NO: 3280 - protein, 182 aa, Artificial Sequence
  Synthetic
SEREKLLKELKDNLDESRRRVEELLKRIKENLEEVKDRAKKTLDDLKRDIEELRKLVERRETREEEIKKKLKEHDEKTEKIKRDLRDHLRRHKEDTKRLVEELKKHLEDHKRKIEDIERKLKDEDVKRRLRDLSRRLAREHEKVIEKLRRLSDELEKIHREIEERLERLSDELRKEADKARK

SEQ ID NO: 3281 - protein, 182 aa, Artificial Sequence; identical to SEQ ID NO: 3280
  Synthetic

SEQ ID NO: 3282 - protein, 182 aa, Artificial Sequence
  Synthetic
DEARELLKRLREINEKLKKDVEEIERRLEKYNRDVKRKLDDSIRELKEKLDRLRERIRDEGTGREDLERVKKDVEDYLEENRRRAEESKRELERLLREVREKLKRSVERLDEALEKVDRDGLPEDVRRAVEELVRRHKDTVKKIEESVRRLVEEHKRTVKEALDRSRRIAEEIKRVLDEAAR

SEQ ID NO: 3283 - protein, 182 aa, Artificial Sequence; identical to SEQ ID NO: 3282
  Synthetic

SEQ ID NO: 3284 - protein, 182 aa, Artificial Sequence
  Synthetic
SEEEKLLTELKKLNDDLERRVRKSLDEIRRYNEKMREDVRRSDREVREEKKRLDEKLKKDGTDDDELRRVKKKLEDYLRRNEEEVRKSREEVRRYLTKNREDVRRSKEELRKLLEKVKKDGLPEEALKKVRELVERHKRTVDEALEKSERLLREHERTVDEVLDRSRRAVEEVKKTLDDARK

SEQ ID NO: 3285 - protein, 182 aa, Artificial Sequence; identical to SEQ ID NO: 3284
  Synthetic

SEQ ID NO: 3286 - protein, 181 aa, Artificial Sequence
  Synthetic
REAEEVRRRIEESHEEVRRRARKDERDLEESHKRLEEKAKELKDELRKILKDIDDLAKSNVSEESVKKLKEDLDRKLEEVERRMREDKKRHEDHLRESEKDMRRLKKEHRDRLEELRRAGLPEDVLRDIEKLVRDNEEALDRILKRTKELVDRNLEAIDRILKEVEELVRRIKELLDRAKK

SEQ ID NO: 3287 - protein, 181 aa, Artificial Sequence; identical to SEQ ID NO: 3286
  Synthetic

SEQ ID NO: 3288 - protein, 179 aa, Artificial Sequence
  Synthetic
SEVEEVLERLKRKLDEIERESRESAKKIRREIERIEKEARDSLRRLKKLIKEIEDRVRRDGRRRDELDELLKRLEDYVRRSVERLERLLEDLTKKVRDHERTLRRRLKRVRDDIERLKEAGIDREELEKLLKRLEEVVRESEKEIEDLLRRVRELIERIKREHEKILKEAEEVIRRVKK

SEQ ID NO: 3289 - protein, 179 aa, Artificial Sequence; identical to SEQ ID NO: 3288
  Synthetic

SEQ ID NO: 3290 - protein, 179 aa, Artificial Sequence
  Synthetic
REVEEVLRELEEHIERSKRKSEESLKEIRRRIEEIEERSRRSLTELKKRIDDIKRRVEKDGPREKELDDLLKDLKRKADEHAKRLRDLLKELEDRVREHERDLERNLKEIKEKIEELERAGIDKEDLKRLLDKVTEVHKESAKEIRKLLDEARKVIEDSLRAIRDILRKIKETIDRDKT

SEQ ID NO: 3291 - protein, 179 aa, Artificial Sequence; identical to SEQ ID NO: 3290
  Synthetic

SEQ ID NO: 3292 - protein, 179 aa, Artificial Sequence
  Synthetic
EEVERVLEKLKRHIDDSRRKSKRSVDEIRKHIERSKRRSEESVERVKRELERIEEKVRREGNRRDELKTDLDRLRRYVRKHVEDLRENLKRIDERIKEHEDRLDKNLEDLKREIEELRKAGVDEEELKKLLEEAEKVHRDSKRELRKLVKEARDVHRESMETVKRLLDELEREIRRAET

SEQ ID NO: 3293 - protein, 179 aa, Artificial Sequence; identical to SEQ ID NO: 3292
  Synthetic

SEQ ID NO: 3294 - protein, 179 aa, Artificial Sequence
  Synthetic
SEDEEALKKLKEHIDRSREESKRSLDRVKREIERIREEIERDLRRLREELKKIEDRLRRDGPRRDDLERLLRRVEEEVERLKKKLDKLLEELRKYVEDHKRRLDENLERIRDEIRRLREAGIDEDELRKLLEDAKRVHKRSKDELKRLLEEAEKVIRDAKRKIKKLLDELRKVLEDARR

SEQ ID NO: 3295 - protein, 179 aa, Artificial Sequence; identical to SEQ ID NO: 3294
  Synthetic

SEQ ID NO: 3296 - protein, 179 aa, Artificial Sequence
  Synthetic
DEVRRVLEELKEHIKRSEKRVRENEEEIRRHIEKSKRDSDESLKELARLIKKIEDDVRREGTREKDLDKLLKDLERYVEEHKKRLDDNLRRLEEHIKRSKEELEKNLRRLREEIEELKKAGIDEEELKKILDEAEERHRRIEERHKDLLRKAEEVHRDSLRRLREILRRAEEVIRREKT

SEQ ID NO: 3297 - protein, 179 aa, Artificial Sequence; identical to SEQ ID NO: 3296
  Synthetic

SEQ ID NO: 3298 - protein, 179 aa, Artificial Sequence
  Synthetic
KEVEEDLERLKKHTEDTRKRARDNLERIKEELEEIRKESEDSARKVRRDIEEIKRRVDETGPDRDELDRLLRRLEEYVKRHKDRLRELLRRVEEHIKKSIRELREDLRRLREEIEELKKAGVDERELEKLLKEHEKTIRDIEEEHRRLLKELKDVVRESSRELEELLKEAEDVIRRVKK

SEQ ID NO: 3299 - protein, 179 aa, Artificial Sequence; identical to SEQ ID NO: 3298
  Synthetic

SEQ ID NO: 3300 - protein, 182 aa, Artificial Sequence
  Synthetic
DEVREALKRLEDETRKNKKESDKSLERLKEESKKNKDESDKSVKNIEDKIKKLKEDLDRDGPDEDRLREVLKRLRDYLREHKERLDRSKRKLDEELKKHREDLKRSKDRLDEELKRLDKEGLPEEVKRALDELVKDHRRVLEESARRIDEIVERHRRLLDDSLRRIAELVRRVEETLREERR

SEQ ID NO: 3301 - protein, 182 aa, Artificial Sequence; identical to SEQ ID NO: 3300
  Synthetic

SEQ ID NO: 3302 - protein, 182 aa, Artificial Sequence
  Synthetic
DEVEKALKELEDDLRELKKRSEESLKNVEEEIKRAKKELDESLDNLRKKIEELKRRLEKDGTNEDDLRRVLEELRKYLEDVRRKLEEVLRKLRDYLRKHEEDLRRVERELEKKLEDLERAGLPEEVLRKLETIVRKIREELDRSKKKLEKLIEEAKRELERVLKEHEDLVKRVRDVLEDARR

SEQ ID NO: 3303 - protein, 182 aa, Artificial Sequence; identical to SEQ ID NO: 3302
  Synthetic

SEQ ID NO: 3304 - protein, 182 aa, Artificial Sequence
  Synthetic
DDVRETLTRLRKETERNKRESDKSLENLKRKSEDNKRKIEESLKNMKRRIDEVKRRAEKDGPNEDELRKLKEELKRYLDRLREELERSVKEATEYVRRHERRLRESLKDLKRKLEDLDRRGLPEEVKKELDEILRRHKEVLRESERRLEKLLRDHRRRLEEALEEHKKLIDEAEETLKRIRD

SEQ ID NO: 3305 - protein, 182 aa, Artificial Sequence; identical to SEQ ID NO: 3304
  Synthetic

SEQ ID NO: 3306 - protein, 182 aa, Artificial Sequence
  Synthetic
SEVEKALKELEDKTRKNKEDSERSLDKLRKDIEELRKKAERSIRNMRDKLRKLRDDVRKEGPDKDRLEEVLREVERYLEELRKDLERVLEELKKYLEEHKRRLEESRRRLKEDLDKLEKDGLPEEARRKLKELVDRHEEVLRRSLERLKRLVEEVRRTLEKILRDHERLLDELRRDLEKDRK

SEQ ID NO: 3307 - protein, 182 aa, Artificial Sequence; identical to SEQ ID NO: 3306
  Synthetic

SEQ ID NO: 3308 - protein, 182 aa, Artificial Sequence
  Synthetic
DEVEERLRELEETTKENKRRAERSLENVRKKSRDNDKRIKESLDNIRREIKRLRDKVRKDGPNREELKEVLDRLRTYLKEVEKDLRRSLKELEDYLRKLEKELRESLEDLKKKLEDLRREGLPREVLEKLKEIVERHEEVLRRIKKKHEDLVREHRKRLEEARKRHEKLVREAEKTLDDVRR

SEQ ID NO: 3309 - protein, 182 aa, Artificial Sequence; identical to SEQ ID NO: 3308
  Synthetic

SEQ ID NO: 3310 - protein, 182 aa, Artificial Sequence
  Synthetic
EEVERILDELRRRNEDMRRRSEENERELRKRNTELRKKVEDSLRRLREDLKRIKKLVEEGRVDEETLRKLLEDVERYLKEHRDRLRKSLEDAKKRFKEHEDRLKKSLEDVERKLEELRREGLPEEVTKALEELVRRHRKTLEESLRKAEKVLRDHKESLERSEKKLKELMEEVKKLLDDARR

SEQ ID NO: 3311 - protein, 182 aa, Artificial Sequence; identical to SEQ ID NO: 3310
  Synthetic

SEQ ID NO: 3312 - protein, 178 aa, Artificial Sequence
  Synthetic
SREDEIRKRLEESLERVKKIIEDIKRRIDESLERIKELLKEIDERSKRSLEKIRRKIEREPRSEKVEKEAREHMKRLDELLREVEEYIERSIKELRELLDELRRYVEESEERLKELRRRGGSEELLRRARKAHEDLLREVKRRIERAEEEHKRLLDELRKVVERSKTEIKKLLDELRK

SEQ ID NO: 3313 - protein, 178 aa, Artificial Sequence; identical to SEQ ID NO: 3312
  Synthetic

SEQ ID NO: 3314 - protein, 185 aa, Artificial Sequence
  Synthetic
SRVEDVERKLRRKLEELKEDIERLREESRRSLEELERDSDRNRRESEDSLRRVEERIRRIKDDEDKERVTRTVEEELERHERRLRESKKRLDDEERKHKKRLEEVRREVTEKVRTIREELEELERDGVDRETLRRVEREIERLLRELEETLKRSEEELKRIVDEHRKLLERSKRELEKLVDEVRK

SEQ ID NO: 3315 - protein, 185 aa, Artificial Sequence; identical to SEQ ID NO: 3314
  Synthetic

SEQ ID NO: 3316 - protein, 186 aa, Artificial Sequence
  Synthetic
REIEEVLKRVEKVVRDDSRRNKEVLTRNRRKVERWKETLEDVLRRVEKAVRELRKDAEDRLREKKEKIAKVEDLLDKIRKTVKKVLDEVKKLLDDSIRLSEEMLRESERTLRDIEREVDEVSKKTRTEDILREVEKKLKELLDRSRELSDEVRKRSDESNKEIKKELDRARDELRRLLERIEEELN

SEQ ID NO: 3317 - protein, 186 aa, Artificial Sequence; identical to SEQ ID NO: 3316
  Synthetic

SEQ ID NO: 3318 - protein, 186 aa, Artificial Sequence
  Synthetic
DEIEKVLEEVERVVEEDERRNRKVLEENKRLVDEWDRRVREVLKDVKRRVDELDTRARRDLRENEEKIRKVRKLLDEIREVVERALKKVRELLERSIELSKRVAEDSKRTLDDIRRVVEEVARKTKDKEILDRVKERLERLLEESRELSERVKREIEETNERIARELERVMETLKKLLKDIEDELK

SEQ ID NO: 3319 - protein, 186 aa, Artificial Sequence; identical to SEQ ID NO: 3318
  Synthetic

SEQ ID NO: 3320 - protein, 186 aa, Artificial Sequence
  Synthetic
KEAEDVLKKVDTDVTRDDEDNRKLLEDNRRSVEEDERRNRRVLEEVEKRVRDLAERVKRDLREDSKRLEEVERLLRRIEERVTRALEDTKRTLEESLKLSEDVLRDSHRTNRDIKRVVEEVTRKVRTREILKRVTEELERLLAESERLSEEAEERVRRSDDTSRRLSEEVRKELEELLRRIEERLR

SEQ ID NO: 3321 - protein, 186 aa, Artificial Sequence; identical to SEQ ID NO: 3320
  Synthetic

SEQ ID NO: 3322 - protein, 186 aa, Artificial Sequence
  Synthetic
REVEEVLKRVKETVEKDREDNTRVLERNRESVKEDDDRNRKVLKRVRDEVRKLLEEAKRDLKDDEKKLREVTDALRRIIEEVERVLKESHDTNRESIKLSEKLIRDSERTLERIERRVDELVKKVRTEEILKRIEEELKRLLEESRELSKEVEDRVRKSDKKSRDLSEKVKKDLKELTDEIRKRLK

SEQ ID NO: 3323 - protein, 186 aa, Artificial Sequence; identical to SEQ ID NO: 3322
  Synthetic

SEQ ID NO: 3324 - protein, 186 aa, Artificial Sequence
  Synthetic
SEIEDILERVREEVDKDRRKNDEVLRENERLVKKDDDDNAKADEDVRRKVTELEKRARRELKDNREKLKKVKELLERIKERVKEVLRRSHKTNRDSERLSEKVVRDSRKTLREIEEVVEEVSRRIRSEEILKRVAKRLKELLEESKRLSDEVTKRSRDTDEESERLSRKVDKEVKDLLKEIERELE

SEQ ID NO: 3325 - protein, 186 aa, Artificial Sequence; identical to SEQ ID NO: 3324
  Synthetic

SEQ ID NO: 3326 - protein, 185 aa, Artificial Sequence
  Synthetic
SEVEEMEERLRKLDEDSRRLSEDVKRRLDKINKEIKDLLDDVRRKLKEMLDKLTKDLRDLKGKEEDVERVVREIEEDVKRVLKEVKRLVEESRRLSEKVLRDSERSVRESRELAKEALKRVKEKRAEDKVRDVLRDNERTLKKDEDDNKRVLDEDEKRLREWEERARRVLEEVRRRLKELVEEVR

SEQ ID NO: 3327 - protein, 185 aa, Artificial Sequence; identical to SEQ ID NO: 3326
  Synthetic

SEQ ID NO: 3328 - protein, 185 aa, Artificial Sequence
  Synthetic
REVDKAREDLRRVDDELRKILERVRRELEKLDKESEERSRRLARDLDRLLEELERDLKDNKGKRERVDRVVREIKEKVRRVLETSKKLVEKSRKLAEDVLREVEELVRRSKTLAEDVLRKVKEREVERKVREVLKDNERTLRELRDTIRKVLEDNDKTLREDVRRNEEVLRRVDETLRELKKRVE

SEQ ID NO: 3329 - protein, 185 aa, Artificial Sequence; identical to SEQ ID NO: 3328
  Synthetic

SEQ ID NO: 3330 - protein, 185 aa, Artificial Sequence
  Synthetic
SEVDKVKEDLDEVDKDSRRISREMEERLKELDKRSREISDRVVRELEKILKEIEDLLRDLKGRSEDVREMVRRLRELVKRVLKESKELVDRSRKLSDDALKESKRVADESRKLVEDALRKIDRKEARDKIRRVLEDNERTLREDIEDNRKVLEDNDKRLKDDERKNREVLKRVDETLKELDERVK

SEQ ID NO: 3331 - protein, 185 aa, Artificial Sequence; identical to SEQ ID NO: 3330
  Synthetic

SEQ ID NO: 3332 - protein, 186 aa, Artificial Sequence
  Synthetic
DELRELEERLRRSVEEIKRDLKRIHDENREAVERSERKSKKILEELKREVEDVKRELREKLKDDKEKVERVTRLLETVIKELRELVERNREELEESDREVDKLIKEVEKVLEDAERDLEDLVRRSRDEKLVREIERRVRKMEEDVRELVKTIEKRSRDVIKKSEDILKRIKERVEELEKRVRDAVR

SEQ ID NO: 3333 - protein, 186 aa, Artificial Sequence; identical to SEQ ID NO: 3332
  Synthetic

SEQ ID NO: 3334 - protein, 186 aa, Artificial Sequence
  Synthetic
DELRELLETLRDEVRKDDKRNEDIHRENRKRVEESRRRSEKILRDLREVVKRLEDELRKKLKDDKDKVRKVKRLLDEVIKTVEEIIRRNEKVLRDSDKTVREAIRRTHELNRRIIEDLEELVRKTRSEELLKRIEKRVRDMIRRSRTLSARLEDLSRELDERSKRVVEDLKRRIDEAIKELEKEVE

SEQ ID NO: 3335 - protein, 186 aa, Artificial Sequence; identical to SEQ ID NO: 3334
  Synthetic

SEQ ID NO: 3336 - protein, 180 aa, Artificial Sequence
  Synthetic
DETEEVAKKIKELIERSRELVKKVKEKIDRLNEEIEKLVREVEKTIKELTDRIEELRKRGVDAKDIERLLKEIEERVRKMLEDVKRILERSIRESEKALERNEEVLKRIKEEVEEALKRVDREEMKKLLDDLRKAVDESRRRSEEILKENRKRVEKWREDLRRLLEKVKEDLDRIRERLR

SEQ ID NO: 3337 - protein, 180 aa, Artificial Sequence; identical to SEQ ID NO: 3336
  Synthetic

SEQ ID NO: 3338 - protein, 180 aa, Artificial Sequence
  Synthetic
SEVEEAKKTLDELNRDIAKKVEDVEREIKRMIEESERLTREVEERIRRLTKKIEDLRRGGVDRKDIKELLERILKDVDKALKDSHKSNREIIRRVEEALKTIEELLKRSDELVKRVLDRVDEERVKKILEENKRDAERWKRRLKKLLDDVRRLVKEDDDRNEELLREVTERVRRIEEKLD

SEQ ID NO: 3339 - protein, 180 aa, Artificial Sequence; identical to SEQ ID NO: 3338
  Synthetic

SEQ ID NO: 3340 - protein, 180 aa, Artificial Sequence
  Synthetic
SEVEKVKEELKKLNKEIADSSDEVDKDIERLIRESRKLTEDVRREIKRLIERIDELRRAGVDEKELDRLLKEIIKRVEDALRKSHESNRRIIKRVEEALKRDKELLERSDERVAEALKRVDDEEAKRILDENKKLVREWEEKSRAVLEKVKKLVKRDDDENKKLLDDVKKLVDEMRERAR

SEQ ID NO: 3341 - protein, 180 aa, Artificial Sequence; identical to SEQ ID NO: 3340
  Synthetic

SEQ ID NO: 3342 - protein, 180 aa, Artificial Sequence
  Synthetic
DLEREIRKIIEEAKKELERVNDEIRRIIEEMRRRSEESNKRIREIIERARRRLEELIRRGVPKEDVERVLEEAIRRVEELLKESRRILEEVIKRVDKLLKDSERILKRVEDLVRELLRRVDTEEVKKLLTDLKRLVDEIRKHNKRLLDELRKEVEKSERENRRLLEEVRRTVDEMRERAR

SEQ ID NO: 3343 - protein, 180 aa, Artificial Sequence; identical to SEQ ID NO: 3342
  Synthetic

SEQ ID NO: 3344 - protein, 180 aa, Artificial Sequence
  Synthetic
SAEDKARKIAEDAKKEAEDSNRDAHRIAEEAKRRARKINEEARELIERAKKELTRLRREGADKRAVKKAAEEAIEIAERALRESDKAARDAIRLAEEALRRSKRIAEEARKLARDALEKVKAEEAKKLLDELRKAAEDIRRNNEEALKDLRRAAEEIRRHNEELLRRAREAAKKARDDAE

SEQ ID NO: 3345 - protein, 180 aa, Artificial Sequence; identical to SEQ ID NO: 3344
  Synthetic

SEQ ID NO: 3346 - protein, 185 aa, Artificial Sequence
  Synthetic
SAEEAVKRVEELVRRVKERNKRLVEDVEREVRRVKKRSEETNRRVKKLVERVKEDLDKRVSDEEKVKRIEDLLREILDTVRRLDEDSKRLLDEILERARRLIKKSDELLDRILKRARDMVKDLKDDKDKLEEVLREVRDRLADVERKSERVVEEVERLLREVVRKNEDVLRRIEELLRDVEEKAR

SEQ ID NO: 3347 - protein, 185 aa, Artificial Sequence; identical to SEQ ID NO: 3346
  Synthetic

SEQ ID NO: 3348 - protein, 185 aa, Artificial Sequence
  Synthetic
SVEELVREVEKRARKVKRDSDKTNKDSTKLVKEVKDRSRRTNEEVKKEVERVKEDLEKRVSDKEKVDRLKKELEDILRRVTKLDEESTRELKKINEEVTRMDEKSKKELDRILEELRRMAEKLKDDEDKLKEVVDRIRKLLEDVKRENEDVKRRSRELAERVREENDKVSKEIRELLEEVERRAK

SEQ ID NO: 3349 - protein, 185 aa, Artificial Sequence; identical to SEQ ID NO: 3348
  Synthetic

SEQ ID NO: 3350 - protein, 185 aa, Artificial Sequence
  Synthetic
SAEEMREEVKRLVDKNRKDNREVEKKSTRLAEDVKRKSEETNRKIREEVERVKKDLEERVSDEEKVRKLKDDLRKILETVDRMDETSVRELEKINRDLRKLVAENDELTDRVLKEAEKLVKDLREKEEKLKEVLDEVRRLIKEINDHSREVSKTSEKLLRDVLKKNEDVLREIERLLEEVRRRIK

SEQ ID NO: 3351 - protein, 185 aa, Artificial Sequence; identical to SEQ ID NO: 3350
  Synthetic

SEQ ID NO: 3352 - protein, 178 aa, Artificial Sequence
  Synthetic
REVEEITKEIREMNEESKRLLEEVREKIERLSRESNRLLEDSKREIDEAIRRVEELLDKEDKKDVVEKLKEVVKRAHERNEKIVKDDRDVVREVKRLLEEIVRRDRELAERVIRRLKRDGDDKDIITEIERTNDETEERVRDIERRIKESSDRNDKRAKEISERIKRLLEEVDKKVKE

SEQ ID NO: 3353 - protein, 178 aa, Artificial Sequence; identical to SEQ ID NO: 3352
  Synthetic

SEQ ID NO: 3354 - protein, 184 aa, Artificial Sequence
  Synthetic
DLEELVKEVERRVRRNKTETDRLVEEVERSVRENRRRIEELVRRVEKEVRRIKEDLKRKLSDEDKVRRILEELDRVLREARERLKRVEDKNREVLERVRELAKESVRRTEDALRRAKELIDNIRDKDVLEKVAREIKRLIEESNRLDKEVEDEVREMSKDVNRELERIAEEIEKVLRDVERKLR

SEQ ID NO: 3355 - protein, 184 aa, Artificial Sequence; identical to SEQ ID NO: 3354
  Synthetic

SEQ ID NO: 3356 - protein, 173 aa, Artificial Sequence
  Synthetic
SLEELLKEVKKLVEDVHRKNKKNVEDVRRLVERLRKENEENVEEVRREVKKVKEEIGDKDVLDKLEKALKEVERLNEESTRRLEKVLREIEELNRKSSEDLKRVVDEVRKLINNNAPLEEVRRRVEELVTDVDRSSKENHRRIRKVVREVERTTEENHRRIRDIVRRVREEAK

SEQ ID NO: 3357 - protein, 173 aa, Artificial Sequence; identical to SEQ ID NO: 3356
  Synthetic

SEQ ID NO: 3358 - protein, 176 aa, Artificial Sequence
  Synthetic
SEIEKAVRELEELVKDNERKSKKSVEDSERIVKEIRDRVRRVVERVRKVVEDIARAGVPEEVIKEIKRIVEEAEKLLRDVIRRIETVVDENRRLLERSNRKIRKVVREAKELLDRLRDDELRKVVERARDLIRKIREESKRSHDRITKLAEDIKRELEKIERRLEKLAEELERKAR

SEQ ID NO: 3359 - protein, 176 aa, Artificial Sequence; identical to SEQ ID NO: 3358
  Synthetic

SEQ ID NO: 3360 - protein, 176 aa, Artificial Sequence
  Synthetic
SEVDELRKEVEEMVKRNKDETDKSVKESKEIVDEIRKRIKEVVDEVRRFVEDIRREGVDEKVIREIDKVVEEAKKKLDDVLEDIKRVVDENRKRLDDSNKEIRDVVKKADDLLKKLRSRALEDVARRLRELLKRINDKTRESHKEIKRLADEIRKKLEDIVRELEKLLREIKERAR

SEQ ID NO: 3361 - protein, 176 aa, Artificial Sequence; identical to SEQ ID NO: 3360
  Synthetic

SEQ ID NO: 3362 - protein, 176 aa, Artificial Sequence
  Synthetic
SEVDEVRERLERVVRRIEREVEKSERDSERIVEKNKRDTDRVDREIEKVVKKIRDRGVDERVVREVERVVEELRELLERSNEELRRVVKENKDLLREVIERVRKVVREIDDLLRKLRSRALEEIEKRARELLKRITELLRESHERIKRLAEEINKKTEKVVRDIRKLLKEIEDKVT

SEQ ID NO: 3363 - protein, 176 aa, Artificial Sequence; identical to SEQ ID NO: 3362
  Synthetic

SEQ ID NO: 3364 - protein, 176 aa, Artificial Sequence
  Synthetic
SEIERLREELERVVRAIERTVTESVRESKEMVDRNKRATEKSVRDSEDMVREIEERGVPKEVIEKIRRVVKENKELLEESNRKLEDVVRKNEELLREVERAVRDVVRRIEKLLRDLRSRELERVAKEARDLLREIKKLLDESTETIRRLVKEINDETERSHRKITELAKRLKEEAK

SEQ ID NO: 3365 - protein, 176 aa, Artificial Sequence; identical to SEQ ID NO: 3364
  Synthetic

SEQ ID NO: 3366 - protein, 176 aa, Artificial Sequence
  Synthetic
DEVRELVEEVERVVKRNKDESKKSEEESREIVREIEKRVEDLVRTVEEVVKEIERKGVPEEVIKKIREIVKRVKKLLDDVRRKIEKVVRENKELLERSNREIERVVDRARELLKKLRSRELEKVADTLRKLLKEINEKLERSVRRIRELAKEIKDELRRIEEELRKLAKELDDEAK

SEQ ID NO: 3367 - protein, 176 aa, Artificial Sequence; identical to SEQ ID NO: 3366
  Synthetic

SEQ ID NO: 3368 - protein, 174 aa, Artificial Sequence
  Synthetic
DRTREVMERIERLLEDSRRKTDKVRREIRKLLEDVHDKTRRVAKEIRDLLDEIRRLLESGVDSKEVERRVREVFDRLRRLVEESERLLEEILRRLEDMARRSKETSERIVRELEREGIEEEVVKKARKKVRENAEEAEEVRRRIRRSVEENRKELRRLEKELKDVLDEIRERVR

SEQ ID NO: 3369 - protein, 174 aa, Artificial Sequence; identical to SEQ ID NO: 3368
  Synthetic

SEQ ID NO: 3370 - protein, 174 aa, Artificial Sequence
  Synthetic
RELEEVRKDIERLLKEVEDTNRRAKERVKRLLEEVHDDTRRAVERIRKLLDEIRKLLEGGVDDRDVRKLLEDVLRELERLVRRSVEELERVLKELEDLNRTSIRLLEKIVDDLRRAGIDEEVVKEIEKMLEKIARHARKSDKEAKESVEDNRRRLEKVRKEVEDMLDEIRERAR

SEQ ID NO: 3371 - protein, 174 aa, Artificial Sequence; identical to SEQ ID NO: 3370
  Synthetic

SEQ ID NO: 3372 - protein, 174 aa, Artificial Sequence
  Synthetic
DREKEVADRIRKLLEEIREESERVAKEIRELIKEVHKRTKEVAEEIRRLLKEVEELLRNGVDSEEVRRLLKEIVDRLRELVKESEKELDRILDRLKKLVEKSKRESEKVVKELRDAGIDEEVVKEIERRLRENERKLRELEKEIKKLVEDNRTRLRELEDEIRRVLKKITDEVT

SEQ ID NO: 3373 - protein, 174 aa, Artificial Sequence; identical to SEQ ID NO: 3372
  Synthetic

SEQ ID NO: 3374 - protein, 180 aa, Artificial Sequence
  Synthetic
SELEKAVEDSRRLDRRVEETLRDVTRRVRETNKEVEDMLEEVRERAERLLREIEEKLTDEAVERVLKKIIDDIERLLREIKKLLEDSNRELRRVVKEIRKLLEESLKRSRDAVEEVRRKGLEDELRKVIDENRKSVETIEEELRRVEKEDEDTLREIEEKLRKAIEELEKKLKEILDRLR

SEQ ID NO: 3375 - protein, 180 aa, Artificial Sequence; identical to SEQ ID NO: 3374
  Synthetic

SEQ ID NO: 3376 - protein, 173 aa, Artificial Sequence
  Synthetic
REREELVERVRELLKEVEDRDREMVERSERLNERIRERDKEVEDRSRKLDEDIERLLRAGARDDEVRRLLEESLRTTEKAVEDTERLLRESLERSKEVVKETKRLLDEIAEEIKRIGGEEVLKEVKDAVDTLKKHSEDVIRKDEESVRDLRRHSEDVLRKNKEMVDDIKAKAE

SEQ ID NO: 3377 - protein, 173 aa, Artificial Sequence; identical to SEQ ID NO: 3376
  Synthetic

SEQ ID NO: 3378 - protein, 181 aa, Artificial Sequence
  Synthetic
DEEDKLREVLKDVERRVREMLRENNELIREVAETSERLLRENNELIERVRKEVTRLLKELEKVSDKRLVKEVVDRVRKLVDELKKHADKLVEESTRLVEELKKHADDLVRRVRELVERVERKIKDIREIVETIRKILREIEEHAERNKTRLEEENKKVREHVERNKKDLEETLKEVEDRAR

SEQ ID NO: 3379 - protein, 181 aa, Artificial Sequence; identical to SEQ ID NO: 3378
  Synthetic

SEQ ID NO: 3380 - protein, 181 aa, Artificial Sequence
  Synthetic
SKEDKLREELKEVEKTVRELLKRNNELIERVREEVERRLEENNRLIKEVKDRIDDLLRKLKDDSDERSVRRVRETVTRLVEELKRHADRLVEEVRRLVEELKKHADEVLERVKRLVDDVTRKAKDIREIVKTIKEILDEIRRHLERNKDRLEKELTRVRETAEKNKRDLEKVLEDVDRKAK

SEQ ID NO: 3381 - protein, 181 aa, Artificial Sequence; identical to SEQ ID NO: 3380
  Synthetic

SEQ ID NO: 3382 - protein, 182 aa, Artificial Sequence
  Synthetic
DEAEKLEREVRKELEENREELERSTEESERLLKHNEDELRKSEEESKKLLREVEKELRRVPKEKLDKVERDARDILRKNKEMVDRVRKTVEDILRDNRRVVDESRRLSKEIERRVREVSESSDKRVLDEVVKEIRRLIEEVKRTTKEMNKKIRKLFEESNRKLEEAHRDIRRKAERVKRELK

SEQ ID NO: 3383 - protein, 182 aa, Artificial Sequence; identical to SEQ ID NO: 3382
  Synthetic

SEQ ID NO: 3384 - protein, 182 aa, Artificial Sequence
  Synthetic
KELDEIREEVDRVLRENERRLRTVKKEARDVLEHNRKRLEELRRKIEEVLKEIEEELKRVPEKKADEVRKRIRDILEDLRRVLREVAETAKRILDELDKVVRESEKLSRKIKDDVTKILKSKDEEVLRRVLERIRRLIERVKERTKRMTDDMRRLIEESNDKLRRAEERIRKLLEEVKRTLK

SEQ ID NO: 3385 - protein, 182 aa, Artificial Sequence; identical to SEQ ID NO: 3384
  Synthetic

SEQ ID NO: 3386 - protein, 182 aa, Artificial Sequence
  Synthetic
KKVEDIKREAEKVIKESEESIRRNERELDEVIKESERSIRRNERELERVLKELRDSVARLRGEELERAKRVVDELEEFVKESKELLKRSLDELDKAVKDSKRLLEESLKRLEKVVREIEEKLRERPDDRIREELKKVADEIRETNKRIHEESKRVVDEVRRTNEEIHKRSAKVVKDIKDKIK

SEQ ID NO: 3387 - protein, 182 aa, Artificial Sequence; identical to SEQ ID NO: 3386
  Synthetic

SEQ ID NO: 3388 - protein, 182 aa, Artificial Sequence
  Synthetic
EEVERITEDAKRVIDESRKTIKRNEDDLRRVIEESRETVERNRKRLEEVLRELEERVRRLRGEELERARRVVEELRKMVETSVRLLRRSLEELKKLVKESVELLKRSLDELRKLVEEVRERLRERPDKRIEEELKRVAEEVKKINEDIHRRSKEEVDRVREINEKIHRDSERVAEEVRRRIK

SEQ ID NO: 3389 - protein, 182 aa, Artificial Sequence; identical to SEQ ID NO: 3388
  Synthetic

SEQ ID NO: 3390 - protein, 177 aa, Artificial Sequence
  Synthetic
EELERLKEEVEEIVRRLKRELERIEEEIAKMVRDSEKSLEEDEREVRKVVEELRRRGNGGEIEKLVEELRRLSREAVRRSEKLLEEIRRLVEKVVREVERVVDELRRRVEEVVRKIETEEILRRVKEEVEKVARDIKAIIEKVAREVKEVLDRIREVNKRAHEETRKVADEIEKRAK

SEQ ID NO: 3391 - protein, 177 aa, Artificial Sequence; identical to SEQ ID NO: 3390
  Synthetic

SEQ ID NO: 3392 - protein, 179 aa, Artificial Sequence
  Synthetic
DEVERIAKELTDVLDRIRKAVETDKEEIKRVLKEIEEAVRTNEEKLKDALRKIREGPVDEKIVRTAERLAEELVRNSRKILTDISDLARKLAENSERILRKIEKLIRDLVKELEDLRKESERALERVEEKARELVRRVDELLRRSHERTKELAERVRRLLKKSDEETERLARDVERKIK

SEQ ID NO: 3393 - protein, 179 aa, Artificial Sequence; identical to SEQ ID NO: 3392
  Synthetic

SEQ ID NO: 3394 - protein, 179 aa, Artificial Sequence
  Synthetic
SEVERITERLKEVLKEIKELVETNSEKLKRVLEEIKKAVEDNTRTIKKVLEEITRAPVDKDIVKDIREELERLVEESRRILEEVERLIRELMKNTERILEEAERLAERLVRKLEALRDGSEEMLKRVEDEARRLTERVRKLIEDSDRETEKLVRRVRELVKRSHEKVKELVDRVRKRIE

SEQ ID NO: 3395 - protein, 179 aa, Artificial Sequence; identical to SEQ ID NO: 3394
  Synthetic

SEQ ID NO: 3396 - protein, 179 aa, Artificial Sequence
  Synthetic
SEVERIAEEVKRVLEKIRRDVEENRKRIEEALKRIEKELRDNERRLREVLDEIRKRPVDEEIVKEVKKRAEDLVRNSERIVREVERLARELLKKTEDILRKIKRLAERVLKKLEELRDSSEDALRAVEEEIRKLEDEVRRLIETSHKEVEDLAKEVTDLLRESNERTEDLRREVDAKRR

SEQ ID NO: 3397 - protein, 179 aa, Artificial Sequence; identical to SEQ ID NO: 3396
  Synthetic

SEQ ID NO: 3398 - protein, 184 aa, Artificial Sequence
  Synthetic
SDEERLLRTITRVLEENKKSVDDDLKKNEDVLDENRRRVERWEEALRELLKRVEDKVKDLKKDGRDEELKRVIELVRRALDRVRDELKKSLDESKELVDESRRTLDESRRLVEEVLREVKELLREGVDTDEIRRVLEKVKEELDRTDEKSRDLSRKVRDRIRESNREIEKLLEEVRERLERETK

SEQ ID NO: 3399 - protein, 184 aa, Artificial Sequence; identical to SEQ ID NO: 3398
  Synthetic

SEQ ID NO: 3400 - protein, 184 aa, Artificial Sequence
  Synthetic
READELRTRAEKALRDNRESVERLKRELDRVLKENERTVRELKERVKEVLKDVDKKVKDLKKEGRDEDLRRLKDRVRRVLRRVEELLERSRRESERMVREVRRLLEESKRLVEEVLREVEELLRRGKPREEIRKVLEDVRREVEETDDRIRKVLERARRESEKVDRELKKELERVRKELEEETK

SEQ ID NO: 3401 - protein, 184 aa, Artificial Sequence; identical to SEQ ID NO: 3400
  Synthetic

SEQ ID NO: 3402 - protein, 175 aa, Artificial Sequence
  Synthetic
DRERRVLEELRKLSEDSKRLLERIRERMRRLAEETKRRARDILREVEELSRRVKELLDGGKDAREVLEDNKRVVDEVREKLKRLLEENKRIVDEVEKLLREVIRDNERVVEKVARDVREIEEVKDDVRRSSEEVKEEVERLIREAKKSTDEVRELLKELEKRLRESIEESKRKAE

SEQ ID NO: 3403 - protein, 175 aa, Artificial Sequence; identical to SEQ ID NO: 3402
  Synthetic

SEQ ID NO: 3404 - protein, 178 aa, Artificial Sequence
  Synthetic
EEVKRMEDRLEEVAKRADEESKKVMDELEKIVRDVLRESKRLTEELRRIADRVRKELRTDEVVRRVVKELDDVSKRNEEVVTKVLEELDRIVEKVEEINRRVLDELRRIVDEIRRRVTDKKELDRIEKRVREIKKRSEDSVRTIRERVRDAKRKLERSVEEDKREVKEIKERLEREAR

SEQ ID NO: 3405 - protein, 178 aa, Artificial Sequence; identical to SEQ ID NO: 3404
  Synthetic

SEQ ID NO: 3406 - protein, 178 aa, Artificial Sequence
  Synthetic
SEVDDLKRKLDEVVRRAKEESKEISERLEEIVRDAERLLKELHEEDERIVDRARKEIRTREMVEEFVRRSEDVARKTTEIVKKVVEELRRVSETNERVVERVLRELDEIVRKIEEDVTDRDKLEKIRDAVRKVKEELERSLEKDRKRVTEIEEKLKKLVEENRRTSKRVKEELEEKVR

SEQ ID NO: 3407 - protein, 178 aa, Artificial Sequence; identical to SEQ ID NO: 3406
  Synthetic

SEQ ID NO: 3408 - protein, 179 aa, Artificial Sequence
  Synthetic
RELEEIKKRVEDIMRRIEDLLRENEKKIDKVRKDIRKSLEENKRKVEEVRKDLKRLLDEREDDRLRELIKDAERLLKEVLDHSRKSVRDVEDLLEKLLRHSKELVERAKKALTDVLRKVEERPEEEVKKEIERLAKKLEEELERSNRESDRLVREARKHNEESDRRSEELARRVRERLR

SEQ ID NO: 3409 - protein, 179 aa, Artificial Sequence; identical to SEQ ID NO: 3408
  Synthetic

SEQ ID NO: 3410 - protein, 179 aa, Artificial Sequence
  Synthetic
KREEDVKRDLKRVADESRKSDEDIKRRLDRLVKEIRELHKKTTDELKKVADEVRDRLRKVKDDKDVLRKILDDLRKMLEEVKRTDDRIVERLEKLVREVERLAEESLKRSKDKLREVIKRVKDIDELREDVKRVEDENRTSLREIKRAIEKVLDESRKLVEENRRRAEKIIKEVEDTLR

SEQ ID NO: 3411 - protein, 179 aa, Artificial Sequence; identical to SEQ ID NO: 3410
  Synthetic

SEQ ID NO: 3412 - protein, 179 aa, Artificial Sequence
  Synthetic
REEEEVTEELKRLADKSRKSDEDIERTDRRVTEEIERLHEETTRELEKVRRDVDRELKKVKDDKRVLEDILRKLDELLKRIKKKDEDILKELRELLEKSIRDLERSLEESRRALEDVVRKVKDIDELKKEVRKILEENKRSLERIRRHSTRVEEKSRKLIKENDDRLKKVIEDVRRKLK

SEQ ID NO: 3413 - protein, 179 aa, Artificial Sequence; identical to SEQ ID NO: 3412
  Synthetic

SEQ ID NO: 3414 - protein, 179 aa, Artificial Sequence
  Synthetic
SEKDKVTKELEDVARESRESDKEIKRELDEVVEESERLLREIRRRLEKVAEEVRRALEKVKDDKRVLKEILDRLREVVEEVKRLAEEVVKRNREVTRRIKELVRKSLEDSERVAREVIKKVREIEELKRRVEEIIRENEESVRRIAKRADDSNREIERLVDEIRRRAEEAIRRVTEKVR

SEQ ID NO: 3415 - protein, 179 aa, Artificial Sequence; identical to SEQ ID NO: 3414
  Synthetic

SEQ ID NO: 3416 - protein, 179 aa, Artificial Sequence
  Synthetic
KEEDDVRRKLEKVVREIDKLHKESTERDRKVREDSEETDRRIKEELKKVVKEVRDRLREVKDDKEKLRKILDDLRKMITDAKRLAEDSLRRSRELLKRSVETDERITDRLRKLLKEVIDEVDKIEELKDEVRKATEKSEDLVRRNEEHSRRVIEENERTLKDIADEAERVIKEVEDRLR

SEQ ID NO: 3417 - protein, 179 aa, Artificial Sequence; identical to SEQ ID NO: 3416
  Synthetic

SEQ ID NO: 3418 - protein, 179 aa, Artificial Sequence
  Synthetic
REDEEVTKELEEVIREIEELHERSTRKLKEVVDRSRELLDRVRRRLKEVVDRIRELLERVKDDKDVLREILEELRRVVKEVKDLLREILERNTRVTEDVVRTDEEITKRLRDMAREVIKKVREIEELRKRVEEAIRKSEELVKENTERAKKSNEELERRVRELEERAKRAIEEVKEKIR

SEQ ID NO: 3419 - protein, 179 aa, Artificial Sequence; identical to SEQ ID NO: 3418
  Synthetic

SEQ ID NO: 3420 - protein, 179 aa, Artificial Sequence
  Synthetic
SREEDVDRKLDEVIERSRRIDEEILRRDKEVVDEIRKLHKESTDRLKEVVDRVDKELKEVKDDKEKLREILKELREMVRRVEKTDDDISKELEDLLRESVRLAEESLKESEELIRKVIEEVKDIEELKKKVTEAIEENRESVEEIRRHSEEVKKESEKRVKENRDRARRAEERVEEMLR

SEQ ID NO: 3421 - protein, 179 aa, Artificial Sequence; identical to SEQ ID NO: 3420
  Synthetic

SEQ ID NO: 3422 - protein, 178 aa, Artificial Sequence
  Synthetic
DREREVKKRLDEVRERIERLLRRVEEESRRVAEEIRRLIEEVRRRNKKVTEEIRELLKRLKDKEEVRRVLERLRKLNKESDELLERILERLRRLVEKTNRLVKKIIEELRRLVEKIVREVPDVKELREELKKLERKIEKVAKEIHDHDKEVTERLEDLLRRITEHARKSDREIEETAR

SEQ ID NO: 3423 - protein, 178 aa, Artificial Sequence; identical to SEQ ID NO: 3422
  Synthetic

SEQ ID NO: 3424 - protein, 178 aa, Artificial Sequence
  Synthetic
DEEEKITRDLEKVEDEIRRLLEEVRRLSKKVKEEITKLLEDVNRESEKAVRKVRETLKRLETKEEVERVLRELEKLMRESDKLLKDIVERLRRLLEETNRLLKEIVDRLRKLLKELVERLDKVERLRKRVTDVIRKLEEVLKDIHRHDKEAIEEAERRLEDNHRRNRRVLEELKRRAD

SEQ ID NO: 3425 - protein, 178 aa, Artificial Sequence; identical to SEQ ID NO: 3424
  Synthetic

SEQ ID NO: 3426 - protein, 179 aa, Artificial Sequence
  Synthetic
SEEETVEELVRRAEEKSRRILEDSKKKVRDIERENDEILKRSRDRVKKAEDDLRRVVEKRDEEEVRKILEDLKRLLEKVIKTDEDIVKTSRDLLREVIKKDEEIVEKLKRLLRDMLEKAKDRGDERILRELERVVEEIDREHERTKEELKKVADESRKAHRESERDLERVIREVRERLR

SEQ ID NO: 3427 - protein, 179 aa, Artificial Sequence; identical to SEQ ID NO: 3426
  Synthetic

SEQ ID NO: 3428 - protein, 179 aa, Artificial Sequence
  Synthetic
SEVERVRKTVEEIKEKNERILKTSKDEVRRILEESERMLEESKKRVDEVREEAADVVRKRDEERVRRILRELEDLLRRVIEEDKRIVERLRRLLKRVIDTDRRILEESRKVLEDVIREAEERPDDRILEKLEEAAKRSDELHKRSRDDLRRVAEEIKKLHEETRRKLKKVVDEIRKKLK

SEQ ID NO: 3429 - protein, 179 aa, Artificial Sequence; identical to SEQ ID NO: 3428
  Synthetic

SEQ ID NO: 3430 - protein, 188 aa, Artificial Sequence
  Synthetic
STLEEVRERVDRVKKKLKKLLEEVTEINERSKKEIDEILKESEDRVRKVKEDLKRVVKEDKDGDRVRKIIEEAKKKLDEVLENSERIAREVKKDNDDSNREVKRVIEDIERKLDEIVKKIEDLERKGMDEEVLERVLRELEELTRRVEKEIRDLLKRIEDSSRRVRELATESRKKLEDLVREIKERLT

SEQ ID NO: 3431 - protein, 188 aa, Artificial Sequence; identical to SEQ ID NO: 3430
  Synthetic

SEQ ID NO: 3432 - protein, 183 aa, Artificial Sequence
  Synthetic
SSEEKVREEVERVREEITRLLRENEDTVRRVDEKAEKALRENKERVDRLREEVRKLLEKDKDKRLEEVLKRVEELLKRSIDKSREVLDRLRKMLEKSLKLSKDILKELEKLLRDIERRVRALTEDDFVRKVTEELKKVTDRIRKLLEESRKHTERVRREAEKLLKEIKDETKKVEEEVRRRAK

SEQ ID NO: 3433 - protein, 183 aa, Artificial Sequence; identical to SEQ ID NO: 3432
  Synthetic

SEQ ID NO: 3434 - protein, 181 aa, Artificial Sequence
  Synthetic
SSREKIKDDLRKAVEENRRLLREVRELLREMLERDERILREIERRLDEARKRLEEVARNNVPEKVVKRLVERVVEEVKRLLETSKKTVKEVVEEIKRLLEEIEKSSRDVVEEIRRLLEETGEGRAVEELKKELRRLEEESRRAVEDLKRLLDELKERTDRVVKKLDETLRKLKEDVDRKAK

SEQ ID NO: 3435 - protein, 181 aa, Artificial Sequence; identical to SEQ ID NO: 3434
  Synthetic

SEQ ID NO: 3436 - protein, 182 aa, Artificial Sequence
  Synthetic
REIDELRKELDEIRKRIEKVIEELKRHLDEVDKRAEDLAKELDDLTKTIERDAERRIREDKKSKEVVERVKRLLDKSNTDSDRVVKTVKRLLDENNKTSDKVVKDVKKLLDEVLKKVRDGPVDDKVIREVEERVKRIKEDVDRVLEDNSREVERVKRKVDKMLKRNKDEADRIRKKMDDDLR

SEQ ID NO: 3437 - protein, 182 aa, Artificial Sequence; identical to SEQ ID NO: 3436
  Synthetic

SEQ ID NO: 3438 - protein, 182 aa, Artificial Sequence
  Synthetic
SVIERLKEELKKIEEDARDMAKKLNKETEDILRRARKLARELEKHLEDVKRKIDELIKEDKKSEEVVKEVKKELDRNNEESKRVVEEVRRRLDESNKKSREVAEDVKRLLDEILEKVRRGPVDKKMIEEVERDVRRIKKEVDRLLEENTERIEEIKKEVDELLKRNTDEVEKVKKKVDEDRK

SEQ ID NO: 3439 - protein, 182 aa, Artificial Sequence; identical to SEQ ID NO: 3438
  Synthetic

SEQ ID NO: 3440 - protein, 179 aa, Artificial Sequence
  Synthetic
KIEEDLERSLKKSEDELKELRDRLRKSNKEVTDDAERIKKEVEDSNREVEKRVRDLERRGVDKDELRRVLEELSKIVEEIKELIERLLEELTKIVEDLERELKELLKESRRIVEELRRLRSEEARKVLEENEEVVRRIVKKVEDILDDHRRVVKEVRDRIERLLKEHKKIVEDADKDLT

SEQ ID NO: 3441 - protein, 179 aa, Artificial Sequence; identical to SEQ ID NO: 3440
  Synthetic

SEQ ID NO: 3442 - protein, 173 aa, Artificial Sequence
  Synthetic
REEEEVAKKLERAAEESRRLHEESKRDHERATDEIRRKAEATLRELKRVIDEIERLADERDKEDVRRRAEELLRRVKKASEDIVKELRDLVERSLRRDKEIVDRSKKVLDEVIREVDVEEIRRRVETLERENRKAEEESRDKVRKSERRLEELNKRHEDLVRELEERLERKRK

SEQ ID NO: 3443 - protein, 173 aa, Artificial Sequence; identical to SEQ ID NO: 3442
  Synthetic

SEQ ID NO: 3444 - protein, 173 aa, Artificial Sequence
  Synthetic
DEEEKVLRELEEVIRTSRRLHKRSLEELDRVLEESKALHRESKRALEDVTREITKLADDRDKKDVVRRLKELLERILRTDEKIVRDSEEALKRIEEEDKKIVRRSEEVLKRVIDKVDVERIRKLVDDLRKENEKALRESKKRVEEIRRRNEEAIKDSKKDVEDLERDLERKRK

SEQ ID NO: 3445 - protein, 173 aa, Artificial Sequence; identical to SEQ ID NO: 3444
  Synthetic

SEQ ID NO: 3446 - protein, 173 aa, Artificial Sequence
  Synthetic
SDEERVLEELKKVIKESRDLHKESLDDLRRVIEKSRRLHEESLERLRRAIEEIERLMDERDKKDVVREAEKILREVRKEDEDIVRDSERVLERVKRTDREIVKRSKEVLKRAIDKVDVEEIRDLVRTLEEDNKRMEERSRRTVRKLEKENDDARKESERLVEELERRLEEKRR

SEQ ID NO: 3447 - protein, 173 aa, Artificial Sequence; identical to SEQ ID NO: 3446
  Synthetic

SEQ ID NO: 3448 - protein, 183 aa, Artificial Sequence
  Synthetic
RDVEEVKKRSDTTLKRIEELIRRVNERSKKSIKEIRDRAKEVEDEVRELARKIEEDARRRKESKELLEELLRRIKKLVDEIVDEIRRLLEKNKRIVEDSKRILEELVEENSRRVEEIKKRNKELDEVVRELEKINDKSRKRVEDAVRSNEKLLEDSERDIRRVIERLKKLLEDLKRKLEEIER

SEQ ID NO: 3449 - protein, 183 aa, Artificial Sequence; identical to SEQ ID NO: 3448
  Synthetic

SEQ ID NO: 3450 - protein, 183 aa, Artificial Sequence
  Synthetic
SDAERVMEESRRTIEKIKKDAKEMNERSRKTVDEIRERLERLLRELERIAEEIRRELEKRREVKDEVRRLLEEVEKLAREIEETVRRLVEKNTDLVRRSLERLDELVKTNHDLVEKIKDRNKELEEFVRELKKLNDKSRKDVEDLKRSNEEINEDSKRKVEEIIRRLEELLKEIRRELEDVER

SEQ ID NO: 3451 - protein, 183 aa, Artificial Sequence; identical to SEQ ID NO: 3450
  Synthetic

SEQ ID NO: 3452 - protein, 184 aa, Artificial Sequence
  Synthetic
SVEEDLKRLVDEIRRRVEKVKRDLERIVDENRKRVEESKEESKKSVEEIERRVREAAKRISDERLIKTLRRIVEEVERVNREVLRKDDELLRESEKVVTEVVKRLDEIVERARKVVEEVAKRIRDEKVADEVRKRLRKMIRDLEEVAREVKRELERLHEETERSSRDAKRRSDKMARDLERTEK

SEQ ID NO: 3453 - protein, 184 aa, Artificial Sequence; identical to SEQ ID NO: 3452
  Synthetic

SEQ ID NO: 3454 - protein, 184 aa, Artificial Sequence
  Synthetic
SSEEKLRELVKRIKRRVEEIIRRLEESVERDRDEVRRSKERLEALVEEIRRRVDDIEKRIDDERLIRTLREIVRRAEEVVRRAVEEDRKISDENEDVVRKVVKRLEKILREIEKVVKEVADRLRSEKAVREVEEELRDMERKLEKVAEEVTRRSKEVTEKLRESSDRVEKELRRIIEELERVAK

SEQ ID NO: 3455 - protein, 184 aa, Artificial Sequence; identical to SEQ ID NO: 3454
  Synthetic

SEQ ID NO: 3456 - protein, 184 aa, Artificial Sequence
  Synthetic
SVREDLKRLVKEIEDEVRKSKKDLDDSVREDKREVRESKEDSKRSVKRSEEEVRKIKKRTDDDELVKRLEDILRENKRVNDEAMKRDDKVSKENEDVVRKVVREDEDVLRTARRVVKEVSERIRDEEVAKRVRELLEEIMRRLRKTSEEARRRSKKITDDLRESSKKVREDSERLRKRLEEEAK

SEQ ID NO: 3457 - protein, 184 aa, Artificial Sequence; identical to SEQ ID NO: 3456
  Synthetic

SEQ ID NO: 3458 - protein, 187 aa, Artificial Sequence
  Synthetic
DAERKITRLLEEIRRESKRSSEEIKKSLKENEDEVRRVVEEIRKRLREIEKEVKEVLDRLRDQREVVDLLRRVLERVREIVRRIEDELRRVLEKSERSVEEIHRRNEEVVKKVEDVVREVRKLAKENSEKLVEEVLREVKRIIEENRTLSERVKEHNEKSHRESEELAKRVKELLKEIERDIRRLEK

SEQ ID NO: 3459 - protein, 187 aa, Artificial Sequence; identical to SEQ ID NO: 3458
  Synthetic

SEQ ID NO: 3460 - protein, 181 aa, Artificial Sequence
  Synthetic
SDAERVLKESKESLEELERRVTEALKRSRDSLRRLKEVADEARRRLEEVLERIARKKDSREELRELLERLRELVEKVVRDVREMLKRDEDLNRRVVEEVREILDRDRKLVKRVMDELDKDKNSEVKERLKRSLEETEKRVREVEERLKKTVEDTRKVVEDIERELERLLREVEEVVRRIEK

SEQ ID NO: 3461 - protein, 181 aa, Artificial Sequence; identical to SEQ ID NO: 3460
  Synthetic

SEQ ID NO: 3462 - protein, 181 aa, Artificial Sequence
  Synthetic
EEAERMLRESEASLRRIEKIVREALEASRRTVEELKKVVERVLREVRKLIEEIEKKKDVREELEKLLREVEERVRRVEEEVKEVLDRDRELVDRVLRRVRELLERDEKLNRDVVRRVDKDNMDEVRERLKKTVEDSKRVVEKAEEDLRRSLEDTERLVREASRRLRDLLRELRRIVEEIKR

SEQ ID NO: 3463 - protein, 181 aa, Artificial Sequence; identical to SEQ ID NO: 3462
  Synthetic

SEQ ID NO: 3464 - protein, 181 aa, Artificial Sequence
  Synthetic
SEDEKALRESKKTTDEIRKRVTEMEKRSREVVKEIRDIIERVLREVRRVLEEIRKKKDSREELDKLLRELEKLVKDVVKEVTELVDRDRELNKEVVKELRRLLEEDERLVEEVVRRIEKDKNSEAKKRLKDSLDRTRKTVEEMTRRLEKTVKETEDLLREARERLEELLRELERVADEKRR

SEQ ID NO: 3465 - protein, 181 aa, Artificial Sequence; identical to SEQ ID NO: 3464
  Synthetic

SEQ ID NO: 3466 - protein, 181 aa, Artificial Sequence
  Synthetic
SEDEKVLRDSRKVLREIEEVVKEVLKRSKKLVEELEDIARRVLKESEDSNKEARDKKDLREELRRLLEEDERLVERVTREVREVLDRDRRLNKEAVERVERLLEEDEKLNRDALRKLSKDNNDEVERRLRKTVRDTKEVVDRAREKLERTVRTTEETVKEIEKRLEESLRRSREDVKEREK

SEQ ID NO: 3467 - protein, 181 aa, Artificial Sequence; identical to SEQ ID NO: 3466
  Synthetic

SEQ ID NO: 3468 - protein, 182 aa, Artificial Sequence
  Synthetic
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 3469 - protein, 182 aa, Artificial Sequence; identical to SEQ ID NO: 3468
  Synthetic

SEQ ID NO: 3470 - protein, 182 aa, Artificial Sequence
  Synthetic
SAEDKLRKLLDDARRTVKEVEERLKKLNKKLEEDVKRVKRELRESNKKSRELVEKVKREVTDEDVKKKVEDLLKRDHDVVRRVEKELDDMLRRNHKLVRDVLRELRKLLEDVERVVERARRVRSEVVEEVLEELKKLIETVKRRAKEVLDRSEETIREIRKRAEDVLRESERIIEDIERMTR

SEQ ID NO: 3471 - protein, 182 aa, Artificial Sequence; identical to SEQ ID NO: 3470
  Synthetic

SEQ ID NO: 3472 - protein, 183 aa, Artificial Sequence
  Synthetic
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKKVEKEIRELLERLKEEADRVRERSKKILTDLKKSSEDVKRESERMLKKLEDEIR

SEQ ID NO: 3473 - protein, 183 aa, Artificial Sequence; identical to SEQ ID NO: 3472
  Synthetic

SEQ ID NO: 3474 - protein, 183 aa, Artificial Sequence
  Synthetic
SVEERLEDLLREVTETLDTSRRRLEKLDREVDKKVKEVEKRLRETLKESEDTVRDVERRVSEELVKLVRDILERNEEVNREAVKRIRDILDEIKKLVEEVVRRDAEIVKEAERVVERVARDIRSEEVARRVEKELEDILRKLRKSSEEAERRIEEMLRRLDKVVKEMLKRSRDLLRTLEETTK

SEQ ID NO: 3475 - protein, 183 aa, Artificial Sequence; identical to SEQ ID NO: 3474
  Synthetic

SEQ ID NO: 3476 - protein, 181 aa, Artificial Sequence
  Synthetic
SIREDVERLAEELDRKSREIATRAKRELDEILRKDKEISDRARKELEEILKKLKEIADRDKDERKIRRVLEEAEDLVRRVVELNKKSLEEARKLVEDVLRLLEESLKESKDLVERAKERITGKEVEKRLDDALKRNAEEVEDVKRKLKDVLREVERTVRESEKDLRRVLEEVERAVREIRR

SEQ ID NO: 3477 - protein, 181 aa, Artificial Sequence; identical to SEQ ID NO: 3476
  Synthetic

SEQ ID NO: 3478 - protein, 182 aa, Artificial Sequence
  Synthetic
SEVDEVLKRSRDVLKRIDEIVKKVLTDSKRVLEDLRRIVKEVLDESKKVLEEIRKIKDSREDVTELVKRLHKRNKDVLDRVRKVVERNHRLNKRALEEVARLVKELHDLNKRALDEVRSDERAEEVERAMRKSSDDLRRKLEEVERRLRKSSEESKKVLKDAEREIRRSSDELRKVLEDIRR

SEQ ID NO: 3479 - protein, 182 aa, Artificial Sequence; identical to SEQ ID NO: 3478
  Synthetic

SEQ ID NO: 3480 - protein, 182 aa, Artificial Sequence
  Synthetic
SEVEDVLTKSRKVLKEIEEIARKVLEESKRVLEEIRRVVEEMERRSEDVLRELRRIKDKREEVREVVKDLHKKNEDVLRRVKKMIEENHRLNETVLREVRRLVKELHELNKDALRRVKDLERADEVRDEVRKSSEELRRVLEEAEERIRRSSKESKELLKRVKERIEELSRRLEKVLREIEK

SEQ ID NO: 3481 - protein, 182 aa, Artificial Sequence; identical to SEQ ID NO: 3480
  Synthetic

SEQ ID NO: 3482 - protein, 184 aa, Artificial Sequence
  Synthetic
DAEDELKKAEDRLRKSDEEAKKSIEDVKRELRRLLEESKKEIEKLIEELRRLLERAKEKPKDETILRRLEEIVRRIEERLRRAVEENAEIVKRIEERADRVVEESEESVRRIVEEIKKAKDRLRTEEVVERVLRKVERLLEENERLVKEVEDELRKLLEDLKRSSKKVRDEVKELAKRLRDEVR

SEQ ID NO: 3483 - protein, 184 aa, Artificial Sequence; identical to SEQ ID NO: 3482
  Synthetic

SEQ ID NO: 3484 - protein, 184 aa, Artificial Sequence
  Synthetic
SAEERIEEVKERLRRSDEEAKRKIDRLVEELRRLLEESKKEAEKVKKELRKLLEEVKRKPKDEKILKKIEEIVREIERTVEDMLRRNAEIVKRIEDRARRVVEESNDSVRRIEKRVDEALREVRTEEVVKRVEDELRRLLEENKKLVDDILDEVRRLLEELEKSSRKVKEDLDRLLEELRREDK

SEQ ID NO: 3485 - protein, 184 aa, Artificial Sequence; identical to SEQ ID NO: 3484
  Synthetic

SEQ ID NO: 3486 - protein, 179 aa, Artificial Sequence
  Synthetic
SAAEEVKKRITDLLRKDEEVVKRASEAVERLLEDDKRVVEDVRREIEEILRTLEKVTREGKDKKAIRTIVRDLERVIRRVLEASARTVKRIEDLIEKLLRESRETVDELRRVLEEAAREGSIDKDDVKRAEDEVRKSHKKVEDDLRRLKEEVERSLKDTEDKARRAKEEVERLLRESER

SEQ ID NO: 3487 - protein, 179 aa, Artificial Sequence; identical to SEQ ID NO: 3486
  Synthetic

SEQ ID NO: 3488 - protein, 179 aa, Artificial Sequence
  Synthetic
DEDDRVRKEVEKMLRDDDRIVKEIEKRLKDLLDRDRKVVREVRELVEELLRRLEKVIKDGAPEEVIREIVERIRKRLKELLEKSAKTVDEIRKLIEELLKKSKKSVDDLVKRLEDVRREGSISEEDVDRLRREVDKSNKDTKKILDEVRKEVEDSLRKTKKIIDDALRRVDELLKEAER

SEQ ID NO: 3489 - protein, 179 aa, Artificial Sequence; identical to SEQ ID NO: 3488
  Synthetic

SEQ ID NO: 3490 - protein, 182 aa, Artificial Sequence
  Synthetic
SVEERVEDIKRSNEESNKRLREEVEKIKEELKEINKRVEDTVREIEKRLEELLRRVRSDKEEKFKDVKKLVEDIVRRLREIVKENHEIVKEVLKELDELVEKSTRTVEESKKRLDEMLRKIRDERVVEEIDKIAKEVNTRNKKVVDEIRKRAEEVKEESKESLKRLRKIAEEVLEELKKRAT

SEQ ID NO: 3491 - protein, 182 aa, Artificial Sequence; identical to SEQ ID NO: 3490
  Synthetic

SEQ ID NO: 3492 - protein, 175 aa, Artificial Sequence
  Synthetic
DLAEEVRKDVEDLERTNEKVVRDIRKLLEDLNREHKRVSDEIRKRIEELKEKLKRIKDEDEVRKVVEELERTLERVRKRVKDTVDKSKELLKRLLERSRETVERVKKKLDDVRRDGAIDDDDVRRIKKRAEDSHDRVKKELDRIAKSNEELLRKTEEEVRRLLEELEEILRRTRK

SEQ ID NO: 3493 - protein, 175 aa, Artificial Sequence; identical to SEQ ID NO: 3492
  Synthetic

SEQ ID NO: 3494 - protein, 179 aa, Artificial Sequence
  Synthetic
DEVEEALRRVEESNRRVKEEVERAVERVKRSDDDVRRLVEEMEREVRKLIDDIRRLAEAGKSADVVRKLIKEVEDKLKEVLERVRKLVETSKKLLDEILKRVEELVRRSKEELDKVLKDGSADKDEITELKKHSERLLEEAERLVRDLKRHSDELLEEVEERLRRLREDLKRLLDEVET

SEQ ID NO: 3495 - protein, 179 aa, Artificial Sequence; identical to SEQ ID NO: 3494
  Synthetic

SEQ ID NO: 3496 - protein, 179 aa, Artificial Sequence
  Synthetic
SAVEKAVRDVERTNEEIRRVVEEVRKEAEKTHRDIRRVVEEARETAERLLREIEELAKKNAPKEAIEELVRRVLDLLRRALEEVREAVERSDRRLEEALERVRELLERSNKLVDDVRREGSISEEAVKRLKDENKKTLDEVREIVKRLAEENKRLLEEVEKTVRDLKRELEKLLREVAK

SEQ ID NO: 3497 - protein, 179 aa, Artificial Sequence; identical to SEQ ID NO: 3496
  Synthetic

SEQ ID NO: 3498 - protein, 182 aa, Artificial Sequence
  Synthetic
KEVEDVVKEIEEVLDRLRKEVKKIKEDSDRLNEEIEKVVTDLVKELDRLLREIDDLIRKLKGDSEAVRRAVEELKREVDRVLREVEEMVKETKRLNDESNEKVRRVVEDLRRLIERVLRDATDDRARKTLEDLKRRIEELLRRVDETNERLKRHSDDLLRDVKRRLDEVRERIDRLLDKAER

SEQ ID NO: 3499 - protein, 182 aa, Artificial Sequence; identical to SEQ ID NO: 3498
  Synthetic

SEQ ID NO: 3500 - protein, 182 aa, Artificial Sequence
  Synthetic
DEVDEAVKRLREILRRIREIVEKVRKESEDVNDEIRRIVEEVTKRSEDALRELRELIRRNKGREEDVKRVADRIRELDDRSNDTVRRLVEKTRRLNDESNKTVRKLVEELKREVKKVEARVTDERVREELRKVEEDIDRLLKEVTELNERLKRHSEKLLRDVTRENRRSKEAVTRILEEARR

SEQ ID NO: 3501 - protein, 182 aa, Artificial Sequence; identical to SEQ ID NO: 3500
  Synthetic

SEQ ID NO: 3502 - protein, 182 aa, Artificial Sequence
  Synthetic
SEVEELLDRLREVNKRIREEVRKVTEESKKAIEEIKRIVDDMVDKVRKILEKLKELIRDNRGDRESVRKVVEELRELIRRVLEEVRKLIERVKKRNDESNDTVRRLVEETERIVDEAEKRVKDDKAREDLRRVKEHSERLLREVTKLNKDVEKELKELLDEVRERLKDLKRRIDKILEEAER

SEQ ID NO: 3503 - protein, 182 aa, Artificial Sequence; identical to SEQ ID NO: 3502
  Synthetic

SEQ ID NO: 3504 - protein, 181 aa, Artificial Sequence
  Synthetic
SVRERVKDEMEKVLRDDKEVSKRVTDEARKVLEEHRKITDEVRRRSKELIRELKKVRDEGRPEEKIKEIADRIREVDDRSNRRVRESVKKLEDLLRRVVKESEETVRTLRKLLEDVLREVDREEVRRTVDEVRRRIDKSLEESKKLVEDISREITELLRRTTERNKESKREVDKILEDARK

SEQ ID NO: 3505 - protein, 181 aa, Artificial Sequence; identical to SEQ ID NO: 3504
  Synthetic

SEQ ID NO: 3506 - protein, 181 aa, Artificial Sequence
  Synthetic
SIVERAEKELRRLLKEDEEVSDRVRKEVKRLLKEDKEILDDVRRRIEKILREIEEVARRGEDKRAIRKLVEELKRVIDKAVEESRDSVRRIKDLLDKALRESEETVRRIKTLADDLLRKVDREDVRRIIKEIKERVKKSLDESREIIERAKREVDKSLEESKKVAEDAKRRIERLLREVER

SEQ ID NO: 3507 - protein, 181 aa, Artificial Sequence; identical to SEQ ID NO: 3506
  Synthetic

SEQ ID NO: 3508 - protein, 179 aa, Artificial Sequence
  Synthetic
SEVEKVVREVEKLIREIERHSKEVNKRSKEDIDRIREKIERAIRRVEELIRKVKEVTERGDRRKEEVLEELDRIVEEVETMAKRVREELKEIVDKSRELMRRSEELLDEILKRAAELARRVGVKEDLDRIRERLERLKKRTKELLERDEREVERVERELEELIRDIRRKIEKLKRDIEK

SEQ ID NO: 3509 - protein, 179 aa, Artificial Sequence; identical to SEQ ID NO: 3508
  Synthetic

SEQ ID NO: 3510 - protein, 175 aa, Artificial Sequence
  Synthetic
SDLEDVIKKIEELLRRVEERLRDAVRKIEELLRASDERLREINEESRELLRRVKELKDAGIDKRDVERILRDIVRRSKKLLDEVHRTNEEILRTIERVVEEVKKELDKILKEVEDKVRDRKLVDDIRKEVERIVEEARKLLERIKREVKESSERAERLHEEDRKRVEDALREVKK

SEQ ID NO: 3511 - protein, 175 aa, Artificial Sequence; identical to SEQ ID NO: 3510
  Synthetic

SEQ ID NO: 3512 - protein, 175 aa, Artificial Sequence
  Synthetic
KEAEDVLEKAKRLLKRSDEVVEEANDESRRLLDKIRKLVDTVNEESKRLLDRVRELREAGTDKKDVKKILEDIVRRSEEMVERVERLLREVVERSRELVERVHELNKEILERIRREVEDKDAVRDVEREVRRSSKRLKELHEEDKRRVRKILERLKRLHEKDRRDLEKVMKEVED

SEQ ID NO: 3513 - protein, 175 aa, Artificial Sequence; identical to SEQ ID NO: 3512
  Synthetic

SEQ ID NO: 3514 - protein, 175 aa, Artificial Sequence
  Synthetic
DDLDEVIKDIERLLKESDDDVERVIREIKKLLDEVRKRVRDANEDSKRLLREVERLAEAGLDRERVEEELRKIVEKSRKAVEEVKRLLDEILKRVTDAVREVHELNKDILRRVRERVRDERLVREIERRVRKSSEDLRRRLEEIRERVEDIERELRKLHEEDKKRVEDILTEVRR

SEQ ID NO: 3515 - protein, 175 aa, Artificial Sequence; identical to SEQ ID NO: 3514
  Synthetic

SEQ ID NO: 3516 - protein, 174 aa, Artificial Sequence
  Synthetic
SEKERVVEEVRKKLEEIRRRTEEMIERVERLLDEIRRRNKELVERNKELNKRIAEIVRDRNNKDEVKELIDRSKKSTDDVNEESRDLARKVKELVDRANKESRRLVEEVRKEVEDLIDSELARDIKRKLEKILEDSERLVDEIRKRIEKIKRESDETVRESRESSRRLLEEVKR

SEQ ID NO: 3517 - protein, 174 aa, Artificial Sequence; identical to SEQ ID NO: 3516
  Synthetic

SEQ ID NO: 3518 - protein, 179 aa, Artificial Sequence
  Synthetic
SEVERLLEDNRRTIREDEERNKRVVDTWRELTRRLEERIEKVLTDNKKTVEDLVRKRGRDRDVLRIIKELEDLSKKIEDDLREIIKRDRELARELKERSDELLKRLRELSKRIEKVLRDRRRDDDELRKDLERLDEESKRASEKLEEEVRREIKRSKELIEEVERKVEEIDKRADERLN

SEQ ID NO: 3519 - protein, 179 aa, Artificial Sequence; identical to SEQ ID NO: 3518
  Synthetic

SEQ ID NO: 3520 - protein, 179 aa, Artificial Sequence
  Synthetic
SEVERVLEKLKRDVEKNERDNRRVLKKLREDVKKDADDNRKVLEDLRRAVEELRREVGRDRDVERILRELEEALRRIEEESKKLIRRLEDLLREIERKSRELLKRLRDLLRRIAEVLRANTNDTKDLVDEARKVLETSKRLSDELKKEVEKMLRESREMSKRLKEEVDRILKEVRDKAR

SEQ ID NO: 3521 - protein, 179 aa, Artificial Sequence; identical to SEQ ID NO: 3520
  Synthetic

SEQ ID NO: 3522 - protein, 174 aa, Artificial Sequence
  Synthetic
DELEEVIDRNRKSLKEIEERNKKVIEDLRRAIKEIEDRLKEVLDRVKKRIEDIERRVPGKEILDKVREMVKELEDRVRELVKELRKLVKELEDKVREHSKKVRKLSKELEDELRKEGPVEELRKKIEDVDRKVRKESEDLKRELKKLLDEIRRKVRELEERAKRVEEEVDREAK

SEQ ID NO: 3523 - protein, 174 aa, Artificial Sequence; identical to SEQ ID NO: 3522
  Synthetic

SEQ ID NO: 3524 - protein, 174 aa, Artificial Sequence
  Synthetic
SELEEVIRDNERSLKEIEDKNREVTKTVREEIKRIAKKLKEVLDRNRETVRDIERRVKGEEILREVRELSDRLEEDARRILEEVKELLERLEREVEKHSREVRDLSRKLADRLRKEGPVDELRRRIKEVDKEVEEKSEKLKREVKAVLDRVEKLAEEIRKKVEDVDRTVEEKAR

SEQ ID NO: 3525 - protein, 174 aa, Artificial Sequence; identical to SEQ ID NO: 3524
  Synthetic

SEQ ID NO: 3526 - protein, 174 aa, Artificial Sequence
  Synthetic
KEMEDLEREVERVLKRLEELVRELLETVRRTLTRLKRKLDEKKKELDKVNEDLDRVTREGRDRREIIKEAEKSLEDLKRDLERIKREIDKINDELRKRVKEIVDRARKILEDLRRNNLEERVVKKLEDAIEEIKRKLEKVHDEHRRTVEKIEEDIRRVEEEHRRTIKEIKEKLK

SEQ ID NO: 3527 - protein, 174 aa, Artificial Sequence; identical to SEQ ID NO: 3526
  Synthetic

SEQ ID NO: 3528 - protein, 174 aa, Artificial Sequence
  Synthetic
SESERLAKEVEKKLKDAERLVKELHEEVDRMNRDLERKLREISERAKKTTEDVERVAERGEDRREIDKDLRRVNKEVKDLIDKLEDEARKSHEEHARVLKEIEDRLREVLKEVEANNLPEEVIKKVRKDIEEITRKLERSNREHERTLREIKKRAEKVHEDHRREIDRIREELK

SEQ ID NO: 3529 - protein, 174 aa, Artificial Sequence; identical to SEQ ID NO: 3528
  Synthetic

SEQ ID NO: 3530 - protein, 174 aa, Artificial Sequence
  Synthetic
RESEELEREVERVLRELEELVKRLHDDVRRVDEELDRKVRDLHKKVRDVLRRVEKLVRDGRDAREIRKELEDAHERHRRMLEKIEDEARKSHEDHKKVLEDIKRRAEEILKKLRDENLEDRVVDRLRRKIEEIARRLRKSNEDHRRSLKEIKDKLEESNERLRRALEEIAERLR

SEQ ID NO: 3531 - protein, 174 aa, Artificial Sequence; identical to SEQ ID NO: 3530
  Synthetic

SEQ ID NO: 3532 - protein, 175 aa, Artificial Sequence
  Synthetic
SEKDEVITRVETELRRVKTEDRDVARRVKEELEDLKRRLERVIEDNERTLRELKKELKERNKPDDEAERLLEKSREVAERVLRKLEEIIKRIEEEIKKMLDESEKIVEEIRDVVRRKGVDEDVVRELEKLLRDWEKRSREVEEKLRRLLDELRETLKEIEKELRRLDKEIKERLR

SEQ ID NO: 3533 - protein, 175 aa, Artificial Sequence; identical to SEQ ID NO: 3532
  Synthetic

SEQ ID NO: 3534 - protein, 175 aa, Artificial Sequence
  Synthetic
DREEKVKRRVEEELDRVRRTDDRVLKRVEERLREDEKRNEEVIRRNEKTLRELEKRLRDNRKPDDRMRELLERSRRKAEEALRKTKKIVRDVREKMREAKEESRKIEERIKETIREKGVDEDVVRELEELLKRWKETSERVKRELTDLLRKSEETSKEVTKTLRELDKRIEDELR

SEQ ID NO: 3535 - protein, 175 aa, Artificial Sequence; identical to SEQ ID NO: 3534
  Synthetic

SEQ ID NO: 3536 - protein, 174 aa, Artificial Sequence
  Synthetic
SREEDLKRKIDEVDKEWKKLTKKLEEEIREVEKEWRKLSKELERKIREVEKRLKEAKDRNVDKDDVDRRARELVERIKREAEKINEDVERLLKEIEDRIREINKDVDRLLKELEAAGVPEEVIKTLRERVKDIHREDKEIIDRLREKAERIKEHDRKLLEDLKRTLDKLRREME

SEQ ID NO: 3537 - protein, 174 aa, Artificial Sequence; identical to SEQ ID NO: 3536
  Synthetic

SEQ ID NO: 3538 - protein, 174 aa, Artificial Sequence
  Synthetic
DEREEIKKELDRIIRESEELVKKIKDVIRKLIEESKRLVEKIREDIKRSNDKLDEVTRRGVSKEDVERVLEKSREDSKRLLEKNRKLIEEVKREIRRLIEENRKLIEEVREEIERRNVEEEVKRRAEDLLRRSDEKSKRIAEEAERRLDRSDEESEKILRDNEDMVRKWREKEK

SEQ ID NO: 3539 - protein, 174 aa, Artificial Sequence; identical to SEQ ID NO: 3538
  Synthetic

SEQ ID NO: 3540 - protein, 174 aa, Artificial Sequence
  Synthetic
DETEKITKDLEDLIREDEKLVKDARDTLAKSNEDSRRLVEDLRRLIKESNEELERVVREDVDERELKKLADESRERSKDALRRNKELIDRSREESKKIITRSDELNREIRKRVEDINVEEDVVRRLERLSEESRERLERILRDNKRRLDKSLEDSKRLVEKNDRDLKKWKEDRR

SEQ ID NO: 3541 - protein, 174 aa, Artificial Sequence; identical to SEQ ID NO: 3540
  Synthetic

SEQ ID NO: 3542 - protein, 177 aa, Artificial Sequence
  Synthetic
DERETVREELKELIERLRDLNRKIEELLRRSNEEIRRLVEEIRRRLKEMNDEIRRVLKKVDREIIRKLVRESEKLTEEVRRELKTIVDESRKLVDKVRRENERLVREVKKRLEDAKRKGSIDDKVLKEAKELLDASEKHLRDLIETNERVLKRWEEELDKIAEENERVLRKWEEEAK

SEQ ID NO: 3543 - protein, 177 aa, Artificial Sequence; identical to SEQ ID NO: 3542
  Synthetic

SEQ ID NO: 3544 - protein, 175 aa, Artificial Sequence
  Synthetic
SEREEVLKKIREMSKRDNEKNKRILDDVRRLSKEDNKDNDRLVEEHRRKITELEDRVRKEGPREEIRKESRRVLEKTAEDFKRSIDRNRKANKEVRDKVKKSIDENKKVLDDAKTEVGEDEVLREVEELSRRDEKRSKEILEEVSKLSKDDEDRSRDLLRKAEEENRRLEEKLRK

SEQ ID NO: 3545 - protein, 175 aa, Artificial Sequence; identical to SEQ ID NO: 3544
  Synthetic

SEQ ID NO: 3546 - protein, 175 aa, Artificial Sequence
  Synthetic
SEKETVLEDIRRMSKEDNEKNERIVERARRILEKIEEKNRRVKEEAKKMLERIKKLVKDRGPDKDLKRELEEVVKTLEELHKRLIDELRRVVEEVERLVRESIKENRKVLKDAADRVGEDRVVDEVRKRSEEDERRSRELLEEVRRAVKRVEDKSRTTVREIRERVKEVKKRLDD

SEQ ID NO: 3547 - protein, 175 aa, Artificial Sequence; identical to SEQ ID NO: 3546
  Synthetic

SEQ ID NO: 3548 - protein, 178 aa, Artificial Sequence
  Synthetic
SEVEDVVRKVRKLVEKSTRDNKRVLEKVRKLVKESSDKNKKVLDEVEELIERLREKLERIRNDKEKEELKKEIDDVLERVERLHKELKKENDDVLREVEEVSRELKKRNDEVLKRVKEAGVDRDALEEIRKRVEDNKRRSDESLEEIRRLVEENKRRSEKTLKEIREKAKRLKDEIDR

SEQ ID NO: 3549 - protein, 178 aa, Artificial Sequence; identical to SEQ ID NO: 3548
  Synthetic

SEQ ID NO: 3550 - protein, 178 aa, Artificial Sequence
  Synthetic
SEVEKVEREVDEMVRDSTKENEDILREVRERLKKIKEDLDRTVTEVRRLLKELEEKAREVRDERLKRRLEEELDRILKEVEELAKKLKDDVEEVLKEVKKLSKRLKDKNDKVLKEVEEAGVTKDMLDRVREKVKRNKEESDKSLDEIRRIAEEVKRRIDELLKEIKKRAEELKRKLRK

SEQ ID NO: 3551 - protein, 178 aa, Artificial Sequence; identical to SEQ ID NO: 3550
  Synthetic

SEQ ID NO: 3552 - protein, 178 aa, Artificial Sequence
  Synthetic
SEVEEVLKRARELVERSTRENRKILERARKMLEDARKTNEDVLRDVERLLDELRRELEKIKEDRLKEELKKKIDDILRKVEKLHREIKKRIDEVLEELAKLSKELKEDNDRVLKEVEEAGVDKEVLDEIRELVKENKKRSDDSLREAEKRLRELKEESDKTLDEIRRKLEKLKEEIDR

SEQ ID NO: 3553 - protein, 178 aa, Artificial Sequence; identical to SEQ ID NO: 3552
  Synthetic

SEQ ID NO: 3554 - protein, 178 aa, Artificial Sequence
  Synthetic
DEVETVRKDVERLVRTSNDENRRILETARKLIKEVREKNKEVTDRVRDLLRRIEEEVKKVKDKELKDRLKKKIDEVRERVERLHKEIKDELKEILDELERLSTELKEKNKKVLKEVEDAGVDERILEEIRRRVEENKKRSDESLKEARELLRDVERESDETLKEIEEEARRLKEEIDR

SEQ ID NO: 3555 - protein, 178 aa, Artificial Sequence; identical to SEQ ID NO: 3554
  Synthetic

SEQ ID NO: 3556 - protein, 175 aa, Artificial Sequence
  Synthetic
DEVKKVVDEARKLVEDDKRTNEEVLRRTRELLERDERKNEEAVKRIRDLLKEIKKLVEAGVDKRELKKRIDELLERLERLVRDSERLNEEILKEDRKVVEESEERNERIKDRLRKLPVDEELLKRIDELIKESKRRTKEAHRESEELARKTKKSTRDLLREVEKRLREIKEEIKR

SEQ ID NO: 3557 - protein, 175 aa, Artificial Sequence; identical to SEQ ID NO: 3556
  Synthetic

SEQ ID NO: 3558 - protein, 175 aa, Artificial Sequence
  Synthetic
SDVEKVVDEVREKVKRDKEDNRRVAKEARELVKESSEKLERLVTEVKKLIKTIEKLVRDGVDKRDLERKLREVEEEVKKMADRLREENEKILRDLEEMVKESRERNERIKDEVRKLNVDDELLKEIDKLIKESKKETDDLLKEIKDLIDENKRRIDKLLREIEKLARKVKRDIEK

SEQ ID NO: 3559 - protein, 175 aa, Artificial Sequence; identical to SEQ ID NO: 3558
  Synthetic

SEQ ID NO: 3560 - protein, 175 aa, Artificial Sequence
  Synthetic
SDVEKVVEELRRLVRKDEEDNRRAVEETRRLVEDSSRKLEEMVRRVRDLIRKVEELVKSGKDKRELTKRLDDILERVKEAAKRLRDINERILERDREMVKRSRDTNEEILDRARKLRVEERLLREIEKLIRESKKKTDDLHRESKKLIEDNKKRIDDLLKEIKDRVERVKEEIRR

SEQ ID NO: 3561 - protein, 175 aa, Artificial Sequence; identical to SEQ ID NO: 3560
  Synthetic

SEQ ID NO: 3562 - protein, 175 aa, Artificial Sequence
  Synthetic
DEVKKVVDEVRKKVEEDKDDNRRAVKETRELVEESSRDLKRLVETSRRLIEEVERLVEKGVDKRRLKELLEEILREDRRAVEELDKKNREILRRDRKAVEDSEKKNEDIRKEVEELDVEERLLREIRKLITESKKTTRDLHRDSKRLIDENRKRIRDLHEETRKLVKEVLDKIRK

SEQ ID NO: 3563 - protein, 175 aa, Artificial Sequence; identical to SEQ ID NO: 3562
  Synthetic

SEQ ID NO: 3564 - protein, 175 aa, Artificial Sequence
  Synthetic
SDVEKAVDEVRKLVKDSNEKVERVLREVRKLIEEDERKNREVFERVRKLIEDILRLVKGGTDKRELEKRLRDVLRRVKEAVEDSRETNERILTDVKRIVEELRKENEDIEDRVRKLRVDEKLLRDIREEIERNRRELEKALREIKKEIEKTKRKTDRLLETIKELIDRVVEEIKR

SEQ ID NO: 3565 - protein, 175 aa, Artificial Sequence; identical to SEQ ID NO: 3564
  Synthetic

SEQ ID NO: 3566 - protein, 175 aa, Artificial Sequence
  Synthetic
DEVETVKRRVEELVKRSNEELKRIVEETRRRVEDDERDNERIIREIKKKLKDIEELVKSGTDKRDLKRKIEEILRELKEAVDRSRELNKEILRKDREKVEELRKRNKDIEDEVRKLPVEEEILKTIRRLIEKNREDIDRLHEESKREIDRTKERTDRLLDDVRRIAERIKEEIDK

SEQ ID NO: 3567 - protein, 175 aa, Artificial Sequence; identical to SEQ ID NO: 3566
  Synthetic

SEQ ID NO: 3568 - protein, 175 aa, Artificial Sequence
  Synthetic
REVEEVLKEVDELVRKSNEDLKDIVRRTRDLLRKDKERNDEVVRRSEELIRRVEELVRRGRDKRELTKRLKEILDEDREAVKESKKLNEEILTEDREAVRELEKKNRKILRDVERLPVDEEALERIKRKIDENEKEIRELHKESEKRIRDTLRATDKLHKDTRRRVEEVKEEIKK

SEQ ID NO: 3569 - protein, 175 aa, Artificial Sequence; identical to SEQ ID NO: 3568
  Synthetic

SEQ ID NO: 3570 - protein, 175 aa, Artificial Sequence
  Synthetic
SDVERVVERARDLVRKSDDDLRKMVAETKRLVEESSKKLDKIVRESRELIRDVKRLVEEGKDKRDLRRELKKILDRDRRAVEELRKDNERILERDRRLAERDDELNRKIEDELRKLNVDEELLKEIKKRIDESREKTKRLHEESRKLIEDNKRRIDELHKETKEEVERAKKEIED

SEQ ID NO: 3571 - protein, 175 aa, Artificial Sequence; identical to SEQ ID NO: 3570
  Synthetic

SEQ ID NO: 3572 - protein, 179 aa, Artificial Sequence
  Synthetic
EEVKRALEELDELVKRIEEDSRRMVKEAEDLVEKIRKEIEDLLRRSRKLNEDIRRLIDRDNEDKTVERLLRRDEELNEEIKRRVDEVLKRIKELLDRMNKRSEDLLRRLKERLEELAKDGKISEDILRRADELLKRLRRKDEELTKKIERLLEKVAKEVEDINRESKRSADEVRKRVRK

SEQ ID NO: 3573 - protein, 179 aa, Artificial Sequence; identical to SEQ ID NO: 3572
  Synthetic

SEQ ID NO: 3574 - protein, 179 aa, Artificial Sequence
  Synthetic
SSVKEVRDELKRLVDEIRKESEDMVERLRRLVEEIRKRNEELVRRSEELNERARRLIERDNNDKEVERLLDEDRKLNERIKRESDDLLRKLEELVKEINRRSKELLDRLEELLRRAKKEGKVDDKILKEAEDLLRDLERRDRELTREVEKLLEELRRTSEETNKRSKESADRVEDEVRR

SEQ ID NO: 3575 - protein, 179 aa, Artificial Sequence; identical to SEQ ID NO: 3574
  Synthetic

SEQ ID NO: 3576 - protein, 179 aa, Artificial Sequence
  Synthetic
KEVEEALKRVRELVKRAEDMNEELLRRSRKLNDEIRRRIEEMLRRLEEVVRRIKELVDRDNDDKTVRELLKKIEELIERVIRTVRKLLKRDKELNDRLRRESERVLREIRKLLEEARKDGKVDEKILTEIEKRLKDLEKKSRDSNRESEESLERIRRKVEEIARRVRELLDRLRREVER

SEQ ID NO: 3577 - protein, 179 aa, Artificial Sequence; identical to SEQ ID NO: 3576
  Synthetic

SEQ ID NO: 3578 - protein, 178 aa, Artificial Sequence
  Synthetic
SRLEEVTRRARKLVEDITRELRKAVEDSRRVVDKIRRLNEELTRRSRELVKEVKDKVRDKDKLKEVEERIRRLNEESRRLSKEVADELRRINEESKKLLDEVAERIRKLLEDLRAESDTEKVREILEEIRRLLEELEREVKELNEESKRRLDELEKRSEETNKESEDLLEKVRRDVEK

SEQ ID NO: 3579 - protein, 178 aa, Artificial Sequence; identical to SEQ ID NO: 3578
  Synthetic

SEQ ID NO: 3580 - protein, 178 aa, Artificial Sequence
  Synthetic
SELEDVVRRLDELVKRIKEENRETLERSRRLVEEAKRTNEETEDRMRRLVEEIEKKVRGDEELERVREEIERANEDDRRRVDEMAKTIRKVNEEDKRRLDKVRREIEELLEDLRRKSDTEEVRRLLEEIRRKLEDAKRHVEELSEESKKLLKELEEHVREVNKKSEKLLRELKDKVKT

SEQ ID NO: 3581 - protein, 178 aa, Artificial Sequence; identical to SEQ ID NO: 3580
  Synthetic

SEQ ID NO: 3582 - protein, 178 aa, Artificial Sequence
  Synthetic
SELEKLVEDVRRLVEKIKRDNRKTLKELEELVREIVERNRDTLRRSRELVDRIKKRVRGEKLLDDVVKDIERVNRDDERRLREVMREIERANDEDRKRVEEAAKRIEELLEDIRRKSDTEDVRRVLKEIKELLERVREHVERLNRDSERLLKDLEEHARRLSKESKELLRELEERVRT

SEQ ID NO: 3583 - protein, 178 aa, Artificial Sequence; identical to SEQ ID NO: 3582
  Synthetic

SEQ ID NO: 3584 - protein, 178 aa, Artificial Sequence
  Synthetic
SEVEKIREDVKKLIEESKKLNRDILEEVRKMIERWRDTTRRIRERIRKLIEEAEEEIKRSTDEELIERIKKKIDDVLKEIEDLLRKTKEEARKVLEDVERLLREDKRRNDKALEDVERAGASSEVLEEVKRLVEESKRESDEILKRVKKLVDDLARTDDKVLEDIKREVDRLKKELED

SEQ ID NO: 3585 - protein, 178 aa, Artificial Sequence; identical to SEQ ID NO: 3584
  Synthetic

SEQ ID NO: 3586 - protein, 178 aa, Artificial Sequence
  Synthetic
SEVEKIKKDVDRMITEWEKRSRDIAKTVDELIEDSRRLNETIRRDVDRVARELKERIKRTTDEELIERIERRIDEILDEIRELLKRDEEKNERVLREAERLLRETKERVKEVRKRVRDKGVSDDVLKKIEEALKRLADRDDDILRRIETLVRKTRRESEELLKEVEDKMRKLKEELRR

SEQ ID NO: 3587 - protein, 178 aa, Artificial Sequence; identical to SEQ ID NO: 3586
  Synthetic

SEQ ID NO: 3588 - protein, 178 aa, Artificial Sequence
  Synthetic
SEVEKLTEDVKRLIEKSKRNNRDILRKVKEDIDEWRKRTKKIADEVRKTERDLEEKIKRTKDEEIIKRIKKEIDEILKRVEDLVRDTKERVKEVDTEVKKLAEDNKRENDDVLKKVREAGVSDEVLRRIEEDLKRSKKETDDILKEVKDLLTDLLRRDDEVLEEIKRRAERIKEEIDR

SEQ ID NO: 3589 - protein, 178 aa, Artificial Sequence; identical to SEQ ID NO: 3588
  Synthetic

SEQ ID NO: 3590 - protein, 175 aa, Artificial Sequence
  Synthetic
REVEKILTDVRRLIEEWRKKTEDIKREVDKLIEEWRKRSDEIADRSRKLAEEIERLLREGVPREDLRRMIKRILDEDRRLLKESRDKAKEIRDRVEKLVRETDKKVKEIEDRVRKAGVEERVLRKIRRDLERLKKTDDDVLKTIEKKLRELEERDRRLHKESREIAEKLKEDIDR

SEQ ID NO: 3591 - protein, 175 aa, Artificial Sequence; identical to SEQ ID NO: 3590
  Synthetic

SEQ ID NO: 3592 - protein, 175 aa, Artificial Sequence
  Synthetic
DEVETIMEKVERDVKRWEELTREIKRRSDKLIEDWKKRSEEVLRESTELIKTIEKLLREGAPREDLDRLLKEILKRDRDLLKESRDRVREAEKEDEDLLRETKKRVKEIKDEVREAGVDESVLRTIDELVRRLEEEDRKVHEESKELARRLEKEDKRLHEESKKLIDELEKKIRD

SEQ ID NO: 3593 - protein, 175 aa, Artificial Sequence; identical to SEQ ID NO: 3592
  Synthetic

SEQ ID NO: 3594 - protein, 175 aa, Artificial Sequence
  Synthetic
SEVEKILDEVRKLVKKWDDETRKILEEIDKLIEDSERLLEKIERRSKKLADEIRDLLRKGAPREELKKRLEEILKEDEDLVREDEKLNEEILRRLEELVKRTDDEVRKIDKRVKEAGIDKSVLDEIRERVTRAKEKDKRVLERVKREVERTKEESKRVHEKSREIIERLKKEIDK

SEQ ID NO: 3595 - protein, 175 aa, Artificial Sequence; identical to SEQ ID NO: 3594
  Synthetic

SEQ ID NO: 3596 - protein, 174 aa, Artificial Sequence
  Synthetic
DEVRKVRKELDDAVRKLRRDHERVIRESEKVSKEIEDRARDVERRLDKVVDELRKKDVKEEIEREVERIREEVRKKLEEILDRVRKINEKAREHSERNKRDVERVKKEVADRLRDGDSREEVMKRLRDMIRRLKEDAEKLKRELKRRHERVKELLDKVRRELEKLEKEVDDKVK

SEQ ID NO: 3597 - protein, 174 aa, Artificial Sequence; identical to SEQ ID NO: 3596
  Synthetic

SEQ ID NO: 3598 - protein, 174 aa, Artificial Sequence
  Synthetic
DEVREVERESEELSEELRRRHEEVVKESEEVSKEIEERIREVIRDLRRVLRKLEEDGVRKEILEEIEKVVRDVEREAERILREVERVNERVRELSKRNIKETEEVNKKVRDELRDGDSREEVVKELRELHDRSRKKVEDIAREARDMHRKAADKLRRLMEDLKRVLEEIRKKVE

SEQ ID NO: 3599 - protein, 174 aa, Artificial Sequence; identical to SEQ ID NO: 3598
  Synthetic

SEQ ID NO: 3600 - protein, 171 aa, Artificial Sequence
  Synthetic
SRVDKIRRELRELLERDREDLERAMRELRKIDKDIDERLKEVVERLRRIDERIDREDRDREELEELLRRSEDTVKKISDEIEDLLRRSEERLRRVLERSKKTNDEIRERLRRVDVSKEVEKEVEDAIRETEKRAREVEEENRKSVEDVRRKMKKVEEENRKSVEDVRRKAT

SEQ ID NO: 3601 - protein, 171 aa, Artificial Sequence; identical to SEQ ID NO: 3600
  Synthetic

SEQ ID NO: 3602 - protein, 171 aa, Artificial Sequence
  Synthetic
SRVDKIRKELEDLLREDEKRIRDMVKRLREIDEKIDRELEKVARELRELLKRVEDSPDDREEVERMLDEIRRRLDEILERIERLLRESERAVKEVEKESRRTNDEIKKRLEKVDVPEEVEKKVRELVERTEETVRDVERENKESVKRVREKAETVKREVEKRAKEVRDKAK

SEQ ID NO: 3603 - protein, 171 aa, Artificial Sequence; identical to SEQ ID NO: 3602
  Synthetic

SEQ ID NO: 3604 - protein, 179 aa, Artificial Sequence
  Synthetic
SEMEEVEERLKELDDKDKRDVDEARKRLEKLDRDIDRRIKEVTKRLRDLNRRIEEELRRNKEKKEELDKLLRESEETTRRILDEVRKLLERSRREVRKIVEENKETIERSRKEVEKIRREGVLTEEVEKKNRKSADDSRETAKRVEEENERTIKRLEEELREVEEEDRKTVEDLRRTLK

SEQ ID NO: 3605 - protein, 179 aa, Artificial Sequence; identical to SEQ ID NO: 3604
  Synthetic

SEQ ID NO: 3606 - protein, 179 aa, Artificial Sequence
  Synthetic
DEVREVTKELRDLDREDKKRVEEATKRLRDLNEEDKRLVKKVADDLREDLKRIRERLERNKEKKEDLERLIKEIEEKLEKIKRDNDKTIRESRRTTEELRRENRKTIEDSRRRVKEIRDRGVLTEEVEKENERSVKKSEEDLKRVKDEDEESVKESRKAVREVEEELRKRLKELREELK

SEQ ID NO: 3607 - protein, 179 aa, Artificial Sequence; identical to SEQ ID NO: 3606
  Synthetic

SEQ ID NO: 3608 - protein, 170 aa, Artificial Sequence
  Synthetic
SEDETVRREVRELIRRLRKHSEDVKRESDKLLDEIRRRVKEVEDRVKEAVERLDRKKRDERLRDVVEKIDRLLEEVKDRIRKVERDSKEMNKKDEERVERVVRKLEEILDREGVDEDVVRKIRTVVKKIEEDNKKTADELRKLHKDIKKEVDDMEKRIRKVLDEIDKEIK

SEQ ID NO: 3609 - protein, 170 aa, Artificial Sequence; identical to SEQ ID NO: 3608
  Synthetic

SEQ ID NO: 3610 - protein, 170 aa, Artificial Sequence
  Synthetic
DEEERARRELEDLLRRLREHSERVAKEVEEVVERNRRKSEEVEKRVREMLKRLDEKKRDEELKRVVEEVKEMLKRLRELNEKVVEEVRRILEKDRRLVDKVRRDLERLLREKGVDKDVVKEIRDRVREAERRNREVVEEIRKLLKEIDKTTRDVEEEIRKLLKRIDEEIN

SEQ ID NO: 3611 - protein, 170 aa, Artificial Sequence; identical to SEQ ID NO: 3610
  Synthetic

SEQ ID NO: 3612 - protein, 170 aa, Artificial Sequence
  Synthetic
DEERKARTEVKKEVDDLKKHVKDVADEVREAVKKNRRKSEEVSREVRDLIRRLKETKDDEELKKAIKKLEELLERMRRLNEKVVKEIKKLLDDDDRLVEEVVEDVKRILREKGVDEDVVREIRELLKRIREENRRTVEEIRKLLKRIDEATEELVREIRRVVKEIEDKIR

SEQ ID NO: 3613 - protein, 170 aa, Artificial Sequence; identical to SEQ ID NO: 3612
  Synthetic

SEQ ID NO: 3614 - protein, 170 aa, Artificial Sequence
  Synthetic
DREEKLRKELKKLIDDDRKKSEDVEREVRKLIKENEDKSRKVEEEVRKLAEELDTKKRDKELEKVIRDLERLLEELKELNDRVRRTLEELLKKLKELNERARKELEDILRDKGVDEEVIKEIRTVVKRVNEESEEMTKRIRDVVREADKTTEDVRRKIEDMVRRIDERTN

SEQ ID NO: 3615 - protein, 170 aa, Artificial Sequence; identical to SEQ ID NO: 3614
  Synthetic

SEQ ID NO: 3616 - protein, 185 aa, Artificial Sequence
  Synthetic
DELRRIEEEVRRRFEEMARRHRKVKRDIEELVKEVTKRNKDTEREIEELVKRMKDEIDRIKEDEKLERLLREAAERLKELLKRDKKLVEDIAREIERVIKELRKINEEVSEEIERLLRELEKLRAEEEKVRRVVKKAREAVERSSREVEKVEREVKKLLDDLKKHSEEVEKKVRELLKRLEDRAR

SEQ ID NO: 3617 - protein, 185 aa, Artificial Sequence; identical to SEQ ID NO: 3616
  Synthetic

SEQ ID NO: 3618 - protein, 185 aa, Artificial Sequence
  Synthetic
SELEEIVKTAREIMDRVRREHDRVATEIRELVKRLEEANRRVREEIKRLVKEVEERIRKIKEDKRLREVLEEIARELEKLLKEDKDLLRKAAEDLKRLIEDLRRINEEVEDIARKVIEELRKSRAPREEVEKVVKEIEDVVRESSERVRRVVEEVKKLLRELAKHSEDVEREVRELLKKLAREVD

SEQ ID NO: 3619 - protein, 185 aa, Artificial Sequence; identical to SEQ ID NO: 3618
  Synthetic

SEQ ID NO: 3620 - protein, 185 aa, Artificial Sequence
  Synthetic
DELKEIRDRIKKRVEELRRENEEVREEIERIVRKAREDHRRVERELEDLVRRARDKVEKIKDRETLKRLLDKVEKDIRKILDELRRLNEEVARTLEKLLRDDKRLVDKAAEDLRRLIEELKKSRADEEEVRRVVKEVEELLEDLKRHSEKVKEEVKRLLEESSREVERVEEKAREMLERLRERAR

SEQ ID NO: 3621 - protein, 185 aa, Artificial Sequence; identical to SEQ ID NO: 3620
  Synthetic

SEQ ID NO: 3622 - protein, 185 aa, Artificial Sequence
  Synthetic
SEAEKLRDEIRRIVEKAERDHEDVKKKIEDLVKRVEERNREVTKRIRDLVRDARRRLDEIKEDEKLERVLRKVERDLRELIKEDEDLLRRIAEALEDMLRKLEKLNRDVAEILKELLRKLRETRIEKDKLKKVEEEVEELLKKSNRKVREVKRELKELLDRLAKHSDEVRREVEELLRDLARRAT

SEQ ID NO: 3623 - protein, 185 aa, Artificial Sequence; identical to SEQ ID NO: 3622
  Synthetic

SEQ ID NO: 3624 - protein, 185 aa, Artificial Sequence
  Synthetic
SELEKIREDMRELVERLKEANDRMREKIRKILEDVDREHEEVRKRIEELVKRARETIERIRDKRTLDEVLKKVEEELRRALKRLDEINERVKRDIRRLLEEDKRLVEEAARRLKKLLEDLDKSRAEKDKVKKVKEDVKRLLDELRKHSEKVIREVEKLLRESNEKVKRVKEKLEELLRRLRERSR

SEQ ID NO: 3625 - protein, 185 aa, Artificial Sequence; identical to SEQ ID NO: 3624
  Synthetic

SEQ ID NO: 3626 - protein, 179 aa, Artificial Sequence
  Synthetic
DEIETIKKEIDDMLREIKREVERSKEEIDRALKRIREEVKKSEEEIDKALEELRRNGVPEEILRKIEELLRRLKDEHRKLLERIEEVLRRLKRRHDKLLEDAERLLRELKEELDRNKDKSEEIIKRLLEKIRREARKVKELIRTSNEEVRKRLKDLEELIRKSHEDVRRTLETLERETR

SEQ ID NO: 3627 - protein, 179 aa, Artificial Sequence; identical to SEQ ID NO: 3626
  Synthetic

SEQ ID NO: 3628 - protein, 175 aa, Artificial Sequence
  Synthetic
DKERELDKEVRDMIDTLRDSNRRINERSERVLRELDESVKKNEEDIRRAIEELKAEVRRDDLPRGLVREAVERLKKLLERDRRLVTEVKERSKKSNEDDKRLSEEVVKELRRLVREKGVDEKVLKEIRDLARKIKEDNDRSLEDNDRLAKEIKERNKRVHDETRKMLEDIKRELT

SEQ ID NO: 3629 - protein, 175 aa, Artificial Sequence; identical to SEQ ID NO: 3628
  Synthetic

SEQ ID NO: 3630 - protein, 178 aa, Artificial Sequence
  Synthetic
DEDKEIDERVKTVKEEIRRRSKKDKEEVDRVLKESDETLKRILEEVKKVLKEIEERVPDLDEVRKKVEDVERKVATELEKNLRRVDKAVKEVRELNKELERELDEIRKEVRDLLKRIRREEELRRIVERVRERVTELREKLKEIHKRTREVADELRKNNRRWEEDVRRLVKELREREE

SEQ ID NO: 3631 - protein, 178 aa, Artificial Sequence; identical to SEQ ID NO: 3630
  Synthetic

SEQ ID NO: 3632 - protein, 178 aa, Artificial Sequence
  Synthetic
DEEERIRTKVEKVKRELEEKSERDKRALEKVEDESRRTSEEDERELERVIEEIIREVDKLDEVREKLERVLRKVRKLNRDSEERLKRIKEEVEEANREIRRRLEEVERRVKDLLDRVRREEELRRIEREVDRAVKELDRLLRELHRRTREVVKELRDLDRRIHEDTRRVVREAREEVR

SEQ ID NO: 3633 - protein, 178 aa, Artificial Sequence; identical to SEQ ID NO: 3632
  Synthetic

SEQ ID NO: 3634 - protein, 178 aa, Artificial Sequence
  Synthetic
SEREEIEERVERVERESEDTSRRDEEALERVLRESEDTSRKDREALRKALEDIERELPNLEEVKRKVERVVEEVEKLNRDSERKVKEIAEEVRRLNEESRRELKEMVRRVRELLKRVRREDVLRRIMEDVKRVADKLRELDKKIHEETRRAVDDLRRLDKEIHDRTRKLVKELREEAK

SEQ ID NO: 3635 - protein, 178 aa, Artificial Sequence; identical to SEQ ID NO: 3634
  Synthetic

SEQ ID NO: 3636 - protein, 174 aa, Artificial Sequence
  Synthetic
SEIEEITKDLRRLVEEIERLNKRVEDENERTAKELRDRVREAEKKNRKTVDDIRKLIEDGVRREEIREVIERDREEVEKVVRDLRDLLRKDRKRVREAVETSERLLEDIKRRLEEVDVSDEVRREVDELIKKSRETLKRIERRSEEVAEELERRLRDIKRRSEDMVRELEERAK

SEQ ID NO: 3637 - protein, 174 aa, Artificial Sequence; identical to SEQ ID NO: 3636
  Synthetic

SEQ ID NO: 3638 - protein, 174 aa, Artificial Sequence
  Synthetic
DEKEKVTKKIEELLKAIEDKIREVEKRSRDSAKEIEDRNREVEKRNKDTVRRIRELIERGVREEEIKKLIEEDKERVRKMVEETKKLVKRSTDEVRRVVDEARKLIERIKEEVERMPVDEEVRKRLEDAVERIKKELKRIKDENDEVVKKSRDSLRRIKEDSERVVRELEERAK

SEQ ID NO: 3639 - protein, 174 aa, Artificial Sequence; identical to SEQ ID NO: 3638
  Synthetic

SEQ ID NO: 3640 - protein, 174 aa, Artificial Sequence
  Synthetic
KRKEDIERRIEKLVRDDRRLVREAEKRSKESVDRLRDLVDKARKESDESARTIDKLIKDGVERRDIERMIRESSKRVKDVIERLKKLLEESTRTVEELVRRSKRTLDEIREEVERLDVEERVRKRLEDVVRESKKRLDEIKKRNEDVVRELEERLRRIEERNRRVAEELKRKAK

SEQ ID NO: 3641 - protein, 174 aa, Artificial Sequence; identical to SEQ ID NO: 3640
  Synthetic

SEQ ID NO: 3642 - protein, 175 aa, Artificial Sequence
  Synthetic
SEIEDIERELRESNKRHEDTLRKIKRDLEDSNRRHRETIRDIEARLEEVIKKLREDGVSEEVLKEIKRMLEEIVRDIRRSHEEHKKLLDEIKREAEKSHEEHRKLLEEIRREAEKNKVREEELRELVKRVHERAERVNRDLKRKVKEVHDRVREVNKELRRKVEELKRRAEERRR

SEQ ID NO: 3643 - protein, 175 aa, Artificial Sequence; identical to SEQ ID NO: 3642
  Synthetic

SEQ ID NO: 3644 - protein, 175 aa, Artificial Sequence
  Synthetic
SEIEDIKRKLDDVIREHARTLKEIKDELKKSNERARERIEDIDRKLRDVERRLRESGVDDDVLRDLEDKARKIKRKLEKIHEEHRRMLEEIEKEARKSLKELKEIVEDIKRKADDNRVRVEELEDLVRRLKKRVEEVNKRLREKVKRLHDEVDRVLRELEEEVKKLKEDVERAAK

SEQ ID NO: 3645 - protein, 175 aa, Artificial Sequence; identical to SEQ ID NO: 3644
  Synthetic

SEQ ID NO: 3646 - protein, 175 aa, Artificial Sequence
  Synthetic
SEREKIEEDIKKALKEAREVVERIKKKLDDSNREHKRTLDEIKKKLDEVIDEVRKSGVSEKMLREIEEVVKKIEEDARRSHEEHKRVLDKIVEDAKRILDRLRELVTRLLEELKKNKRREEEIREDLERIVTEVKKVLDELDKLVKDLHDEVRKVNEELDRKVKKLRKEAEEKTR

SEQ ID NO: 3647 - protein, 175 aa, Artificial Sequence; identical to SEQ ID NO: 3646
  Synthetic

SEQ ID NO: 3648 - protein, 175 aa, Artificial Sequence
  Synthetic
SEIEEIKRRLEDSNRRAREVIKRIEDELRRSNEEHRRTLKEIKEELDRVLEELKRKGVDESVLDRIRELIERIAREAEKSHEEHRKLLEEIRKRAEDIHRRHKEILDDILRKAEDNRTREDELREVVKRVHDEVRRELKKLEELVKKVHEDAKRVNEELRRKVKEVKERAERDVR

SEQ ID NO: 3649 - protein, 175 aa, Artificial Sequence; identical to SEQ ID NO: 3648
  Synthetic

SEQ ID NO: 3650 - protein, 174 aa, Artificial Sequence
  Synthetic
RREEEVEKRLDDARRRLEKSNRDDERLTRTVEEELKRSNDEIRKRLETAMRELKKLVKDGVDKDDVERVLDRVRRELEELVKENKEIVREIRKRNEKSKRDNERLLRKVEEDIRRLDRSEEVERRLEKVEEDSRRELKRSEKRSDEVARDSERLLDEWRRRLEEVIRRVKEETR

SEQ ID NO: 3651 - protein, 174 aa, Artificial Sequence; identical to SEQ ID NO: 3650
  Synthetic

SEQ ID NO: 3652 - protein, 174 aa, Artificial Sequence
  Synthetic
SREETVRERLREVAERLKKSNREIEELLKKAAEELKESNTRDKKLSEDVSRRLEKLSRDGVDKDDVRREIERIKRKNDDTERRNKELLDKIREDMERMARRNKELLRRIEEEIRKMDASEEVEERLKRVIEESERRLDKWRRDLDRVIKESEDLLKKSREDSERVVREVEKKEK

SEQ ID NO: 3653 - protein, 174 aa, Artificial Sequence; identical to SEQ ID NO: 3652
  Synthetic

SEQ ID NO: 3654 - protein, 185 aa, Artificial Sequence
  Synthetic
SEIEEVERMLEDLERRVREADKRVREESKKLEDEIRREDKRVEEMIDEVRKKVDELDRDVRGRERLKEVVERLEEEAEEIVKRVRELSKRLEKKVRDHTREVRRLSEELERRARDIKRRVRERLRDKDEVRRIEEEVDRVIEENRETVKEIEERNRRVLEANRESLRELEERLKRILEEVRRRSK

SEQ ID NO: 3655 - protein, 185 aa, Artificial Sequence; identical to SEQ ID NO: 3654
  Synthetic

SEQ ID NO: 3656 - protein, 185 aa, Artificial Sequence
  Synthetic
SEIDEVRREVEELERRAEEVDREVERRSKELKERVDDVDRRSRELSKRLKDTADEVRKRVRGREDLERVVRDLEKKVEEVVETSKRLSDELRKEAEKHTEDVERLSRKLVEELREIVDRVRKRLRDKDKLETIRRRLEEVLKRNKETVDEIRRRNEDVIRRNEESLEKNERDLRRVLDEVRRSAT

SEQ ID NO: 3657 - protein, 185 aa, Artificial Sequence; identical to SEQ ID NO: 3656
  Synthetic

SEQ ID NO: 3658 - protein, 185 aa, Artificial Sequence
  Synthetic
SELEKVDELVKRLMKEVRDVDRRSEKLTEELERKVREMDRKSKKLSEDLERDARRVEKEVRGKERLEKVVRDLERKVREVVKESERLSRELERDAKRVVEESRRLSEELRRKAEELVRRAREELRDKDALRAIEKKLEDILRRNEETLRRNEDKIRRIIETNKRSLEENRRRLEEVLRRVKESAR

SEQ ID NO: 3659 - protein, 185 aa, Artificial Sequence; identical to SEQ ID NO: 3658
  Synthetic

SEQ ID NO: 3660 - protein, 185 aa, Artificial Sequence
  Synthetic
SITEKVERLIRELERKVKEIDDDLRRTSEEIMKRARKADEDSERLSERLRELVDRLDREVRGKEKVKKVVDDIKREAKRIIEKTDELHEETRRLVEENKRRIDELHKEIRETVKEIEKRIDDDGVPRESAERLKEELRRVLEENRETLERLREENERVLEENKRRVDENREKIKEVLRRVEERTR

SEQ ID NO: 3661 - protein, 185 aa, Artificial Sequence; identical to SEQ ID NO: 3660
  Synthetic

SEQ ID NO: 3662 - protein, 185 aa, Artificial Sequence
  Synthetic
SITERVEEDIKRLMEEAKRVDDKVRKLVEELMRDVKRVDKELAELVEELERRVKDLTRRVRGKERVKEVVKDIERKAREIIRRIRKLLDESRKKAEEIIKELRKLHEDIDRKVKEILRDIDRAGVSREEAERLKEELRRVLEENRRTVEEIERRIKRVLEENEETVRRLEKRIEEVLRDVREKTK

SEQ ID NO: 3663 - protein, 185 aa, Artificial Sequence; identical to SEQ ID NO: 3662
  Synthetic

SEQ ID NO: 3664 - protein, 174 aa, Artificial Sequence
  Synthetic
SKVEELKRRLKKVRDDDRRSVEKLRETLRRVLARDRDEIREAERELREALKRLEDAGADEKLLRDMKKVIDEMKEHLKRNNEELKRVVERVERDLERSHDELRRVIEEVEKRLADGDTREDVLRDVERVVREVLEKNKKILKEVKEVVEESLRNVRDLIRRAREIVKEIVDRVK

SEQ ID NO: 3665 - protein, 174 aa, Artificial Sequence; identical to SEQ ID NO: 3664
  Synthetic

SEQ ID NO: 3666 - protein, 174 aa, Artificial Sequence
  Synthetic
KEVEDLRRELEEAKKRDKDLIDKLKRRAEEVKEEDERSIRENKKALRKAEEDLRRKGADEKLKEDLKRIIEESERNNEDSHRRLEEMIEKVRRHLDRNNEDLERFIKDVDELLRRGDTRERVLEEVRKTLKRSMENVEELEKELEELVTRVRDHNRRDHEETRRLLEEIKRRVD

SEQ ID NO: 3667 - protein, 174 aa, Artificial Sequence; identical to SEQ ID NO: 3666
  Synthetic

SEQ ID NO: 3668 - protein, 174 aa, Artificial Sequence
  Synthetic
DEVERLKEKLEEVRRRDEEIIRKLEEDLERVKRDDDRLVRENEEELKRVEEKLERDGADESLLRELKDVIRRSRDHLTRNNEDLERVIRRVEEHLKRNNDTLKDVLRKVDELLRRGDTREEVLRRVEEAAKRSLDNVDKLEKDVADLVRRSMENVRDLHRRTRRLLEELKEKVK

SEQ ID NO: 3669 - protein, 174 aa, Artificial Sequence; identical to SEQ ID NO: 3668
  Synthetic

SEQ ID NO: 3670 - protein, 176 aa, Artificial Sequence
  Synthetic
SEKEKVLEDAERVLREIKKKNEKALREAEEVARRIAEEVKRIHDRSKEVVDDIKRLADAGEVDEKELEERLKRVIDTVRKLNEDLRKKLEDAIRRLEKLLKESKEELKRVAEELRKDLKDDKDVERRVREAKKENDKSVDEIREEVKRVKDELDRLSERNEEELEKVERDLRRRAK

SEQ ID NO: 3671 - protein, 176 aa, Artificial Sequence; identical to SEQ ID NO: 3670
  Synthetic

SEQ ID NO: 3672 - protein, 171 aa, Artificial Sequence
  Synthetic
DEEKKVLDKLRELATRLSRRVEEAHRESEKIAEEIRRRAEKVLRESRKTVEEIKRSPDDRKDVRRVVKEDEDRSREVVKDLERLLKELEDRSRKLEEELRRIMKKIEEEVRRAGVDERIKDDVRRMKKELEDLIEENRRRVEKVKEDIRRLIRELEARNEDVDRELRRKED

SEQ ID NO: 3673 - protein, 171 aa, Artificial Sequence; identical to SEQ ID NO: 3672
  Synthetic

SEQ ID NO: 3674 - protein, 171 aa, Artificial Sequence
  Synthetic
SRLEKVEKELEELAREDKERIKRVIDDIRRLVREDEERIKEMHKKTEDIVRAIEEEDRDREELKRLLERLEEESRRMADESRRTNEEIRRKVEKVVEESKKTNEEIRKRVEDAGADERIKKRVEKLKRDSKRLIDELRKELEEVVKRSEDLIKENRDTVKEVSDRIREKAR

SEQ ID NO: 3675 - protein, 171 aa, Artificial Sequence; identical to SEQ ID NO: 3674
  Synthetic

SEQ ID NO: 3676 - protein, 171 aa, Artificial Sequence
  Synthetic
DDEERVLKELKKLVEDDRKKIEDVIETIERLAREDVERIKRVIEELRRLVKELEDGDLDKEVVRRLLEEIKRAVKEAVRESEKTNDKIRRDVDRVVKDSKRTVKDIKRKVDEAGADEEIKEDVKRAADESEKLIRELRKAVKRVEEESRRLIEELEREVKEAEERLKRRTK

SEQ ID NO: 3677 - protein, 171 aa, Artificial Sequence; identical to SEQ ID NO: 3676
  Synthetic

SEQ ID NO: 3678 - protein, 181 aa, Artificial Sequence
  Synthetic
EEVERLLEELKELVRRIEERLKRAHDEMEDLVRRIKEEIKKLHEDTKRVVEEIRKLIERDNIDKLLERLIEELKRIHEKINRDIKRAIEELKRLSDRIEEEIRKLIKELEDVLRRITETAGRDERVKEAEDRVRDAVRRLKRLLEEHKKASEKVVRELERLLEENRKTVKEVVDRLREESR

SEQ ID NO: 3679 - protein, 181 aa, Artificial Sequence; identical to SEQ ID NO: 3678
  Synthetic

SEQ ID NO: 3680 - protein, 181 aa, Artificial Sequence
  Synthetic
REVEELIKELRRLAEEIRDRIRKLHKEMEDLARDIERRIEELDRELERVATEIAKLIERDNIDRLLDELLERLDRLSKKIEEDVKRLIDESRRLSEEIAKRIKDLIEELKRLLEEVAKRKGRDEDIKRLEEEVRKVEEELKKLLKEHRDANKEVVDRLKRRIEEHKRKTKDLKEELERRMR

SEQ ID NO: 3681 - protein, 181 aa, Artificial Sequence; identical to SEQ ID NO: 3680
  Synthetic

SEQ ID NO: 3682 - protein, 181 aa, Artificial Sequence
  Synthetic
DEVEEVIERLRRLAERIEERLREMDRRLEELVERAKRTIERLHEELEKLVREAEELIRRDNNDKLVEELIRRSEDLSRKIEETIRRIIERLRKLSREIEEEIRRVIEELKRLLDKIRADRGDDKDVTRLEEELRRVVKKLEDLLREHKEKSDRAVEDLERLLTEHKKRNEDVIRRLKEASD

SEQ ID NO: 3683 - protein, 181 aa, Artificial Sequence; identical to SEQ ID NO: 3682
  Synthetic

SEQ ID NO: 3684 - protein, 174 aa, Artificial Sequence
  Synthetic
SEVEEIRKKAEDVMRRLEELDKRLDEVLKKVSRELEKSDKDLEDRIREVIRELEERGGKKRETLKKVIEDLRKLVEEHKELIERVKRELKRIVDEHHRLIEEAKKRLRDILDKITKDTKDEMERRLEEVVKEAERRSEEVLRRLEKVVKDIKKKSKEILDRLEELVREIRERVR

SEQ ID NO: 3685 - protein, 174 aa, Artificial Sequence; identical to SEQ ID NO: 3684
  Synthetic

SEQ ID NO: 3686 - protein, 177 aa, Artificial Sequence
  Synthetic
SESEEIDREAKKVEREVREMSRRNDEELRRVAKESEDSVRRVEDRVREVSEEVEARGVDDKVREELERISRRIKKLLDESRERLKKMVKESKELNEEIRRKLEEILREVRELLKRVRREKELTEILKRLKDLADELRKLLEDVHRRSKKAADEDRKLNEDILKELEDLARELRKKTK

SEQ ID NO: 3687 - protein, 177 aa, Artificial Sequence; identical to SEQ ID NO: 3686
  Synthetic

SEQ ID NO: 3688 - protein, 177 aa, Artificial Sequence
  Synthetic
DEEKKVRDEIRRAEEESRRSSKRNEDELRKVKEEIERRLEEVRRKAKEVEEKVRREGVPEEVEKRLKEILDEVRRLLEELRERLDRVLRRSEELNKRSEDKLRKVAKEVEELLRNVRREEELRRILERLKEMVERDKETNEEIHRRSKDVVDKLRRRIEDIKRRLDELAEKLKEDTR

SEQ ID NO: 3689 - protein, 177 aa, Artificial Sequence; identical to SEQ ID NO: 3688
  Synthetic

SEQ ID NO: 3690 - protein, 177 aa, Artificial Sequence
  Synthetic
DDERRIRETLKRADEEVEKALREVREHTKDVERENEKLSKENKERLEEVKKRVDDSGVDETVKDELRRIVETSKRLNDESRRKSEEIKKDTEKLLREIKEKVERVLERIERLLDKIRRKDVLRKIEKEIEEMVKDLRRLLKEVEDKDRTLAEELRRINEDIHRRSEEMKKELDDRTR

SEQ ID NO: 3691 - protein, 177 aa, Artificial Sequence; identical to SEQ ID NO: 3690
  Synthetic

SEQ ID NO: 3692 - protein, 182 aa, Artificial Sequence
  Synthetic
KEVEDVEEKIREIVERIRDEARKAEERNRDTVRRIEDVARKLHKRTKEIVDEIRDVLTKRREVEEELRKLLTKLREMNERARRRIEELLRRDKKVTKEVKDKLEKLLRELEEELKKIAKEVDSKEMLETIKRKVEKVKEDLRKKIEDIEKHTRDVEDKVRKELERNEKKSRDVKEEVERRLT

SEQ ID NO: 3693 - protein, 182 aa, Artificial Sequence; identical to SEQ ID NO: 3692
  Synthetic

SEQ ID NO: 3694 - protein, 182 aa, Artificial Sequence
  Synthetic
SELEKAEKENKDSADEIREVLKRLEEENRETAKRIEKHTRDAHRKTEDIVRRIEEVLRRRKEVREEIRELLKRLREVNEEVHRRNEKLVREDEERTKRAEEELRKLLEDDKRRVDEVEREVDAKEALKRIRDHVEEVRREVEELLRKIREHTKEVAEKVRRENEKNKKRSEDVRKKVEDDER

SEQ ID NO: 3695 - protein, 182 aa, Artificial Sequence; identical to SEQ ID NO: 3694
  Synthetic

SEQ ID NO: 3696 - protein, 182 aa, Artificial Sequence
  Synthetic
SEVERVLEENRKSAKEIEDELRKVLRENEKSAEDIEREIDKAEKENRETVKDLRRVLTERKEVREEIERLVREDEKKTKDLIEKLRKLLEDDRRRTEEVKRRIRKLVDEDRERVKEAKRRVDSKEKLETIERHVRKVEEDVERMLKEIERRTRDVMRKVDKLIKEIEKHTREVAKEVKEAED

SEQ ID NO: 3697 - protein, 182 aa, Artificial Sequence; identical to SEQ ID NO: 3696
  Synthetic

SEQ ID NO: 3698 - protein, 178 aa, Artificial Sequence
  Synthetic
SLVEDLERKLEESTRRDEESMKRVREILKELEDRDRKSVKEIEDELRKARKEVKDSRVSEEIRKELEKAVEEVERLLRESHEELKRVIDELEELLKESHKRNKKVVDDVKDVLDKLREIEEMAREVIKTLEKVSRELEETNRRVIDRIRKLAEEILRKNKEVLERLRKIVKEIKEKAK

SEQ ID NO: 3699 - protein, 178 aa, Artificial Sequence; identical to SEQ ID NO: 3698
  Synthetic

SEQ ID NO: 3700 - protein, 178 aa, Artificial Sequence
  Synthetic
SLVETLKKILDDSTRRNEELIRRLEEELKRIKETNERTVRELERELKRAEEEIERQNVSEEIRKEVKDVVDEVRKLLEESKERTKRTIDKVRKLLEESHRDNRRVVKEVEDLLRKLREDEEAAKRVIERLRRLSERNVRTLEEIIKTLRDLARRSKERDDEVLEELKEMIRRIEEKSK

SEQ ID NO: 3701 - protein, 178 aa, Artificial Sequence; identical to SEQ ID NO: 3700
  Synthetic

SEQ ID NO: 3702 - protein, 176 aa, Artificial Sequence
  Synthetic
DELEKVVRELEELAKEILKKLDEIIRDTERLVREAVKRLRELIERTRRLMDEVRKKVRDKDLLKEVKERLDRSHEEAERLVRKLKKDLEDSNRRAEELVRRVEEELKDLVRRLRGTDEKVMRELEDTVRRVREELRKLLEEHNRRVKKVLEDLDRLLDEHRKIVEDIKRDLDRREK

SEQ ID NO: 3703 - protein, 176 aa, Artificial Sequence; identical to SEQ ID NO: 3702
  Synthetic

SEQ ID NO: 3704 - protein, 176 aa, Artificial Sequence
  Synthetic
SEIEKVLEELRELVKKAVTDLRRIIEESKRLADEAAKALKDIIRRSEELADRLRKEIRGREVLEEAKKKLDTSNRDAERLVRELKERLDDSHRRLEELVKRLKDDLDRILEELKGTDEKLARELEDVVRKVKETLDRLLEEHKEIIERIKRTLDKLLKEHNEIVERIKRDLDRRRK

SEQ ID NO: 3705 - protein, 176 aa, Artificial Sequence; identical to SEQ ID NO: 3704
  Synthetic

SEQ ID NO: 3706 - protein, 176 aa, Artificial Sequence
  Synthetic
DEMEKVIRDDEKLLEDVLRRLAEIIRRTEKRAEEMVRELEKLIEDSKRKADDVRKRVRTDEVVKRVKEELDESNEKAEKLVRDLKRELEDSNRKAEELVRRIKKENKRTVEEVKGTDEEVVKRLDDIARDVNRTLDKLLKDHNEIVERIERTLDELLKEHNEIVKRIKEDLDRKRK

SEQ ID NO: 3707 - protein, 176 aa, Artificial Sequence; identical to SEQ ID NO: 3706
  Synthetic

SEQ ID NO: 3708 - protein, 176 aa, Artificial Sequence
  Synthetic
DDAETVIERDRKLADEVAKELKRLIEETRDLARRIREELRRLIEELKTLAKRAKDEVRGDEVVEKVKKELDEILKTIEDLVREVKRELDESNERAKELVRRIKKRNDDTVKEVQGTDRDVVRELREIARKINEDLDDLLRKHNEIVEKIKRDLDRLLEEARKILEEIKRELDETKK

SEQ ID NO: 3709 - protein, 176 aa, Artificial Sequence; identical to SEQ ID NO: 3708
  Synthetic

SEQ ID NO: 3710 - protein, 178 aa, Artificial Sequence
  Synthetic
DEEERLRDSVRRSRELIKEIRKRLEESIRRSERINERVREELRRSVRESERSAEEARRRGDLREELLKELEEVNKALEDMLRKNEKKSEDVNEDLRRRIKELEEELERVNDTVRKLIERNRDTETVLEEHKERVKRILDRARDLLRKHRELVEDSRRHLEKLLRDHRKVVKEIEDKIR

SEQ ID NO: 3711 - protein, 178 aa, Artificial Sequence; identical to SEQ ID NO: 3710
  Synthetic

SEQ ID NO: 3712 - protein, 178 aa, Artificial Sequence
  Synthetic
SEEERLRESLERSRKRLEEVKRELERKLEEWEEIVEESRRRAEKSLRESKERIDDLKRRGELREKLEEDLKEVNKEIREMIKRSKDEVERKIREVERRAKRLAEKLEELNKKMKDLADNNRDTEEVLRRHEKVVRRIDEELEELLEELERVIREDTERNKKLLDEHREVVKEIEERVR

SEQ ID NO: 3713 - protein, 178 aa, Artificial Sequence; identical to SEQ ID NO: 3712
  Synthetic

SEQ ID NO: 3714 - protein, 178 aa, Artificial Sequence
  Synthetic
SSEKRLRDSVRESRDRARKIEEDHRRLVEEWERLVKRSEEEVRKSVEESREEVEKAKKEGRLREELRKELEDVNEKLKKDIKRSKEEVKKVIDRSRESVKTLLDRLEKMNRDLEELLRNNSDTDKVLEDHKRLVEKILKEAEDNLRRSRKMIREDEERNRDLLRRHREVVKEVKRKVD

SEQ ID NO: 3715 - protein, 178 aa, Artificial Sequence; identical to SEQ ID NO: 3714
  Synthetic

SEQ ID NO: 3716 - protein, 178 aa, Artificial Sequence
  Synthetic
DKEERLRESLEKSDRDIRRIKEELERLLREWEKRVRDSEKELRDVLRKVTEEAKELKKQGKLREKLLKELDDVRKRVEKVMRKSKEDVKRVIEEVKRRADELKRRLEKVNRDVEEALKRNVDTDDLLRRHKEVVEKILREIEELLRELREAIRRDKKRNDELLKRLAEVAEKIREDVR

SEQ ID NO: 3717 - protein, 178 aa, Artificial Sequence; identical to SEQ ID NO: 3716
  Synthetic

SEQ ID NO: 3718 - protein, 178 aa, Artificial Sequence
  Synthetic
SEKETLERSIRESERILEEVLRELKKVLDEWRRRVEESEKRHRDLIEEVRRRAKKLREDGKLREDLLRELERILRESRESVDKSKKEVEEVIKRVEDKAREIAERLKRMNDEVREAADKNVDTDDLLRRHKELVEEIKELLERLLRELEEVIKRDKDKNDENLTRSKRLIEEIEERVR

SEQ ID NO: 3719 - protein, 178 aa, Artificial Sequence; identical to SEQ ID NO: 3718
  Synthetic

SEQ ID NO: 3720 - protein, 178 aa, Artificial Sequence
  Synthetic
DSEERLKESVKRSEDDLKRLRDEHRKLVEEWRRRIDESERRHRKLIEDVRRRLTEFRKRGDLREELEKRITEAERRSKESVEESRREAEEVIRRSERSVDKLAEELREVNKRLEEAARRNVDTDRLVEEHKKMVKEIRDRVKANLERSRRMIKRDKEKNDDNLRRSKELIDKLEEDVR

SEQ ID NO: 3721 - protein, 178 aa, Artificial Sequence; identical to SEQ ID NO: 3720
  Synthetic

SEQ ID NO: 3722 - protein, 178 aa, Artificial Sequence
  Synthetic
SKEERLRESSRRSEKAVREVEKRHKESVERSKEEIRRLAEELRKSIEDSERRIKEIRERGKARDELLEELRRVNDEVRDRLRRLKERLEEVNKESKDSVDDLKRKLREVNERAKELITRNVDTDRLLEEHRKLVERILEELEKNLERHRRVVKEILDRVKELLDEHRRRVEEIERKIE

SEQ ID NO: 3723 - protein, 178 aa, Artificial Sequence; identical to SEQ ID NO: 3722
  Synthetic

SEQ ID NO: 3724 - protein, 178 aa, Artificial Sequence
  Synthetic
SKEETLKRSSEESKKELKRVDEELEKIIREWEEDVKRSEKELEEVIERAKREAEKLRTRGELREELKRELERVLRDVRRRVEDSKRDVKRELDKLKKDLDAIRRELEKLNKEVEEAMKRNVDTDTLLERHKRLVEEVREKLERLLRRLRKVIKEDRERNKRLIKRLKEVIDEIRERVR

SEQ ID NO: 3725 - protein, 178 aa, Artificial Sequence; identical to SEQ ID NO: 3724
  Synthetic

SEQ ID NO: 3726 - protein, 178 aa, Artificial Sequence
  Synthetic
SERERLEDSSRKSKERLERIARTLEKLLRDWRREVEKSEKRHRELVEKVRRDLDDLRRRGKVREELERKLEELIKESEKSVKRSKDEVEKVIREMEEELKRLVEELERVNTEVREAAERNVDTEKLLRDHKRLVDDLDRRAKELLEELKRVIDEDKKRNEKNLTDSRRLVEELKEEVR

SEQ ID NO: 3727 - protein, 178 aa, Artificial Sequence; identical to SEQ ID NO: 3726
  Synthetic

SEQ ID NO: 3728 - protein, 178 aa, Artificial Sequence
  Synthetic
SSKERLEESSERSERSIERIDREHERSSEESERRLKKMVDDLRRSSEKSKDDLEKLKREGKVREDLERELREVNKELERLARELAEKLRKVNKDSKESVRELEERLRDANRRLEELLRRNVDTDELVERHKRVVEEIEERAERNLRRHKKVVEDILREARKVLEDHKELVERLKERVE

SEQ ID NO: 3729 - protein, 178 aa, Artificial Sequence; identical to SEQ ID NO: 3728
  Synthetic

SEQ ID NO: 3730 - protein, 178 aa, Artificial Sequence
  Synthetic
DAERRLKKSSEDSKRAIDELRKEHEDSSRESKERLDKIKRDHEELVRRARERAEELRRRGKLREELVKELEKAIEESERNVEKLARDLERANEESRRSVEELVKELEEANRRLEELLARNVDAEKLVTDHKRVVETILDKARKNLDRHRRAVEDLLRKARENLKKTEELVRKLDEDVR

SEQ ID NO: 3731 - protein, 178 aa, Artificial Sequence; identical to SEQ ID NO: 3730
  Synthetic

SEQ ID NO: 3732 - protein, 178 aa, Artificial Sequence
  Synthetic
DAERRLREILRRVTERLKEVKERHKRSSEKSKKSADDVRREHEKLAEELRRKVEELKRRGELREELEKEVEDLLRESEESVRRLEEELKEINERSKRSVDKLERELEEVRRTVEDLIKRNVDTDTVIEELKRRIRELEKRLEENLRRHEELVRRIEEELKRNLKRSRDLLKEIEDKVR

SEQ ID NO: 3733 - protein, 178 aa, Artificial Sequence; identical to SEQ ID NO: 3732
  Synthetic

SEQ ID NO: 3734 - protein, 182 aa, Artificial Sequence
  Synthetic
SEAEEVLRRLEELAKRDREENKKVLDDLEKLVREDEERNKEVLKDLEKFIDELDKELRSEGREVVEELEKKLREVVRRVRKKAEDSHRRLEEIVERVKRLLDESSKKVREIVERVKKEVKDLDKDVVRELERLLREWERDNERSREEIDRVIEEARKRNEDSERELDRLIKEVKDRLDEKAR

SEQ ID NO: 3735 - protein, 182 aa, Artificial Sequence; identical to SEQ ID NO: 3734
  Synthetic

SEQ ID NO: 3736 - protein, 182 aa, Artificial Sequence
  Synthetic
SDAEDVLRKLKELIDRDTKENDEVLRKHKRLTDEDRRKNEEVVRELRKIITRLDEKLRAEGKELVDEVAKEVDKVVKDVERLLDESHEENKEVNRDLKRLLDESSKKVEKIIREVEEEARRLDKEVLDRIRDLLRRWRERNEESRRRAEKSIRDSDETNKRSREEIKRIIRKLREILKERKR

SEQ ID NO: 3737 - protein, 182 aa, Artificial Sequence; identical to SEQ ID NO: 3736
  Synthetic

SEQ ID NO: 3738 - protein, 182 aa, Artificial Sequence
  Synthetic
SDVEKVLRELEELIDRDRRDVEKVIEELRKLIKEDEEENREVLKRAEKMLREIREKLRNSGKEFLDELKRELEKVVEEVERLVKRSHDKLRKIERDVEEVAKRSTEDVKRVVDDVERKAKDIDEKFLRDIRETLKRWKERNEELTRRLREIIREVEERNEESKRRLDELIREAEEDMRRRRT

SEQ ID NO: 3739 - protein, 182 aa, Artificial Sequence; identical to SEQ ID NO: 3738
  Synthetic

SEQ ID NO: 3740 - protein, 182 aa, Artificial Sequence
  Synthetic
SEAERVLEDLKRLIDEDRKKLREILEDHKRLTDEDRERNRRVLEELDKIIKELDERLRSEGRELLKKVREELDRVVRRVEDMVRRSHETNKEVNERLKRLLRESTEDVKRIVREVRERARKLDKDVLDKIEKSLRDWERDNERMVKEADRSVKRSDETNEKSREDLERLIEEARRRLKERER

SEQ ID NO: 3741 - protein, 182 aa, Artificial Sequence; identical to SEQ ID NO: 3740
  Synthetic

SEQ ID NO: 3742 - protein, 182 aa, Artificial Sequence
  Synthetic
SEVERVLEELEELARRDEEKNKRVEDRLRKLIEDDRRDLRRILERLREIAERLKEEAESEGKEVLDEVRKKVEDVIREVEKLLRESTKRLEDVKREVEELLKRSREEVEEIRERVERKVKDIDEEFVRRIRDLLRRWKEEVDRSEDRIRRELEKWERENEEAEKRIRKIIEDLRREIKKKAD

SEQ ID NO: 3743 - protein, 182 aa, Artificial Sequence; identical to SEQ ID NO: 3742
  Synthetic

SEQ ID NO: 3744 - protein, 182 aa, Artificial Sequence
  Synthetic
SKLERVLEELERLIREDEDENKKILDRLKKLIDEDKKENDEIMETLKEIARKLTEELRSEGEELLEEVKKRADKAVEDVKRLLEESRRKVEKIVREVRKLLEDSNRKLEEIIKRVEEELKEADEEVLRRIRELIKEVRRRNDESRERIERLLKEWRERVDASERTIREIIKEIKERVRRARK

SEQ ID NO: 3745 - protein, 182 aa, Artificial Sequence; identical to SEQ ID NO: 3744
  Synthetic

SEQ ID NO: 3746 - protein, 182 aa, Artificial Sequence
  Synthetic
SKAEDVLRKLKELIDRDRDENRKVLDELRRLIERDREKNRRIMEKLKKIVRELEEALKVDGKELVKKVEEELRRVVEEVKKLLKESTDELDKIVRDVEELLKRSEEKVEDIERKVREEARELREDVLKRIEDELERWKEEVERSKREIEKLIKEARDENDKSRKTIEKIIREAEKILRDRDR

SEQ ID NO: 3747 - protein, 182 aa, Artificial Sequence; identical to SEQ ID NO: 3746
  Synthetic

SEQ ID NO: 3748 - protein, 182 aa, Artificial Sequence
  Synthetic
SEAERVLEELKELIERDEEENRRILEEHKRLTEEDLRENREVMKRLEDIIRELEEKLRTEGKEELDEVKKEAEEVAKEVKRLLEESTEKNKEVNERLKRLLDESNKKLREIVKKVREDARRLSEKVLTDIERLIREAEKRNRDSKREAEKSVKKSDELNERSRRRIEKIIEELRRLVDTRRT

SEQ ID NO: 3749 - protein, 182 aa, Artificial Sequence; identical to SEQ ID NO: 3748
  Synthetic

SEQ ID NO: 3750 - protein, 182 aa, Artificial Sequence
  Synthetic
SDVEKFLDELRELIRRSKERVDRMLRKLEELIRRSSEDVERLLKELKELIDDIRRLLDENREKREDIRRLVEELRKRVEDIIRKMEESNKRLRDEVEKIIRELEKLNEEVARVIKKAEDDIRGDELRERIKRLLEEHHKRLREAVEELRKLVEDATEEHERLSERAKRLVEEVKKRVDERER

SEQ ID NO: 3751 - protein, 182 aa, Artificial Sequence; identical to SEQ ID NO: 3750
  Synthetic

SEQ ID NO: 3752 - protein, 182 aa, Artificial Sequence
  Synthetic
DEVEKVLRDLEELIRRSETDIRRLLEELKKLIDDTRREVKKVLDDLRRRIKEVLDRIRRNPEKREEIERLVRELKRKVEEIEKRLERLNEEVERKIREIIRRIRETNKTLRKKVRELEKRLRGDEARERLKDTVTKASRRHEKVERDLEKLLEEHHRAIEKLRKELRDLVRKAKEDIDRARK

SEQ ID NO: 3753 - protein, 182 aa, Artificial Sequence; identical to SEQ ID NO: 3752
  Synthetic

SEQ ID NO: 3754 - protein, 182 aa, Artificial Sequence
  Synthetic
DEAEKVRREHRELVEDSLRKAEEALKRLDELIKRTEKRVKDVEEELKRLIKRVLDEVRKNREKREDIRRLVKELRDKVREIEDEMRKMNEEVRREVKKVEDDLRRTNRELHEKVKDVERKLKGDEVKRRLRTSDKKVSEKHKELLDRLRELLRRHHESLKRLEERIRKLVTDATRRIEEEEK

SEQ ID NO: 3755 - protein, 182 aa, Artificial Sequence; identical to SEQ ID NO: 3754
  Synthetic

SEQ ID NO: 3756 - protein, 182 aa, Artificial Sequence
  Synthetic
DEVEELLKEHRELVKESKKTVEKMLRELEELIKRTRDEVEKVERTHEELVRRVDEVLKRRREVAEDIERLLREIHKFVEDVKEKIKKLNEDVAKVLREITEDIKRTNKELHDVVERVTRRIEGDELKERLKESDKEASDLHEKAREDLERLLKKHHDDLRKIMERLERSDKEAKKRLEEEKT

SEQ ID NO: 3757 - protein, 182 aa, Artificial Sequence; identical to SEQ ID NO: 3756
  Synthetic

SEQ ID NO: 3758 - protein, 182 aa, Artificial Sequence
  Synthetic
DEVEKLLKELEDLRRKTREDLERVKKELEELVKRSKDRLREAEDELRRLVEDIERVIREDREAREDIRRLVEELKKKVDDIRRTLEESNEELRRKVERIIRELERANRDVREKVKEVERRIKGDELKKRIRELVKEHTDELRKVKRELEALVEKATEDHERVLRRLEELVERIKREVDKAEK

SEQ ID NO: 3759 - protein, 182 aa, Artificial Sequence; identical to SEQ ID NO: 3758
  Synthetic

SEQ ID NO: 3760 - protein, 182 aa, Artificial Sequence
  Synthetic
SDAEDLLREHRELVERSKREVERVLDELRRLIEKSLREVEKVLKELEKLIREILDRVRKNSEKEEEIERLERELEKIVEEIERRIETSNRELKRIVKEIIDEIRRTNKELHDKVRDVERKLRGDRVREELRRSDEKVSRDHEELVKEAERLVDEATKEHRKLKRRIRELVRRAKEEIEKLRK

SEQ ID NO: 3761 - protein, 182 aa, Artificial Sequence; identical to SEQ ID NO: 3760
  Synthetic

SEQ ID NO: 3762 - protein, 182 aa, Artificial Sequence
  Synthetic
SKVEDILRRHRELVKKSLDEIRDLLRKLKRLIEESLRRVEEVLRDHERLVREIEDRVRKNREKREELRKLLEDLHRKLEEVEREIRESNKKLAEEVRKIEETIRKTNKELHDTLRDAERKIEGDELKRRLRESDKRVSERHKRATEEIKKLLDRATEEHKKLVKRLRDSDKRVADELDKAEK

SEQ ID NO: 3763 - protein, 182 aa, Artificial Sequence; identical to SEQ ID NO: 3762
  Synthetic

SEQ ID NO: 3764 - protein, 182 aa, Artificial Sequence
  Synthetic
DDVDRVRKEHEKLVRDSLDTARKLLEELEDLIRRDKEDVERVLEELKRLIEEIDDRVRRNREKREELRELLKELEKRVRDIVKKNEESVDELRKKVEDIIRRLAETNKRLHDRLRDVERKLRGDELIERLRRSDKRASEEHKRLMDEAKRLVEKAEKDVTELNKDIKRLVKEVEDRLREAER

SEQ ID NO: 3765 - protein, 182 aa, Artificial Sequence; identical to SEQ ID NO: 3764
  Synthetic

SEQ ID NO: 3766 - protein, 178 aa, Artificial Sequence
  Synthetic
DEVKKVLDESRELVDRIRRKAKEVDDRDRKLIRDVLEELKKLLEENRKLVEDIRRLLEAGVSEDELRRLLEESRELIKRVKERLDDALRRLEESSKTWKEELDRLLEENEELIRRAEEAGVDKETLRRLHEETERILRDLKRHNDELNDEARKRLKEVKERLDESHDRVRRELEAKER

SEQ ID NO: 3767 - protein, 178 aa, Artificial Sequence; identical to SEQ ID NO: 3766
  Synthetic

SEQ ID NO: 3768 - protein, 178 aa, Artificial Sequence
  Synthetic
KDVEEILRKLKELIDEARRRLEKTLRDHEDIVRRAKRRLEELLKRHRDIMDEVRRKVRTKELLDTVREDSKRVVKEAREILEELKRISEKVVEEHKRLSEELKRRLDKILEELERRGVPEEARRRLEEEVRKVRKEIEDVNRRLEKSHKEAEETLRRVEEELKKSHDELERILREIER

SEQ ID NO: 3769 - protein, 178 aa, Artificial Sequence; identical to SEQ ID NO: 3768
  Synthetic

SEQ ID NO: 3770 - protein, 178 aa, Artificial Sequence
  Synthetic
DDVEEILRTLRELIKKIKKDLKKVLDDHERIARRAKEELERILRRHREIVERVDRKVRTEEVATRVAETSKRVVDDARRILKRIAEISREVVEDLKRILKEAAEALRELLRRLEEAGIPDEARKKIEDIVREVEDDLRRVAKAAEDSNRKLEKDLREVAERLRKSHEEAEKALRDREK

SEQ ID NO: 3771 - protein, 178 aa, Artificial Sequence; identical to SEQ ID NO: 3770
  Synthetic

SEQ ID NO: 3772 - protein, 178 aa, Artificial Sequence
  Synthetic
DDVRRLEEELRRLMEEAERRLRKTLEDHKRIVEEAKRRLEEILREHKRILEEIDKRVRTEEVLDEVLRESKRVVDDARRILKELKETSERVEERHRRLSKELKKLLDEILERLARRGAPEELKKRVEDLVREIRRRLDKVNEDLERSNRELEKVLRDVLRELKKSHDDLERSLRETRR

SEQ ID NO: 3773 - protein, 178 aa, Artificial Sequence; identical to SEQ ID NO: 3772
  Synthetic

SEQ ID NO: 3774 - protein, 178 aa, Artificial Sequence
  Synthetic
DEAEKILDELRRLIDEIRRRLRKTLEEHKRILERIRRELEKMLEEHRRIVDEMRRKLRTEELIKEAEDRSREILRRVKEIVDRVREESRDVVRRHEELSRELKKLLDEILERLKKTGLPEEVTRRLEKLVRDVDRDIKRVNKELEKSNRELEKDLRAVEKRLEDSNRDARKKLEDTRR

SEQ ID NO: 3775 - protein, 178 aa, Artificial Sequence; identical to SEQ ID NO: 3774
  Synthetic

SEQ ID NO: 3776 - protein, 178 aa, Artificial Sequence
  Synthetic
DDAERILEELKRLMEEVEKRLKDTLDTHREIARRILERARESLKRHEDIAREIERDVRTEELLKRVLEDSERVVRDHERLSREVAKDSKRVLKEHEELSRRVARRLEDILRKLEERGVPEDVKRKIRELVERAKKRLKEINDELKKSDEDLDRKLEDLNRRLEESNEELKRRLDETRR

SEQ ID NO: 3777 - protein, 178 aa, Artificial Sequence; identical to SEQ ID NO: 3776
  Synthetic

SEQ ID NO: 3778 - protein, 178 aa, Artificial Sequence
  Synthetic
SDAEKLLEDIRKLTEDVERDLRRSLEELKDLIRRLKKEIEDLLERHKRIVDKVVREVRTEEVLREVKKESDKVLKELEELVDRIKKRLDELLKRHRELSEEIKRRLRELLKRLRDRGVPEEVKERVERLVREVEKRLDEVDKELEEEVDKARKELEKLLEDIDRSDKEARKRLEDKRR

SEQ ID NO: 3779 - protein, 178 aa, Artificial Sequence; identical to SEQ ID NO: 3778
  Synthetic

SEQ ID NO: 3780 - protein, 174 aa, Artificial Sequence
  Synthetic
SKEDEIRRLIEDLERRNKEVEETLRELVRETRERIERIKRRLEELIKKSKDEVDDARRKGKVKEELEKKVREIVDESRRLLERLEERVREAVEESERLVERDKEDSRRIKKEIEDIPGSEELLERLERLIDKSRKNVEDIVKRHEDLSRELTERAKAILERHKELTDELREDVR

SEQ ID NO: 3781 - protein, 174 aa, Artificial Sequence; identical to SEQ ID NO: 3780
  Synthetic

SEQ ID NO: 3782 - protein, 174 aa, Artificial Sequence
  Synthetic
SEEERIERLIDELRRDNDEVRKRLDKLVKDTERENEEAERRLRRLIEESRREVEKLKAEGKVKEELERDVERIVKESEDLLRESHKEVEEMVRKSRELVEDDKRRSDEVVERVERIKADEELARELEKLIEDSRRNVKRIKEEHEELSRRNRKLLEDILERHRRLTEELRKKVK

SEQ ID NO: 3783 - protein, 174 aa, Artificial Sequence; identical to SEQ ID NO: 3782
  Synthetic

SEQ ID NO: 3784 - protein, 174 aa, Artificial Sequence
  Synthetic
SKEREIEELIKELEEEVERLKEELRRIIKKLRDDNKRAEEELERLIRESKEDLDRARKEGKVKEEIEKKLRRIIEESERLVEEDKKKSEEIVKRIEELVKKLEKKVRDVAERVRRIPAAEELRKELEDVRRKLKEEIDRILEEAKRVVDDSRRNAEEITRRHKEATKRLREEVE

SEQ ID NO: 3785 - protein, 174 aa, Artificial Sequence; identical to SEQ ID NO: 3784
  Synthetic

SEQ ID NO: 3786 - protein, 186 aa, Artificial Sequence
  Synthetic
SIAERLKELIDRMREDNERAAKELRELIRKAKEESKEVEERLRRRLKELRDRVEELVRRNSEGDKKVREIRKKLEEIIEEIERLLRENEKLVREIEKRIKELIDRDRKRSKEIEDRIRDLIRKLKDLKEMLDRILEELKKLIKESRENLRRILEDLKRLLDESRRHAERITRRLEELIKELKEKAD

SEQ ID NO: 3787 - protein, 186 aa, Artificial Sequence; identical to SEQ ID NO: 3786
  Synthetic

SEQ ID NO: 3788 - protein, 186 aa, Artificial Sequence
  Synthetic
KARERLKRLIEEAKRRNEEMEKELDRRLDELRRESKTLEEDLRRSLEELEERIRRLVKRNSEGSEKIERLKRLVEEIKRRVERAIEENKELVRRIIERIKRLIKENRKLSEDIERRIDDLIRKLKDLREMVEEILRELRKLVEDSLEVLERILDDLRRLIEESRKHLEEVKRRLEELKKRLEDEAR

SEQ ID NO: 3789 - protein, 186 aa, Artificial Sequence; identical to SEQ ID NO: 3788
  Synthetic

SEQ ID NO: 3790 - protein, 178 aa, Artificial Sequence
  Synthetic
KEVEKILEEIERLIREIDREVKRVKTENEKTVRDIRKRVEEIKEEHKDLTRKLEKLARDGVPEERLREVLKRIEDRTREVIEELRELLRRDEKKVRDMIRKLKDLVKKIEDRVRKVELSDEARKRAEDLLRDAKRRVDEVVEELKKTVEELKEEVRKVEEELKELVKRSEDKVRETER

SEQ ID NO: 3791 - protein, 178 aa, Artificial Sequence; identical to SEQ ID NO: 3790
  Synthetic

SEQ ID NO: 3792 - protein, 182 aa, Artificial Sequence
  Synthetic
SEVDKVLKEHEDLVREDKKRLEEILRELKDRLRRDEEELRRIMEELEELLRRLKDVVDKRREDRETLRRLLEELRKKVEEVKRRNDRSVRELEKVVRKVVKENEDSLREVHKRLRDVEKDLRKKEMIDRLRRSDEELKKEADRANEEAKRIVEKIRDTLKKANDKLDEIVERIEDELRRAET

SEQ ID NO: 3793 - protein, 182 aa, Artificial Sequence; identical to SEQ ID NO: 3792
  Synthetic

SEQ ID NO: 3794 - protein, 182 aa, Artificial Sequence
  Synthetic
KEAEDVEEEHKRLVEDDRRKLEEIKKTLERLVEEDRRRLEEVVRELKRLLDEITDVLTKRREVEKDLEKLLEELERLVKKVVDENKKSVETLTRTVEKVSRDNKRTLKEVHDRLRDVERKIKDDEVRKRLRKSDKELRDEAREVNKELEAIVKRARDEVKKVNDDLRKIVDEVRETVKEARR

SEQ ID NO: 3795 - protein, 182 aa, Artificial Sequence; identical to SEQ ID NO: 3794
  Synthetic

SEQ ID NO: 3796 - protein, 182 aa, Artificial Sequence
  Synthetic
DEVREVKKRLRDLIRDDERELRRVLEELKELVKDDVDKLRRLIEKLRKLLEELRRVATKRREVREELRKLLKELRDEVRKASEENRESVERLERRVREISERNKKSLKELRDVVEDVTRKLRDEKAREELKRIVEEVEEKSRRANKKLKDIVDEMRERVKRANEELDDIVKKITEDLERMRK

SEQ ID NO: 3797 - protein, 182 aa, Artificial Sequence; identical to SEQ ID NO: 3796
  Synthetic

SEQ ID NO: 3798 - protein, 182 aa, Artificial Sequence
  Synthetic
REVDEVRKEHERLVKEDEDKLRKIIEDLKKLLREDEKRLREALKRHRELVEEARDVVRKRKEDRERLRKILEDLHRMVRKVSKDNKKSVEDLEREVRRVSTENKKSLEDIHRMLKDVAEKLRSDKVKKELEESDRRVEEKSRRANETLKRIVEEIRKKAEEINRRLKESDDRAAEDIKRVEK

SEQ ID NO: 3799 - protein, 182 aa, Artificial Sequence; identical to SEQ ID NO: 3798
  Synthetic

SEQ ID NO: 3800 - protein, 182 aa, Artificial Sequence
  Synthetic
DEARRVKEELDKLRREDEELLRRLMEKLKDLIRRDTEELKRIIDELRELVERLEDELRRRREDRERLRELLRRLEDRVRRVSDKNRKSLEDLERVVEEVSRENEKTVRRLEKKVKEVEKDLKDEKVREELRRIVDRVKKEVDRANRELEDIRREVEEISKRANEELERIVTEAADRLRKVAE

SEQ ID NO: 3801 - protein, 182 aa, Artificial Sequence; identical to SEQ ID NO: 3800
  Synthetic

SEQ ID NO: 3802 - protein, 182 aa, Artificial Sequence
  Synthetic
SEAEKVIREHERLLEEDRRRLEEALRTLERLAERDEERLKEAEERHRDLLRKLEETVKKRREVREKLRKILEEIHRTVKKVSEDNEKSLRELKEKVDRISRDNEETLERAHRRLRRVEERLEKDEVKRRLRKSDEDVKRRAEEINKEAKEIVDDVKKKSDEANKRLKDSDKRVAERLKEAED

SEQ ID NO: 3803 - protein, 182 aa, Artificial Sequence; identical to SEQ ID NO: 3802
  Synthetic

SEQ ID NO: 3804 - protein, 182 aa, Artificial Sequence
  Synthetic
SEVEKVIEDHDRLLKRDEELLRKIAEDLKDLVRRDEERLRRATEKLKRLLETLEDVLRKRREVREDLRRLLKELKEAVKRISTENKKSLDKLREDVERVSRANEKSLRDAHRKLKDVEDKIKDKEVKDKLRRSDERVEKRSRDANRELEEIVRRARKKSEEANRRLEEIVERAEKRLKEAED

SEQ ID NO: 3805 - protein, 182 aa, Artificial Sequence; identical to SEQ ID NO: 3804
  Synthetic

SEQ ID NO: 3806 - protein, 181 aa, Artificial Sequence
  Synthetic
SEVDKVVEESKTSMRRLERRHREATKESKKSIEEIEETVERVKRESEKSVKKLDDLVKNGSDKSALERALEENRRLIEEIKRTLDRLLETNKRLIEEISRESKELLEENKELIERIEKDVKDEEVRRRLRKIHKELEERLRRMNKRLRELHRELEEKVKEVKKELEDIHRKARERVEKAKE

SEQ ID NO: 3807 - protein, 181 aa, Artificial Sequence; identical to SEQ ID NO: 3806
  Synthetic

SEQ ID NO: 3808 - protein, 181 aa, Artificial Sequence
  Synthetic
EELKEVRERSKESIKRIKEEHERVEEELKDIKRDIDRRHKEVVDESRESVKRVEDLSRADVDEEELRKLLERNKELIDRASEESKRMLEDLERVVREASEKSKRLLEENKKLIDDIERRVKDEEVRRELREIHDELRKRVEEANKRLEDILREIDKRLKELNEELKRIHDRARERLEEERR

SEQ ID NO: 3809 - protein, 181 aa, Artificial Sequence; identical to SEQ ID NO: 3808
  Synthetic

SEQ ID NO: 3810 - protein, 181 aa, Artificial Sequence
  Synthetic
DEIREVIKESKKSVEDVKRRHEEAKRESERSLKEIRELAEEVKERLRDLLRRIRKLVKDGVDEKTLEELLRRIEELLKRIKDRLDEMLERNRELIKKISDDSERLLRDNERLIRDIERKVKDEEVRRRLRKIHKEAEERLRRANDELRKLHEEIKKTVEKIKRELDKIVEEIERDVRRDRK

SEQ ID NO: 3811 - protein, 181 aa, Artificial Sequence; identical to SEQ ID NO: 3810
  Synthetic

SEQ ID NO: 3812 - protein, 181 aa, Artificial Sequence
  Synthetic
SRVEEILRDSKRSMDEARKEHERVLRELRDRLRRLDERHRRLLEELKRLLREVRELTRAKVSERELREALKTIRELLRKISEESKRLLEEIEEVLKRISDTSKRLLEENKKLIDDARREVKNEEVLRRLDDIHRRIKRELKEVNDRLEEIVREIRKRLKEVNERLKEIVDAVEEVVRRAEK

SEQ ID NO: 3813 - protein, 181 aa, Artificial Sequence; identical to SEQ ID NO: 3812
  Synthetic

SEQ ID NO: 3814 - protein, 181 aa, Artificial Sequence
  Synthetic
KRLEDVARESKKSIDEIRKRHKEATDESNKSIEEARRIHEEVLRTLKELLDRVRKLIESGVSERALDEALRTIKELLERISRTSEELLRRNRELIERISKESKELLDTNRKLIEDIEREVDEEEVRRDLRRIHERLREEAEEVNERLERNHEELEREARKVNEELRKIVEDARREVERAKD

SEQ ID NO: 3815 - protein, 181 aa, Artificial Sequence; identical to SEQ ID NO: 3814
  Synthetic

SEQ ID NO: 3816 - protein, 181 aa, Artificial Sequence
  Synthetic
DDVEEIKRRLEELLERLKEDHKRMLEESRKSVEDAEKIVEEVKKESEDSIREIKKLLKDGVDEDTLRELLDRNRRLIERIKEDLDRLLKENRELIKKISERSEKLLREIRKVVKEAKDRVKDEKVKRELDEIVKRIEDEARKVNEELKRIHDDAERKVRKVKEDLERIHRELKKRVEDDRT

SEQ ID NO: 3817 - protein, 181 aa, Artificial Sequence; identical to SEQ ID NO: 3816
  Synthetic

SEQ ID NO: 3818 - protein, 181 aa, Artificial Sequence
  Synthetic
KEDERVEEELRKLLKELEDRHKKASEDSRDSIRRIRERARTVLEELKRVLEDIDRLIKADVREEELKRALEELEKLVREIKKELDDLLDKNRKLIEKISKESRELLEKIERVLEDIRRRVKDEEVKRRLDKIVDDVRERLKEMNDRLRRLHEELKRELERIKEELDKILEEVKRRLEEARR

SEQ ID NO: 3819 - protein, 181 aa, Artificial Sequence; identical to SEQ ID NO: 3818
  Synthetic

SEQ ID NO: 3820 - protein, 178 aa, Artificial Sequence
  Synthetic
ELEERLTRSNDELRKELKRMNEELRRKLEEIRKELERLNEKLREIIERIKEDLDRRARDKDKVKRVTDELRELLKRAHDISRELLKTLEKLIREIHKLSKELLEESDRLLDEARKKVKGRELAEEFLRRHKELVERIREIHERLRERLEELLRRIEELHKRLEDELREVLKRIEDEIR

SEQ ID NO: 3821 - protein, 178 aa, Artificial Sequence; identical to SEQ ID NO: 3820
  Synthetic

SEQ ID NO: 3822 - protein, 178 aa, Artificial Sequence
  Synthetic
KKEEDLDESNKRARDELKEMNDRLRKIVKEIEDELRRLNEEARRSNEELRRRVEERLKDKETADRVLKESEDLLRTIHKLSRDLLKELEDLLREINKRSRELLEESDRLIDRIRKEVKGDELAKKVIKEHEDLVREVLKRHEDLLRRARELLKKIKEIHDRLLDEHRKLVEDIEREAT

SEQ ID NO: 3823 - protein, 178 aa, Artificial Sequence; identical to SEQ ID NO: 3822
  Synthetic

SEQ ID NO: 3824 - protein, 178 aa, Artificial Sequence
  Synthetic
DRERELEKSNRELERELREALKRVKEIIDRIRKTLEDMNRRLKRSNEEAERRLREKARDKDKVDKIVTESKKLVEDIHRTSRELVRELEKLLREMERILRELKRRSEKLIKEIRDKVRGDELAERVIREHRRLAEEIRRLIEKLKREIEELLERARRTHEDLLRKHKELVKKVDEEIR

SEQ ID NO: 3825 - protein, 178 aa, Artificial Sequence; identical to SEQ ID NO: 3824
  Synthetic

SEQ ID NO: 3826 - protein, 178 aa, Artificial Sequence
  Synthetic
DDEEEVKRSNDELRKEIKEAEERLEKSNRELEEDLRRMNRELEESNKRLRELLEREARDEEKVRRVIRESERLVEEIHKRSKELEERSRELIKRIRDELRKLIERSDRLLKDVKDKVRGKELAEDMLRRHRDLVREIRELIDKLTRDHDRLVKEAREIHKRLTERHRKLVEDIKRETD

SEQ ID NO: 3827 - protein, 178 aa, Artificial Sequence; identical to SEQ ID NO: 3826
  Synthetic

SEQ ID NO: 3828 - protein, 178 aa, Artificial Sequence
  Synthetic
SKEEELEKSNRKLKEDLERMNEDLKRILREVEDVLRRIEEELEKLVRELEEILKRRVKDEDKVREMVKRAKDLLDEVREVLKRLRDRLEELIRRIHERSKDLLRESKRLIDEIRRKVRGDELAEEVIDRHRDLVRRIKDEHRKLTDELRKLLEDIERLAEEAKRKLEKLIEDVEREAN

SEQ ID NO: 3829 - protein, 178 aa, Artificial Sequence; identical to SEQ ID NO: 3828
  Synthetic

SEQ ID NO: 3830 - protein, 175 aa, Artificial Sequence
  Synthetic
SSEERVKKVVEELEDLIRKIREEHKDSIRENRKVVEDIRERVKELITELKKELEDKLKDDKDIVREVEKILKEVKEALDRVAEENEEVDRRSEESLRRIEEKVRRAIRTVEELVRRNVDTEDLLRRLRKLIEDVFREARENLKRHKKMSKEAKEKLEELLKRLRDLIKEAREKIK

SEQ ID NO: 3831 - protein, 175 aa, Artificial Sequence; identical to SEQ ID NO: 3830
  Synthetic

SEQ ID NO: 3832 - protein, 182 aa, Artificial Sequence
  Synthetic
SEADEVLRTHEELVRELEERAKEILRRHRKLSEESERKAREVLKTLRDLIRELKKLADEGSRRREDLSRRAERIKEEITRVVEELERENRRIDEELKKLVKELEDRMKEINDRLRELLKRDKDEEIARRIEESEDKSRRIIDEVRERVRKSIEENKRVVEEVRERVERLIKELDKIVEDIRR

SEQ ID NO: 3833 - protein, 182 aa, Artificial Sequence; identical to SEQ ID NO: 3832
  Synthetic

SEQ ID NO: 3834 - protein, 181 aa, Artificial Sequence
  Synthetic
DELEKVIEELKRRIEEVKKELTELNKELKDVSKEIEDVIRDLNRELKKLSDRIKELADRDNNDDLLRKLHKRLEDLHRETKERITEMLERLERLHRDTKRRIEEVLREIEKRVDEIKKKTTDEEIRRRLDEVLRKAEEDLRRAEESNDEHLRKSKEDVERARKSNDKHLDDNRKTLEEATR

SEQ ID NO: 3835 - protein, 181 aa, Artificial Sequence; identical to SEQ ID NO: 3834
  Synthetic

SEQ ID NO: 3836 - protein, 186 aa, Artificial Sequence
  Synthetic
SDVEDLLRRLRKLTKDIEERVKELNKKLEDVSRDIKRRVEEVLKKLEDVLRKARDEVRKLGDDGGAEELLKDILRRIAELLRELDETLKRVDKKIEDIVEESKELLRKVNEEVKKVVDEIRERNKDLDRAEKELRKILEDHKEISDRVRRSNEKLLRDHRRTSETVKRRLEKVLEDIRKELEDAKR

SEQ ID NO: 3837 - protein, 186 aa, Artificial Sequence; identical to SEQ ID NO: 3836
  Synthetic

SEQ ID NO: 3838 - protein, 180 aa, Artificial Sequence
  Synthetic
DVEERVKTIVDDIERTLDEVRRRLEESHKRLEDALKEVDDRLKKLLKETEEVLKRIEDERGKREELDDVRRRAEKSARDLKRLLDEIRKESRRILEELRKLLDDIRKEVREVLERLARVKEKEKVEELLRRLREILERVTRRLEEVLKRHRDLVEEVKKELERVLEDHKRLSEDAERRAR

SEQ ID NO: 3839 - protein, 180 aa, Artificial Sequence; identical to SEQ ID NO: 3838
  Synthetic

SEQ ID NO: 3840 - protein, 180 aa, Artificial Sequence
  Synthetic
SVEEALEKSVKESEEVLKKAEKELRESHEDAKRVLKEVRDELERLMEETKKELRDVERKRGRRDELERIKKRVEDSLRKLEKLLKEVKERSEDLLRKLKTLLREAKKRNDEVREELARVRDKEKVDRILKKDKDLIDRVRRELKKMLDRHRKLVEDVKRELEEALKEHKDDSKRVRDKLK

SEQ ID NO: 3841 - protein, 180 aa, Artificial Sequence; identical to SEQ ID NO: 3840
  Synthetic

SEQ ID NO: 3842 - protein, 180 aa, Artificial Sequence
  Synthetic
DIEDRLERVVRDAKRVLADVEDKLRKLLEETERMLRRVKRELERSHEEAEEELRRVEEERGRTEDLERVKRESEEVVKRVKKILDEIREKAKDSMRKLKELLKRVEERVREVLEELARVDDKKLLEDILRKLRKIIEEVKRTLEEALKRHRDLTRKVVEELEDLLRKHRRIVEEVKKRLK

SEQ ID NO: 3843 - protein, 180 aa, Artificial Sequence; identical to SEQ ID NO: 3842
  Synthetic

SEQ ID NO: 3844 - protein, 180 aa, Artificial Sequence
  Synthetic
DIEDELRKSVKRSEEVLREVEERLKRLLEETKEVLTRARETNEKSHRELEDKLRKIEEERGEDRTLDEVRRESEELLKESEKTLRELLERAKKSVKELKELLDEVRKRNKEMEERLRRVTDESKLRELLKRDKKEIDDVKRELERLLEDHKRLTEEIRRRLKRLNEKHREIVKRVEKELK

SEQ ID NO: 3845 - protein, 180 aa, Artificial Sequence; identical to SEQ ID NO: 3844
  Synthetic

SEQ ID NO: 3846 - protein, 180 aa, Artificial Sequence
  Synthetic
DVEDRLRESEKRSEKTLKDVEERLRRSHEDLEKKLREVEKRLRDSHREAEKTLKRVKEEKGERETLREAEKTSRKVLEDLKRLLDEIREESKRIVKKLKDILDEARKRNEEVREELARVDDKEVVRKILEDDKRLIEEVKKELERVLEEHRRLVEKVKRELEEVLKRHKEIVDDVRRRLE

SEQ ID NO: 3847 - protein, 180 aa, Artificial Sequence; identical to SEQ ID NO: 3846
  Synthetic

SEQ ID NO: 3848 - protein, 180 aa, Artificial Sequence
  Synthetic
SIEDELRKIADEARKVLDKVRKDVERSHREAEKKLREIDKRLKDSARDSKRVLDEVREERGEREELEKARKENEEMLEKLRDLVRKVKKESEEMVRRIRKILEEVKREVEKVLEELARVKEEEKLERILRKLKKIIKDVEDELRKLLEEHRELVKKVEKDLRDLLERDRELIEEVERRLR

SEQ ID NO: 3849 - protein, 180 aa, Artificial Sequence; identical to SEQ ID NO: 3848
  Synthetic

SEQ ID NO: 3850 - protein, 180 aa, Artificial Sequence
  Synthetic
DIEDRLRTSVKKSRDVLEEVERKLRDSHRRAKEVLDKAREDLRKSKEDSKRVLDDVRRKRGDREKLDKARRDNERVEERAREILDRVRRDSERLLKRLKDLLDEVRKRNEKVREELARVKEKEKLEDVLRRDEELIDRVRRRLERILEEHEELVKRVEEELRRVLEEDRKLIKRVKEELE

SEQ ID NO: 3851 - protein, 180 aa, Artificial Sequence; identical to SEQ ID NO: 3850
  Synthetic

SEQ ID NO: 3852 - protein, 180 aa, Artificial Sequence
  Synthetic
DIEDALRDSERESEEVLKRAREELEKSHKEVKKRLDEVEKTNKDSVDESKKVLDDVRRKRGELEKLKEATERNKRVLDTSRTILKRLLEESEEMVKRARRILDEARRRNEEVAEKLKRVTDKELLKKILKEDKELIKRVEEILRRILEEHRELVRRMKKELDELNKRDKELIDRVREELT

SEQ ID NO: 3853 - protein, 180 aa, Artificial Sequence; identical to SEQ ID NO: 3852
  Synthetic

SEQ ID NO: 3854 - protein, 180 aa, Artificial Sequence
  Synthetic
DLEEEAKKSVRESERALDEVRKRLDRVRKEVERELRKVEEDLRRSHRKLEDILRRVAEKRGPAEALERIEEDSRRVLEELKKLLDDLRRRLTELAKRLEELLRRLEEDNRRVLEEAKRVKDEEAARRILERDKALIEKAREDLKRILDEAREILKEAAKRLEDILRKHKKIVEDVARELE

SEQ ID NO: 3855 - protein, 180 aa, Artificial Sequence; identical to SEQ ID NO: 3854
  Synthetic

SEQ ID NO: 3856 - protein, 188 aa, Artificial Sequence
  Synthetic
KIEEEVEKLIRDARRIIEEMRESTERLIERNEEVLETVRREVEKLLRDLERILEKIKRELEGDERVKELLRRVEKLLREVKKRVEELERENREELRKLEERSRKLLEDVKRLADELRRRVEKMSKDNVPEEVLRRILEEIRKIVEDVRRELDTLNRELEELTKESRRRAEELLRRLKEIVKKVERDAE

SEQ ID NO: 3857 - protein, 188 aa, Artificial Sequence; identical to SEQ ID NO: 3856
  Synthetic

SEQ ID NO: 3858 - protein, 181 aa, Artificial Sequence
  Synthetic
REVEEILKEVETLIRENKKKLEEWLRTHEKLNEDLERKAREILTRHRRENEDLKRVADDGKDKRDIKRKIEKLERETRKLIDELKKEVEEVIRRSKEAVKRNNDEDREMVEKLKEDLKRVDKDEVKRRIEELIKKSKRVNDEANRRVDKLVKDTRDKIREIEERIRKLIEESKKLLEDKRR

SEQ ID NO: 3859 - protein, 181 aa, Artificial Sequence; identical to SEQ ID NO: 3858
  Synthetic

SEQ ID NO: 3860 - protein, 181 aa, Artificial Sequence
  Synthetic
REVEEILRRVRELIERNRKEVEDWMRRHRRVNEELKRKAREILERIKEMLKTLKEVLERGRDKREIAERVKKVEKEVEELLRRLKEEVERLAKESEDVVRKNNKKDDEVVKELRELLKRVKDDEAAKRIEKLIKESRERNEEVNRKIKKLIEDTRRVVEDVRRKVEELVKRLRTELDRARK

SEQ ID NO: 3861 - protein, 181 aa, Artificial Sequence; identical to SEQ ID NO: 3860
  Synthetic

SEQ ID NO: 3862 - protein, 181 aa, Artificial Sequence
  Synthetic
SEAEEIAKRAKEAIERNRKLAEEWAKRARDAAERLKELYKRIAERHRKANEELRRAAERGEDLDKIREDAERAIEETERLIEKANRETRKAIEELKKAAKENNDEDRKAAEEAKKLAEKVKDDEARKRIRELIERSKKANKEANDRARKLAEDAKRLNEEANERAKRLAEESREAIKEAER

SEQ ID NO: 3863 - protein, 181 aa, Artificial Sequence; identical to SEQ ID NO: 3862
  Synthetic

SEQ ID NO: 3864 - protein, 182 aa, Artificial Sequence
  Synthetic
REVEEVAKELRELIKRTEDLIRRALERNRKLVKETRDLIEKVLRDLRDLLRRLEEEARRRGKDEDVLRTLRRLLEELKKKVDEVLKELRRSHEELKKHSDKVLKELKESHDRLKEKVDEVRRRGVDDKTLRDLLREHKELVEEAKRRLEESNDEHRREVEDAERRIEEIVRDAKRVVDEIER

SEQ ID NO: 3865 - protein, 182 aa, Artificial Sequence; identical to SEQ ID NO: 3864
  Synthetic

SEQ ID NO: 3866 - protein, 182 aa, Artificial Sequence
  Synthetic
SEVEKVVTELRRLIERLEEVIRRALDTNRKLLEDTEKEAERMMRKLEELIKDLERDLREKGRNEEVEERLDRLLETIKRVVEEVKERLERSHERLKRHSEEVLRTLERILEEIERRVREVERRGVDKETLRKLLKELREVLDKAREDLERSNRDHRRAVEEIKERLERLLKKLEDVVRKAKE

SEQ ID NO: 3867 - protein, 182 aa, Artificial Sequence; identical to SEQ ID NO: 3866
  Synthetic

SEQ ID NO: 3868 - protein, 182 aa, Artificial Sequence
  Synthetic
KEAEEAAKKLKDLIKEDRERARRALEENKRLIDELRKAAKEALDRNRELLERLRDEARKRGNDEEAAETLDRLLKELRDHSKKAAEELEKLLEDINRHSEKAARENEESLKRIREEAKKAKDGNADKDTAEDLLRRATRDSEEAKKKLKKSNEEAAKAVEEAKERLKRSVDEATKAVEEAKR

SEQ ID NO: 3869 - protein, 182 aa, Artificial Sequence; identical to SEQ ID NO: 3868
  Synthetic

SEQ ID NO: 3870 - protein, 178 aa, Artificial Sequence
  Synthetic
SEVEKALEESKESLKTIKKIAKDVLTESEESLRRTKKLIEEVLEASKRSIEELKRLSEADTREKDLDKLLDDNRRLVEKIKKELDDSHRDNRRLVKEIKETLERLLRENKKLVEEIRKAGVDEDELRRLHEDVKRLVEEIAKRLDELHDRHRETVKRAKEELDKLHDRARKEVEDDKR

SEQ ID NO: 3871 - protein, 178 aa, Artificial Sequence; identical to SEQ ID NO: 3870
  Synthetic

SEQ ID NO: 3872 - protein, 178 aa, Artificial Sequence
  Synthetic
SEVEKVLKDSEKSIEDAERIARDVLRKSEESIDRIRRIAEEVLKESEKSIRDAKKLAEDGVSEEALKRVLDTNKELVDRIKKALEDALRRNEELVRRIKATLDDLLRKNKELVDEAKKAGVDERELDRLHEKLRRVVEEIEKELRESNRKLEEVLRDIKRKLDDLHRKAREILERIRK

SEQ ID NO: 3873 - protein, 178 aa, Artificial Sequence; identical to SEQ ID NO: 3872
  Synthetic

SEQ ID NO: 3874 - protein, 178 aa, Artificial Sequence
  Synthetic
SEVEEVLKRIRDVIKTMEDRAREVLKESEKSIKEIRDTIREVLKRSEDSIRRIDEELKKGVDEKDLDKLLRDNRELVRKIKEELDELLKENEKLVRDIERELEELLRRIEELVKEIKKRGVDKDRLDELLKRAEEVLRKIKEDLRRSNEKLREEVKEAKKRLDDLHRELEDVLREAKR

SEQ ID NO: 3875 - protein, 178 aa, Artificial Sequence; identical to SEQ ID NO: 3874
  Synthetic

SEQ ID NO: 3876 - protein, 178 aa, Artificial Sequence
  Synthetic
KETEEAEKLAREAARRSEKLAEEAEKRAKEAIDESKELADRARDTARRADEDLERLAREGADEEALERARERARRLVEKAKEDLKRSHEKAKKLVEEAKKRLDESNKDAERLVREAKKAGAEREKLDDLLRRHNEKVKRAKERLDRLLEEHEKRIRDAERDLERLERELKKKAEDKRR

SEQ ID NO: 3877 - protein, 178 aa, Artificial Sequence; identical to SEQ ID NO: 3876
  Synthetic

SEQ ID NO: 3878 - protein, 178 aa, Artificial Sequence
  Synthetic
SETEEALERLRKMIEDSRRLAKKIREDLREMIERSRRLAEKVRRDDEKSSEDLRRVTEEGRDSEVLRKLLEENERLVREIKADLDRSNEEAERLVRRVKRELDKSNEELKRLVERIKERGVDKDRLDRLLEEHNRIVKEIKEDLDRLLREHNEIVKRIKDDLDRLHEENRRLLEESER

SEQ ID NO: 3879 - protein, 178 aa, Artificial Sequence; identical to SEQ ID NO: 3878
  Synthetic

SEQ ID NO: 3880 - protein, 177 aa, Artificial Sequence
  Synthetic
SKEDLVRELKKKLEEVVKRSREESERSLRKLEKVIRDFRRESERLKKESRDVVKKAREDGLPEDVLRDLERLLREDEERNREANREIEKLLREIEKRNREVNRENEDTLRRIEDKLRKDGADEEVLKEIDDLIRRDEERLRRVLRESEELIKEIKKRAEEMLTRSKKLTRDIEEKTR

SEQ ID NO: 3881 - protein, 177 aa, Artificial Sequence; identical to SEQ ID NO: 3880
  Synthetic

SEQ ID NO: 3882 - protein, 177 aa, Artificial Sequence
  Synthetic
RDREELRRLEEELRRVFEESRRRSERSKKELDKIVKEAEKASKRSLDKLKRVFDELRRRGLPEEVLDELKKLLDEIERVNRDVLKKIRELLREIEELNREVIDRNKKTLDKITEDLRRRGADEDVLRDARELIERDREELERVLRDSDRLVREIKKRIEEMLKRSEDLIEEIERRAR

SEQ ID NO: 3883 - protein, 177 aa, Artificial Sequence; identical to SEQ ID NO: 3882
  Synthetic

SEQ ID NO: 3884 - protein, 182 aa, Artificial Sequence
  Synthetic
SEVERVLKEIEDLIEEIERRAKTVLEEIDKLTKEIEEVVKRMLDRDRELIKTAEDLLRKNKESREELKKMLEDSRELNTRLKKRIRELHRESKELVDKIRKELDDLLKRIEKRVKEIKDRLRDDRVRKALEDLLRKVEEVVRRVREELKKLERKDREVVRKVEEDSERSLRELEKVADEARK

SEQ ID NO: 3885 - protein, 182 aa, Artificial Sequence; identical to SEQ ID NO: 3884
  Synthetic

SEQ ID NO: 3886 - protein, 182 aa, Artificial Sequence
  Synthetic
SEVEKVLRELKELTRRIREEAERLLREDERLLREAERIARELLETNKRLIEEIERRLRERKESKEELDKLLKESEDLNREIKKTIDDMVRKSEKLNREITETLDRLHKESKKVVDDIKKRSRDERVKKDLEEVRKRDREVVEEVRRRSEKSKEDVRRLVEKIRKDSEDSLKELKEVVEEARR

SEQ ID NO: 3887 - protein, 182 aa, Artificial Sequence; identical to SEQ ID NO: 3886
  Synthetic

SEQ ID NO: 3888 - protein, 182 aa, Artificial Sequence
  Synthetic
DEVEKMLEELKRLTDKIREDAERLLKRSEELTEEIKRLIDELLKEIEELIKEARDIVRRNPESREELDRVLEEIKRLVEKILRDIEDMLRKNEELVRRIKETIKRLHDESKKRVKEVEDRLRDERVRRELEKVEREDRKVVRDAEEELKKSRKKSEDVVKEAKERLEELLRRVKRVVDEVRR

SEQ ID NO: 3889 - protein, 182 aa, Artificial Sequence; identical to SEQ ID NO: 3888
  Synthetic

SEQ ID NO: 3890 - protein, 182 aa, Artificial Sequence
  Synthetic
SEVERVLKEIEELTRRLREEAEELLERSERLTEKIRRRAEELLKRNEDLIEKIERDLRRNREKREELEKMLKTSEDLNREIRDELKKLLEENEKLLRDIKRRIREMHKRSEDLVREIERRLTDDRVKKALDELRRRDREVVKRLEEELEKSKKKSEDVVREVEEKSERSKRKLERVADEARR

SEQ ID NO: 3891 - protein, 182 aa, Artificial Sequence; identical to SEQ ID NO: 3890
  Synthetic

SEQ ID NO: 3892 - protein, 179 aa, Artificial Sequence
  Synthetic
SEAEKLLKEDEDLIRKARDEIRKVLEDDERLIEEVERKSREMLKRIKEIIDDMRKRIRGDELLEEARERIERLIKTLEDLNRKSEKENRDSLRRLERLLEELDRLNAKSLDELRKRIGELKEVVEEVRKSRKKSEDVLREVERELKKSFEKSKRVNDDSKKKLDELKREADEVIKRLKD

SEQ ID NO: 3893 - protein, 179 aa, Artificial Sequence; identical to SEQ ID NO: 3892
  Synthetic

SEQ ID NO: 3894 - protein, 179 aa, Artificial Sequence
  Synthetic
SRAEELLKRDEELIDTVRRRIEKMLREIKEIIDRVKRKSEKMLEDDERLIREVEKRVRDEDLLREVAERNKKTIKEIRDLNDRSRKEIKDLIRRLKKLLDEAREENEKSIRELRKEAGQLEEVLRELEKSRKKSEEVLERVKRELEKLERRAEEVNKESEDRLRESEKESKKVIDELRR

SEQ ID NO: 3895 - protein, 179 aa, Artificial Sequence; identical to SEQ ID NO: 3894
  Synthetic

SEQ ID NO: 3896 - protein, 179 aa, Artificial Sequence
  Synthetic
RRAEELLRTIKEIIKRIDDELKRVLDDDDRLIDELRKESERLLEEIERIIRRIEREVRGEELLKRVTDIIRELERRLEELNKRSRDLNKRSIEKLRELLERVKREIEDLIRKLEKEIGEREEVLRELRKLEEEAKAVIDKARRELERSERKSEELNRESKRRLEELSRRAKRVIDELRK

SEQ ID NO: 3897 - protein, 179 aa, Artificial Sequence; identical to SEQ ID NO: 3896
  Synthetic

SEQ ID NO: 3898 - protein, 179 aa, Artificial Sequence
  Synthetic
DEVRRLLKEIEDIIRRIEEDIRRMLEKDRKLIEEVERKSKEMLDRDKRLIEELEKRLRGEEFLEEAERRNRKTIEDIRRLNRESEKENEKSIRDLEELLKRVEEEIRRLVKKLTDRIGELEEAVRELDRLRREAEEVLDRVRKKLDKSRKDSERVNEESERRLERSAEESKRVLDELRR

SEQ ID NO: 3899 - protein, 179 aa, Artificial Sequence; identical to SEQ ID NO: 3898
  Synthetic

SEQ ID NO: 3900 - protein, 187 aa, Artificial Sequence
  Synthetic
DVREELKKVVDKAEKVSRKSRDDLDKVRKRVEEVNRDNERRLREIAKKVKEVLRDIDRKRRDESLKRLIDTIEKLLRDLERTNEKLDDESRKLLEDLARKVEELNDRARKELERLRERVKKVEEDNKPKEVVKRLLEDVDRLIREVEKESKRLLDEIEEMIEELKRRAEENLKTIEDIIKDVTEKAT

SEQ ID NO: 3901 - protein, 187 aa, Artificial Sequence; identical to SEQ ID NO: 3900
  Synthetic

SEQ ID NO: 3902 - protein, 179 aa, Artificial Sequence
  Synthetic
REVEEVLKTVRKLIEELERSSRKSLKEVKELLEKLEEDARRSLKRVKELLKELEDRSRTVDSKDIKRVVEEIEEDIRRSNKELEDLLREIRRKIEESNKENRKRAEDIIRELAKALKDVDEEAKKRIEDLIRELEELLRESSDRHRKLDEELKKLLKDVTDAHRRLMEELRKLLEDIET

SEQ ID NO: 3903 - protein, 179 aa, Artificial Sequence; identical to SEQ ID NO: 3902
  Synthetic

SEQ ID NO: 3904 - protein, 179 aa, Artificial Sequence
  Synthetic
DEVETILRDIKRLLREIEELARKSSKKFKELLERLEETARRSLTRIERLLEEVEDISRTVDRKEIEDKVREIKKEVDEMNKRLEDELKKIKDDLERSNEELRRLIEEIKDRVAKRLKDVDEDAAREIEKLKRELERLLEEASRTHEELTRRLEKLLEDATREHERLKRELEKLLEDIKK

SEQ ID NO: 3905 - protein, 179 aa, Artificial Sequence; identical to SEQ ID NO: 3904
  Synthetic

SEQ ID NO: 3906 - protein, 179 aa, Artificial Sequence
  Synthetic
REVEEILRKIRELLEELRKRVEESRRRIEELLKKLEEEVRESEKDVRRLLRELEEISRTRRREEIARRMEEIKEKARKSNEELKKLMEEIKERVKRVNDELRKLAEDIKEKVRKDLKDVDEEAAKEIEKLVKELEELLKRASDKHRKLSKDLEDLLREVTERHRRLEKELEDLLREIER

SEQ ID NO: 3907 - protein, 179 aa, Artificial Sequence; identical to SEQ ID NO: 3906
  Synthetic

SEQ ID NO: 3908 - protein, 179 aa, Artificial Sequence
  Synthetic
SEVEKLLEEARRLLKELEDSSRRSVEEAKRLLEELKRRVEESVRRIRELLKDLERLSSRVDREEIEKEVRRIEEDVRRSNDELRKLVEDILRKLRKVNEENADLVRRIITRLRDALKDVDERAKEALRELEKRLRDLLRDSSRLHEDLARDLKRLLDEVTEEHDKLRRELRKLLEDIKT

SEQ ID NO: 3909 - protein, 179 aa, Artificial Sequence; identical to SEQ ID NO: 3908
  Synthetic

SEQ ID NO: 3910 - protein, 179 aa, Artificial Sequence
  Synthetic
SEVEKVEEDVKRLLKEIEDSSRRSLEKAKRLLEELRRSSEESLKRIRDLLEELRELSRTVDSKDIADRARKIAKEVDDSNKRNRELVKRIIEELERVNRENEEKLKKIKEDLRRSLKDVDEEAKKRIEELKRELEELLKKSSEEHKKLVKELKELLKKSTEDHEKLKRDLRKLLEEIRT

SEQ ID NO: 3911 - protein, 179 aa, Artificial Sequence; identical to SEQ ID NO: 3910
  Synthetic

SEQ ID NO: 3912 - protein, 178 aa, Artificial Sequence
  Synthetic
DSEDLMRRVKEELDKLVKDSRKRSEDLKRENEELLRRSEEALEKSVRDADRLFEEIKRTKDKKEELLRELKKLLDELREHSKRVLERNREILERNKKRNKEANDRNKEILDRIREEIKRKGADRDVLKTLKDLIRELKRHSEEVEREDKETTDRLRRHSEKALRTNEEIIRRIEERAR

SEQ ID NO: 3913 - protein, 178 aa, Artificial Sequence; identical to SEQ ID NO: 3912
  Synthetic

SEQ ID NO: 3914 - protein, 182 aa, Artificial Sequence
  Synthetic
SVDEALRDIERKVEELMRESDERLRRVKKEVEDNVRRSEEELKRIADEMKELLDRARERGVDEEILRRVEEELRRLAEEIKKINRDAEERLRRLIKEVREINEDVRRKLEELREELRRDGGKVEDLVREVLKKLKELIDRWRDLSRRLKERLDTLIKEHHELSKRLLERLKRLIDEARKKLN

SEQ ID NO: 3915 - protein, 182 aa, Artificial Sequence; identical to SEQ ID NO: 3914
  Synthetic

SEQ ID NO: 3916 - protein, 182 aa, Artificial Sequence
  Synthetic
SEVEELKREADDVNRRAEELARETLKKIEKVNREVKRRLEEALREIEELLRRAEEIVRRNEDKDRAIEEVRRRLDELRRKVEKVNEDNRKLLEELTEEVKRVNDENKKLLDDLADKVEKKLTTEEARKRLEEVVRHNKKLDDEHRKALDELRKHNEDLDRRSKEELDKLRKRLEDLLRKVKE

SEQ ID NO: 3917 - protein, 182 aa, Artificial Sequence; identical to SEQ ID NO: 3916
  Synthetic

SEQ ID NO: 3918 - protein, 182 aa, Artificial Sequence
  Synthetic
REVEELLKEIEEVLKKSERLSRESLKKIREVLERIERLARENVKRMKEVIDRVRELAERNEDRERLIEDVKRLIKEVSDSNRELDERSKKLLKELRDENERLSEESKKELERIRKKVEDKLTTEDARRALEELRKRVEEVNKKSRDDLERLTREAEELNRKNEEDLRRLEKEVKDLLDEIRR

SEQ ID NO: 3919 - protein, 182 aa, Artificial Sequence; identical to SEQ ID NO: 3918
  Synthetic

SEQ ID NO: 3920 - protein, 181 aa, Artificial Sequence
  Synthetic
SSRETVKRLTEEARKLLEDWKDRNRDVERKVEEIIERIRRTNEKSERDARRKLEEVDKRRRDEEVEKVREELERLLEESHRKVEEVVKEVEELVRESTEKVRRIVEKVKRLLEELTRLMEAGERDTEELKREIERILEELRRLMKEDKEELERILERLRRLAEEDKKENEEILDRVDKKAK

SEQ ID NO: 3921 - protein, 181 aa, Artificial Sequence; identical to SEQ ID NO: 3920
  Synthetic

SEQ ID NO: 3922 - protein, 181 aa, Artificial Sequence
  Synthetic
STEETITDLKREAEEILRRWREENKRVSDEAAESVKESDKTNKKSKDDLKRVLDEVDTKERSERVKTVIRKAEDLARRSHEKNREVNERLKKLLEESTRTVDTIIRELRRILDDIKRKVDAGERDAKELEDEVREALKRIRKLIEEDRRKLKRILDEHRRLTEEDRERNERVLRELREDTR

SEQ ID NO: 3923 - protein, 181 aa, Artificial Sequence; identical to SEQ ID NO: 3922
  Synthetic

SEQ ID NO: 3924 - protein, 181 aa, Artificial Sequence
  Synthetic
SVDESLEEIRKEVERLLRKWKEDNKEMRKRIRELLEDWRKKVEDSKKRAKDLIDEVKKRRDDERVEKVRKELEDLLKESEEKVREVERRVKKLLDESTKKVKEIEKEIRDIIRELDKRLKAGKRDTRELEKEAEDALRRLKKLIEEDRRELEKILKELEDLMREDTKENEKILREAEERSR

SEQ ID NO: 3925 - protein, 181 aa, Artificial Sequence; identical to SEQ ID NO: 3924
  Synthetic

SEQ ID NO: 3926 - protein, 181 aa, Artificial Sequence
  Synthetic
SVEDEIRRLTEEIERTLRRWREEVKRSEDRAEESIKRSDEKNKESKERLDKVLDEARRRRDDEEVKKVIKEVEELAEESNRRNKEVNDRLKKLLEDSKRKVEEIVRRVKKAMEDLKRLLDAGERDLRELLKEVEDVLEELKELIKRDTEENKRILDEHKRLTEEDEKRNREVLERLKRKTD

SEQ ID NO: 3927 - protein, 181 aa, Artificial Sequence; identical to SEQ ID NO: 3926
  Synthetic

SEQ ID NO: 3928 - protein, 181 aa, Artificial Sequence
  Synthetic
ESEETLKEVKKEIEKLIKRAEEINRESAERLKRILEEWKKEVDRSEKRLREVLDEVRRRRNTEEVEKVIREVEELVKRSRDKVRKIEKEVRDLLKESTDELKRIVEEIEEAVRDIERKLRAGKRDRRELLEELKRVLDRLKKLIDDDRRKNEKVLRDLEKLMREDADENREVLKRLEDKAR

SEQ ID NO: 3929 - protein, 181 aa, Artificial Sequence; identical to SEQ ID NO: 3928
  Synthetic

SEQ ID NO: 3930 - protein, 179 aa, Artificial Sequence
  Synthetic
SDEERVIKEVEDLIRRIREDNKRLLDEAEKIIRRVAEDNKKLVEDHRRMLRKIDEEAKRGRDEKFLKDLVERSERVVEESRRHVERNEREIREMLERLREHVERNERELREILERVVRKVGKETEDVKRLEEKVRKLLEESKRKLKRLAEEVRKLIKDSRDKIRELERENKEIIKKVKD

SEQ ID NO: 3931 - protein, 179 aa, Artificial Sequence; identical to SEQ ID NO: 3930
  Synthetic

SEQ ID NO: 3932 - protein, 179 aa, Artificial Sequence
  Synthetic
DREKEVVDTLRRLIEDARRDNKDLVETHRRLLEDLERDNRELVRTHEERLEEIERRARRGDDDTFLKKLEDESRDVVRDSERHLEENKRKSTKIVKDTKDHVDRNRKKIKKILDEAVREVGKEAEDVRRLEKEVEELLRESDRRVEDLERKNREILKRSEDLIRRLKEENRRIIEKVRK

SEQ ID NO: 3933 - protein, 179 aa, Artificial Sequence; identical to SEQ ID NO: 3932
  Synthetic

SEQ ID NO: 3934 - protein, 179 aa, Artificial Sequence
  Synthetic
DDERRVVEELERMIRELEKKIREIVKRHEEALKRLKEDNDELSKRHKKMVEEIKRRADEGRDDTFLKKLVEDSERVVEESKRHVDRNKEKSERIVRTTAELIKRLKEEIKKVLEDAVRKVGKDTEEVRRLKREVEELLKRAEELLKRLEDRNRKILRESEEDIKRLERENREIITRVRT

SEQ ID NO: 3935 - protein, 179 aa, Artificial Sequence; identical to SEQ ID NO: 3934
  Synthetic

SEQ ID NO: 3936 - protein, 175 aa, Artificial Sequence
  Synthetic
KELDEIIRRVEELIKDDERRNREVLKRSDESTKESHDKARRILEESEKTTEDIKRKVEKDGNTEKVERDIRRNNEELRKVLRELEKEHRENNKRLDEMLDRSRKNNDDIRKEIREKVKDEDKIRRLERESRELLRDSEDKVRKSKRKDEENLKRIEEEARRSEKRDEELLREAAK

SEQ ID NO: 3937 - protein, 175 aa, Artificial Sequence; identical to SEQ ID NO: 3936
  Synthetic

SEQ ID NO: 3938 - protein, 175 aa, Artificial Sequence
  Synthetic
RELDEIIKTLEKLIEDSHREAREIVKEVKKRLDDDKRRNEEVLKESRETTERIRKEIEERGRTEEIEEKIRRNNRRLEKLLDESEKNNRRIIDTIERLLRKLEELHKKIIDEIRKKVKSEEKIRRLEERARRNVEEMRKLAEELEKESRRILKESAEAVKRSKDEDRKLLEEAKK

SEQ ID NO: 3939 - protein, 175 aa, Artificial Sequence; identical to SEQ ID NO: 3938
  Synthetic

SEQ ID NO: 3940 - protein, 175 aa, Artificial Sequence
  Synthetic
SETDKVIEESEKTNRDIKRHSEEVVKDSKRTNTEIERTVEKMIRELEEILERIKRLADNGVPKEDLKRLVDELKERIDRILKELEELLRTDKKRISDALRRDEELAKKDKDEIDKKLDDKDKAKKLKDETDRILETSERLLKALRDETDAIKRKVEELVRRVKEELDRILKKTED

SEQ ID NO: 3941 - protein, 175 aa, Artificial Sequence; identical to SEQ ID NO: 3940
  Synthetic

SEQ ID NO: 3942 - protein, 175 aa, Artificial Sequence
  Synthetic
SETDRVVEESERTNKEIERHSEEMVRDSERTNKEIEEHSREVIERLREILERIERLVRKGVPKDELKKLVEDLRRRAKEALDRDRELLRRDKEKIDEVLKRDTELAERDKREIDKKVRDEEKMRRLKEETDRILDKSRRELKRLKDETDKLLEDSERLLREVEKTLRRILEEARK

SEQ ID NO: 3943 - protein, 175 aa, Artificial Sequence; identical to SEQ ID NO: 3942
  Synthetic

SEQ ID NO: 3944 - protein, 175 aa, Artificial Sequence
  Synthetic
SETEEVVKTLKRLLEEIKKHSDDAVRKSEETNKRIREEVERVIKRLKELIEEISELVKSGVEKERLKELVDRVKTALDRALDELRKLLEDDERKIKTVLDEDKKLVEEVKKRADEKASDEEKLKRLKDALDRILEESKRLADELKKRTKDILDEAKDALRKIKEELDKLVEDAER

SEQ ID NO: 3945 - protein, 175 aa, Artificial Sequence; identical to SEQ ID NO: 3944
  Synthetic

SEQ ID NO: 3946 - protein, 175 aa, Artificial Sequence
  Synthetic
SETDKVVREVEELIRRLEEHSRRVVEKSERTNEEIERHSRDVIRRSKEINDRIEELARNGVPEDDLRRLVKKNKEDNDRALEEDKRLLDTDKEEIDRALKRDEEIVRRIKEEIDKKVTDKDKMKRLKEELDKLLDDSRRLMKRLKDETDKILDKSRDLLAKTKRESDRILEEAER

SEQ ID NO: 3947 - protein, 175 aa, Artificial Sequence; identical to SEQ ID NO: 3946
  Synthetic

SEQ ID NO: 3948 - protein, 175 aa, Artificial Sequence
  Synthetic
SETDKVVDDSRKTNEDIKRHSEEVIRRLEELIREVEEHSRRVEDEVRRILDEIRKLAEDGVDERDLRRLVKKLEEEIDRVLEEDERLIREIKKEADRVLETDKRLAEEDKKRIDDKATDKDKATELKKDTDRILKESEDALRRIKKELDDLLRTSKRLAEELKKELREILERAKR

SEQ ID NO: 3949 - protein, 175 aa, Artificial Sequence; identical to SEQ ID NO: 3948
  Synthetic

SEQ ID NO: 3950 - protein, 175 aa, Artificial Sequence
  Synthetic
SETDEVVERLEKILKDIREHSERAIKKLEDILREIERHSRKVIRDSERINTEIKKLAEAGVPEKDLTKLVEDNKKRNDDVLDEDRKLVEELRERAERILRTDKRLVDDLKRKADEKLTDKDKLTTLKKKLDDLLDTSRRLVEKVEEDLRRILEASKRMLEETKKRSKEILDRIRK

SEQ ID NO: 3951 - protein, 175 aa, Artificial Sequence; identical to SEQ ID NO: 3950
  Synthetic

SEQ ID NO: 3952 - protein, 175 aa, Artificial Sequence
  Synthetic
SESEEVVREVDKILKEIRKHSKDVIEKLKKLIDDIRRRVRKVIRDSEEINKRIEDLAREGVPEEDLERLVEENKRRNDEVLKRLKELAERVKEEADRALERDKRLVEELKKRIDDKVTSEEDMRRLKERLDKILDDSREMLKRLKDELDEVLEEVERLLRETKKRSDEILKRIKD

SEQ ID NO: 3953 - protein, 175 aa, Artificial Sequence; identical to SEQ ID NO: 3952
  Synthetic

SEQ ID NO: 3954 - protein, 176 aa, Artificial Sequence
  Synthetic
SEIEDVIRRAEELIKEDKKRVEDVVREIEKLIRDDARKVRRAIEELKRLLREIEERVREEKEKRDVLERLVRTIKEEIDRLLKDNEDSIRRITKRLRDILRENRESLERIRRELDRRLTVKEEAERLRRELEDLHRDVKRLIDELEKDLRRLLEESKRRADRVKEELRRLREEVRK

SEQ ID NO: 3955 - protein, 176 aa, Artificial Sequence; identical to SEQ ID NO: 3954
  Synthetic

SEQ ID NO: 3956 - protein, 176 aa, Artificial Sequence
  Synthetic
SEADKAAEDAKRLIDKDREDVERAVKRAEDLIEKDREDVDRAIKESEELNKRAEDEARRRKDAREKVKRLADEDKKRNEEALRRNRKSIEDIRRDLEKALRDNEKTIEDIRREIEKLASDEEKARRLKEEADKVAKESKELADRLKERADRLHKRARELAERTKEDTDRLVEEAKR

SEQ ID NO: 3957 - protein, 176 aa, Artificial Sequence; identical to SEQ ID NO: 3956
  Synthetic

SEQ ID NO: 3958 - protein, 176 aa, Artificial Sequence
  Synthetic
SEIDEVVKEIEKILEDDKRRVDEAIEELEKLIREIREEVRRVIKESEDLNKEIRDRVRKNKEKREDLDRLVEEDRKKNREILETLKELIERIRREIERLLRENEETLRDIERKIREKMTDKDKAERLRRELKKIMEDSRRLADEIKKRLDRLLEEVKEEIERTKRETDRLLEEVRR

SEQ ID NO: 3959 - protein, 176 aa, Artificial Sequence; identical to SEQ ID NO: 3958
  Synthetic

SEQ ID NO: 3960 - protein, 176 aa, Artificial Sequence
  Synthetic
SELDRVVEEIDRLIREDEKEVRDMIRESEKLNRENEETNRKLLEDWDKLSKDIRDRVDKNKEKEEEAEKLLRDSERLAEDVLRRDKETVERDREKNKKVKERNERTIKEIRDRIEKKMEDDKKARELKEKLDELKKRSEKLLEDTKRETDKLHERSRRELEKLRRKDEELVKRVKD

SEQ ID NO: 3961 - protein, 176 aa, Artificial Sequence; identical to SEQ ID NO: 3960
  Synthetic

SEQ ID NO: 3962 - protein, 176 aa, Artificial Sequence
  Synthetic
SEIEEVVERIERLIKRIKEEVERALKESEDLIRDIERRVRELLEEWDRLSERIREVVERNPEKREDLKRLVEESRREAKRVLDELRRLVEEDRRRNEELLRRLEELIREIEDRIEKLAEDKDELRRLKEELRKLLEDVKKLLEESKKKTDDLLKRAEDELRKLKEKDDDLLRKVKD

SEQ ID NO: 3963 - protein, 176 aa, Artificial Sequence; identical to SEQ ID NO: 3962
  Synthetic

SEQ ID NO: 3964 - protein, 176 aa, Artificial Sequence
  Synthetic
EELDRVVEELDRLIRDNKRRNDEALKESDRLIRENERRNRKAARDWEELSKEIEDRVRKNKEKEEEVERLVRRSEKELEKIERADEETVRRDRELNKKVRDDDRRTIEDIEKKARELLEDKDKLTTLRKKLDDLHKESRRELERSKKKTDDLHRKSREEVRKLREDDERKLREIKK

SEQ ID NO: 3965 - protein, 176 aa, Artificial Sequence; identical to SEQ ID NO: 3964
  Synthetic

SEQ ID NO: 3966 - protein, 176 aa, Artificial Sequence
  Synthetic
SEADEAAKKIEKLIEDNERKNRKALKEWDELTRENEKRNRDAIKESEDLIKEAADEVRRRKDAREKAKKLAEDDKRRNEKALEDDERTLRESKKRAEEALREDRETLRRIEEEIKKLASDEEKARRLREEAEELHRRSEEAARRAEKKDREAHKRSREAIKRTKDDTEELLKEAER

SEQ ID NO: 3967 - protein, 176 aa, Artificial Sequence; identical to SEQ ID NO: 3966
  Synthetic

SEQ ID NO: 3968 - protein, 176 aa, Artificial Sequence
  Synthetic
DEIDKVVRKIEKLIDDNRRENEEMLRESEKLLKENEKKNEKAIRESEELIRRIEKRVRENKEKEEELKELVDRDRERNKEVEKEDRETVKRDRDLNEDALRRDRETLERIKREIEKRAEDKDKARRLEEELKELHKRSKEELEKSKEKTDRLHDKSRRLIEETERRTEELLERVRR

SEQ ID NO: 3969 - protein, 176 aa, Artificial Sequence; identical to SEQ ID NO: 3968
  Synthetic

SEQ ID NO: 3970 - protein, 183 aa, Artificial Sequence
  Synthetic
SVEDEVERLERDAEEISRRSETELRRLKKEVEDLNRESKKLLDELREEMEKILKKVREDSDEEELERLIREARKLLKDLADKIRRVDEESKRILDELARRIKKVNDDLKELVERLSRRAREIKDKDEVKRLVEEIERLLKRAEELSRELVRRIEKLIRELAEESRRLVDEIREVLKRLKDRAD

SEQ ID NO: 3971 - protein, 183 aa, Artificial Sequence; identical to SEQ ID NO: 3970
  Synthetic

SEQ ID NO: 3972 - protein, 176 aa, Artificial Sequence
  Synthetic
SEIETVLEKLKRLLEEDRELVKRVEDKIRRIIEEDEKTVRDIKKRLDDILREIRDVLEKRKEVREELKELLERVEEVIKDVLRKNEETLERLERELKRALKRNDDTLKRLREEAARLLEVEEELKKVEDELDRVRKETERIIKELREELEELHKRARDLLKEVRDELRKLLEEAKK

SEQ ID NO: 3973 - protein, 176 aa, Artificial Sequence; identical to SEQ ID NO: 3972
  Synthetic

SEQ ID NO: 3974 - protein, 176 aa, Artificial Sequence
  Synthetic
SEIEDVVRRIDELLREDKRRVDEVLERNRKLIEDDERLSREIARELDEIIKRLREVVKSNKEDRDTIRRLAEEAREVIERVDRENEKTKRELEKHSREALRENEDTIRRITEELKTRIKVREEVRKLKERLDKILEDTRRLLEESKRRLDRLHERHRETSEDMKRRIDKLLEEVRK

SEQ ID NO: 3975 - protein, 176 aa, Artificial Sequence; identical to SEQ ID NO: 3974
  Synthetic

SEQ ID NO: 3976 - protein, 176 aa, Artificial Sequence
  Synthetic
KEAEDVVREVEELIDRDRKLVERVLRENERLLKEDRDTVKKVLEELEEILKDIERVVRERKEVKEEVDRLIKELRDLIEKVLRDNKESIDRIREHSKRALETNERTNKELEETLRRLLDIEELLRRLKEEIERLLERSRRLVKESEERLDRIREETKRELDRVEEKLRRLLEEVKR

SEQ ID NO: 3977 - protein, 176 aa, Artificial Sequence; identical to SEQ ID NO: 3976
  Synthetic

SEQ ID NO: 3978 - protein, 176 aa, Artificial Sequence
  Synthetic
SEIEKVVEEIKKLLKELKETSERILRRNEKIIKEIEETSREVLKELERILEEIEDVVRKRKEVREEVEELIKELEERIRRADKRLEELIKELRDHSEKANKKIEDIVRRIEERLRRLLRDKDRLKRLRDELERILRDHERLSRESKDKLDKLLERHKELSDEVRKKLKELRDRADT

SEQ ID NO: 3979 - protein, 176 aa, Artificial Sequence; identical to SEQ ID NO: 3978
  Synthetic

SEQ ID NO: 3980 - protein, 176 aa, Artificial Sequence
  Synthetic
REIEEVEKEIERIIERIERTSRRVKEENDRLLEEIKRRSEEVKKRNDDIIREIRRVVEEDKKNREEVKRLIEELRKHSRDADEELRELIKKLKRHSDEANKTLEELIKELRKRLEERARDERRLKELKRKLDKLREDHERLSRRSDEELRRLEEEHKRLSEDSKRELDKLLDEVRK

SEQ ID NO: 3981 - protein, 176 aa, Artificial Sequence; identical to SEQ ID NO: 3980
  Synthetic

SEQ ID NO: 3982 - protein, 176 aa, Artificial Sequence
  Synthetic
DEIERVLEEAKKLIRDLEEHSRRVEEENKRLLKEIRETSERVKRELDRILEEIRKTVERRKEVREELDELIKTIRKRIKEADDELRRLIEELEEHSRRALETDKKILDEIEKRLRDLFKDDEKLRRLEEELKRLLDESKRLLEESEDELRKLEEEHRKLSEEVKRRLDELKKEVET

SEQ ID NO: 3983 - protein, 176 aa, Artificial Sequence; identical to SEQ ID NO: 3982
  Synthetic

SEQ ID NO: 3984 - protein, 176 aa, Artificial Sequence
  Synthetic
REIEEIVERVKEIIDRIRRHSKEVEKENEKIIERIRRRSEEVLRTNEKALRDIERRVRERKEVREELRKLIEDLRRHSDRADEELERLIETLKRHSKEALDRDRELIKRLEDDLRRAAKDKDELKRLKEELERLLRESKKLVDESKRRLEELLREHRELSKRSRDKLDELLRRVEK

SEQ ID NO: 3985 - protein, 176 aa, Artificial Sequence; identical to SEQ ID NO: 3984
  Synthetic

SEQ ID NO: 3986 - protein, 176 aa, Artificial Sequence
  Synthetic
SEIEEVVRRIREIIEEIRRLSEAALERNKRIIDEIRRTSKRVKEEIERIIRDIRRVVEERKEVREEVERLIRELKKTIEDANEELKRLIKELRDHSEKVNEEVRRALEELKERLDRLLRVREDVRKLKEDLKELLKEHKRLSEESKKRLERLLEEHERISEELKRRLEKLLKEAED

SEQ ID NO: 3987 - protein, 176 aa, Artificial Sequence; identical to SEQ ID NO: 3986
  Synthetic

SEQ ID NO: 3988 - protein, 176 aa, Artificial Sequence
  Synthetic
SEIEEVVKKVKKIIDEIRERSREALERNEKILEELKRHSEEVTRRAEKIIEEIKRVLEKRKEVRKRLRELARKLEELLKRALRRDEEIVAKLRRHSEKVNRELEEDIKRLKEELKTRMKDKDELTKLEKELEDLREEHRKLSKDSKDRLKKLLDESRELIERLKEKLKRLLEEAER

SEQ ID NO: 3989 - protein, 176 aa, Artificial Sequence; identical to SEQ ID NO: 3988
  Synthetic

SEQ ID NO: 3990 - protein, 181 aa, Artificial Sequence
  Synthetic
SEVEEMLKRLDDILKKHRELVKEMKEELDRVIETHRRLVEEVRRRLEKSNDEIDKLVKADVREDELRKLLTDNERLNREINRTSKDVVRKLEDLLRRAEEESRRVVKEVRKVIDDIRRRTRDERVEKALKEVRERLERSHKKAKEDLDRVREEARKSHEDVKRLSEEDRKKSEDLADEVRR

SEQ ID NO: 3991 - protein, 181 aa, Artificial Sequence; identical to SEQ ID NO: 3990
  Synthetic

SEQ ID NO: 3992 - protein, 181 aa, Artificial Sequence
  Synthetic
REVEEALERLRKLIEDDRELVKRAKEKLDKLLKDDRKLVEDVLRELKRSNDEVKKLVDSGVSEEELKRLLDENRRLNEKINRENEESIKRVEELLEEIERRNRETLERIKRLLDDVRKKTTDKRAEEELRRVKEEVDRVLEESKRRLDEVRRRLERIEEESRTKSEEDRKRSEDLVREAER

SEQ ID NO: 3993 - protein, 181 aa, Artificial Sequence; identical to SEQ ID NO: 3992
  Synthetic

SEQ ID NO: 3994 - protein, 181 aa, Artificial Sequence
  Synthetic
SEVERLVEDAERVIDEHRKLVTEMERRLERVNREDEKLVRKVLEELKKSNEEIKKLREDSVSEEELEKMLRKNEELNKEANERNKDSTRKNKELNKRINEDSKRVVKKLRDLLKEVEDRTTDERAKKLLDEIRKKLDDSNREVEKRSRDDERHTERVVRESKRLSEEDKKRSDELADETRK

SEQ ID NO: 3995 - protein, 181 aa, Artificial Sequence; identical to SEQ ID NO: 3994
  Synthetic

SEQ ID NO: 3996 - protein, 181 aa, Artificial Sequence
  Synthetic
SRVEEVKKELDDLIRRHKELVEKVRKELKDLLDKHERLVEEAKKEIEKLIETLKRLAENGVSEKDAEEILKEIEKLLKRIEEDSKRVLDEIKKLLDDIRKESKKVLDDIRRVIDRARKETTDRRAEDELRKVRKEVERSNKEVEEILDDVRRKVEESDKRVKEILKKLREDVKKLLDEVRK

SEQ ID NO: 3997 - protein, 181 aa, Artificial Sequence; identical to SEQ ID NO: 3996
  Synthetic

SEQ ID NO: 3998 - protein, 181 aa, Artificial Sequence
  Synthetic
SEVEKLVADADKLIKDHRKLVEEAKKRLDEVNERHRRLVEEVERRLDKSNKELEDLVRSGVDEDDARRVLEDNERLNKEANDRSKEMLDRNRDLNRRINETSERILKKIEDLLEDVRRRTDDRRADEELRRISERVKRSNEDVRKKSEDDKRHTDESDRDVKRLSKEDRERSETLMDRVRE

SEQ ID NO: 3999 - protein, 181 aa, Artificial Sequence; identical to SEQ ID NO: 3998
  Synthetic

SEQ ID NO: 4000 - protein, 181 aa, Artificial Sequence
  Synthetic
SRVEDVERELEEEIDKHRKEVEDAKRRLDELIRRHKEEVKKLKKKLDDLIEELERLARNGVDEKTIEEVVKRIREELEAIEERSRRVLKKIEDVIDELRKRSEEVVRRLEKLLKDVEREVDDERAKRSLDRVREKIEKSDRTAKDLLKKVEEEVRKSNERVKELLKRVKDAVDDLLRRRRK

SEQ ID NO: 4001 - protein, 181 aa, Artificial Sequence; identical to SEQ ID NO: 4000
  Synthetic

SEQ ID NO: 4002 - protein, 181 aa, Artificial Sequence
  Synthetic
DEVEEVVKRAEDVIRTHKELVKKAKEDLDKIIEDIERELKKMLEDLERSNRRVEELVRGGVDERELDKLLEENRRLNEEINDRLEKLVKEVRKVLEKIKKDSDDVVRKLEKLLKDVERRSTDERVKKILDDIRRELEESNKKVEEDLRKAEEDLEELLRRARELSKEDEKKSRKLVEDARR

SEQ ID NO: 4003 - protein, 181 aa, Artificial Sequence; identical to SEQ ID NO: 4002
  Synthetic

SEQ ID NO: 4004 - protein, 181 aa, Artificial Sequence
  Synthetic
DEVDEVVKRLEDIIRKHETLVKKAKEDLDRVNEEDTKLIRDVLRRLKESNEEMERLVRSGVSEDDARRLLDENRKLNEEANRRNKKSLEDNSRLNEKLNRDSKRVLDEIRELLKDIERRSTDERVKEELRRVEEDVKKSDEDARRLSKEDRDHTRENFKRSEELSRRDEETSRRLMEEVKR

SEQ ID NO: 4005 - protein, 181 aa, Artificial Sequence; identical to SEQ ID NO: 4004
  Synthetic

SEQ ID NO: 4006 - protein, 187 aa, Artificial Sequence
  Synthetic
KDVEDLVRKAEELLKRHREDVTRLLERLKKVNKDHERLVKELKRRLEELLREVRELVERDGGESERAKEILRRLVEKAKKLLKEVEERSRKVNRDSEKLLKEIRERSKEVEDRVRKLLKEIEERVRGKDEVERRLRRLEEELKKSHEEVERRLDEVRRHSKRSHDELRKVLRKLEEDLRRLAEEVKT

SEQ ID NO: 4007 - protein, 187 aa, Artificial Sequence; identical to SEQ ID NO: 4006
  Synthetic

SEQ ID NO: 4008 - protein, 187 aa, Artificial Sequence
  Synthetic
SDLEELVKRAEKLLEEHKELVKRLEDRLRELDKRHKEIVERLRKELERLLREIRRIVEEKGGESEEAKELLKKLREEVRKILEEIERTSEKMERDSERLNEEIRKRSKEMLDRAAELLKEIESRIRGVDEAKRKLDELEERLRRSNKELEEKSEENERRTRESNEELERRLEDVRRKLERLREEVER

SEQ ID NO: 4009 - protein, 187 aa, Artificial Sequence; identical to SEQ ID NO: 4008
  Synthetic

SEQ ID NO: 4010 - protein, 187 aa, Artificial Sequence
  Synthetic
KDVEDLLRRLEEIIKDHRREVEELLRELTKLDEEHKEEVRRLTEELERLLDEARRLVEEKGGESEEARKIVKDMEERVKKVLDDIRRESERVVRESERLNKEIEKRNDEVRRRAEKVLKDITDRIRGVDEAERELERVEREVRKSSDKLRRDSKRNKERTRKSNEELERRLEEVERELRRLVAEVEK

SEQ ID NO: 4011 - protein, 187 aa, Artificial Sequence; identical to SEQ ID NO: 4010
  Synthetic

SEQ ID NO: 4012 - protein, 177 aa, Artificial Sequence
  Synthetic
KKVEDLEERLERLLRDAERRVRELLDEARRLLETHRELSKRLLERLEKVNRDIREKAKEKKEEVLTELLKESERLLEEVKKINKEAEDRIRELLKRVDDILKDLKKRIEDLLDEVRKRGLDERLLRRVEKEVEDLLRTVKDLLRRIEEEVRKSLEESKKLLKEVEDHSRKLLEEIRK

SEQ ID NO: 4013 - protein, 177 aa, Artificial Sequence; identical to SEQ ID NO: 4012
  Synthetic

SEQ ID NO: 4014 - protein, 177 aa, Artificial Sequence
  Synthetic
DEDEEVLRRLKELLKTHRKLSEDLLREAEAINEDHRRLSEELLRRLEKLNEEIRRKAKEKDRRVMEKVRKESRDLLEEVKRINEEAKRRSEEVAKKVRKINKEAKDRIDTLLEDLKRRGVDEELLRRVEEEVKKSNEESKKKIKELEEHSRRSNEESERRLREVEEHSRRLLEEIRK

SEQ ID NO: 4015 - protein, 177 aa, Artificial Sequence; identical to SEQ ID NO: 4014
  Synthetic

SEQ ID NO: 4016 - protein, 176 aa, Artificial Sequence
  Synthetic
SEVEDIVRKVDEIIRRLERHNEELRKRVEEVLDRLRRHNEKLDRDVKEIIKEIERVIRGNTDDARELTKRLKEALDRHRKASEDNIRDIRDALRKVEEVSRKNVDDLRDALREVREKLGKKDLLREIEEKVRRLVRKSEELLRRIAEDVKKVIEDSKDSHKKIEDELRELEERLRK

SEQ ID NO: 4017 - protein, 176 aa, Artificial Sequence; identical to SEQ ID NO: 4016
  Synthetic

SEQ ID NO: 4018 - protein, 176 aa, Artificial Sequence
  Synthetic
SEVEDIVRKVDEFLERLKEHNRKLDKEAKELLDRLKRHNEKLDEEAKRLIEEIKRVADENSMDKDRLLAELRKVLEEHRRVSEDNVRRIRKLLDDHRRRSEENMRRIDAVLDKVRKELEDKDLLREIAEKAERVKEESKRSHDEIADEIRKVEEESERSHREIAEELERLSRRLKK

SEQ ID NO: 4019 - protein, 176 aa, Artificial Sequence; identical to SEQ ID NO: 4018
  Synthetic

SEQ ID NO: 4020 - protein, 176 aa, Artificial Sequence
  Synthetic
KDVEDIVREVERLIKELREHNKELVDRAREVLKELKDHNEKLVEDVKRLIEDITRKIRANTDDKEKLLRDLERVLREVKRVSEENIRRIRKVLEKVAEDAKRNVEELRKVLKEVREKLKKKDLLRDIERKVEKLERDSRRLLREIEEEIRKVIERSKELLERIEKELRDLMRELRK

SEQ ID NO: 4021 - protein, 176 aa, Artificial Sequence; identical to SEQ ID NO: 4020
  Synthetic

SEQ ID NO: 4022 - protein, 176 aa, Artificial Sequence
  Synthetic
KEVEDIVEDVKRVLDELRRHNEKLVREVDRLIRELDKHNKELDDRATEIIKRIEEVVRRKSRDKRELVRELEEVLERHREMSERNVRRLERILKEVAREADKNVKDIRRALERVKRELEKKELLERIDEEVKRVEETSRRLLREIAEKVKTLKEKSKRSHEEIRRRLEELADEIRK

SEQ ID NO: 4023 - protein, 176 aa, Artificial Sequence; identical to SEQ ID NO: 4022
  Synthetic

SEQ ID NO: 4024 - protein, 176 aa, Artificial Sequence
  Synthetic
SEVEEIVRRVEKLIEDLKRHNEKLVDEVKKVIDTLRKHNEDLVRRVEEVIKRIEEVIRENRVDKRELLKRLEELLKRVAEEAKRNVKRLREALKEVAERSKENVKRLEDVLEKVKRELEDKDLLRDIAEKVKTLKEDSRRLLEEIADRVRRLEEDSRRLLEEIRKEVERLKEELKK

SEQ ID NO: 4025 - protein, 176 aa, Artificial Sequence; identical to SEQ ID NO: 4024
  Synthetic

SEQ ID NO: 4026 - protein, 176 aa, Artificial Sequence
  Synthetic
SEAEEAAREAKEAIDRLEEHNKKLDEDAKRAIEEARKHNKELDERAKRALEEIEKAARDNREDKEELKKKADRALEEHRKAAKRNIDEARRALDEHRKASEDNAREAREALKRVRRDLRDTDAARRIAEEVKKLEKKSEDSHRKIAEDVKKAEEDSERSHRDIARRAEEVKKKADD

SEQ ID NO: 4027 - protein, 176 aa, Artificial Sequence; identical to SEQ ID NO: 4026
  Synthetic

SEQ ID NO: 4028 - protein, 176 aa, Artificial Sequence
  Synthetic
SEVEKIVREVEKLLEELREDNRDLVRRADKDLERMERHNRKLVKDVEDVLRRIEEVRRANTEDKRELEKEVRRVLKEVADMAKRNEEEIKKVLDKVTRHSEDNVRKIREILEDVRRKLEDKDLLREIERKIREVEEKSRELLREIKKKLEDVARESRRLLEEIARKIEKLSDELRK

SEQ ID NO: 4029 - protein, 176 aa, Artificial Sequence; identical to SEQ ID NO: 4028
  Synthetic

SEQ ID NO: 4030 - protein, 176 aa, Artificial Sequence
  Synthetic
SRAERIVEEVEKVITDLERDNRELVRDVRRLLERLERHNKELDDRITEIIKEILRLAERNERDKRELEKELEKVLDEHRRVLEENIKEIRDVLREVAEHSERNMRKLRDALRKVERDLEKEELLREIKRKVEELEKRSKELLEEIARRVKEVEEKSRDSHRKIRERLKELVRKVRE

SEQ ID NO: 4031 - protein, 176 aa, Artificial Sequence; identical to SEQ ID NO: 4030
  Synthetic

SEQ ID NO: 4032 - protein, 178 aa, Artificial Sequence
  Synthetic
REMEEVLKEAKELLKESNKKAREIDRKIKELLDDSHRKVKETVDRVKRRIEELDRKVKEVKEERLKEELKEEAERVRRDVERLVEELRRENDEILEEHRRLIKELEDENEEVLDRLRKKLRVEEVLREVEKELEDNKRELRESHKEIARELERNKEDIDRLVEEIKRRIEELKKRIDK

SEQ ID NO: 4033 - protein, 178 aa, Artificial Sequence; identical to SEQ ID NO: 4032
  Synthetic

SEQ ID NO: 4034 - protein, 178 aa, Artificial Sequence
  Synthetic
DEMEKVLKEAEDELRRVEKEVREVDKEAEELLERSHRKVRDIVRRVTEELKRLKDKVEKIREERVKKRLKEEIDEVLTRAKKLIDELRKENDDVLRRHRELVKRIKEKLERIREDLERKLRVREMLEKLRREVERVKKEVDDSHREIAKKVERNKKEIDKLVREVEREVEELKKRIDK

SEQ ID NO: 4035 - protein, 178 aa, Artificial Sequence; identical to SEQ ID NO: 4034
  Synthetic

SEQ ID NO: 4036 - protein, 178 aa, Artificial Sequence
  Synthetic
SEVEEVLEDAKRLLKEVEKRVREIDRRAEDLLRRSHEKVRRIDKDVKRLLREVEKKVEEVKEDELKKRLEEELEEILRKHKELAEELKKENEDALKEHEDLIRRLREELEDVLRRLRERLRKEEVLKKVEDDVRRLDEEVRRSHEDIRKKVEDNKKRIDESHEEIRRLAERVKKEIRK

SEQ ID NO: 4037 - protein, 178 aa, Artificial Sequence; identical to SEQ ID NO: 4036
  Synthetic

SEQ ID NO: 4038 - protein, 178 aa, Artificial Sequence
  Synthetic
SEDEKVVKEAKRLLDENRRENKEIDERAEKALEDSHRKVRKIDKEAKELLEKLRRDVEEVKEEELKKELRKELERVLRRHKKLVDDLKRENDEVLKRHRDLVEESKRKLEEILKELEERLRSRELLDKVRREVERLKEESKKSHDRIREELRRNKEEIEKSHDEIRRRVEKLDDEIRR

SEQ ID NO: 4039 - protein, 178 aa, Artificial Sequence; identical to SEQ ID NO: 4038
  Synthetic

SEQ ID NO: 4040 - protein, 178 aa, Artificial Sequence
  Synthetic
SEVEEVEREVRKLLKESNDKVREIDKEAKKRLKDVEDKAREIDERITKLLKDIEDEVRKVKERELKEDLKRKIEDVLRDHERLVRELERELEKILEDHKRLIEELKRENDRVLEELRKKLRKEEVLRKVEKEVEDNKKELDESHKEVKREVEEVRERIDESHKRIRERADRVKKKIEK

SEQ ID NO: 4041 - protein, 178 aa, Artificial Sequence; identical to SEQ ID NO: 4040
  Synthetic

SEQ ID NO: 4042 - protein, 178 aa, Artificial Sequence
  Synthetic
KELEDVLEDVKRLLKESNDEVKEIDDRARRLLEESHRKSEEVDRRAEKRLREIEDKVRKSDKEEVKEELKKEIKKVRDEHEELSRRNTEENKRVLDEHRKLVEELKKKNDDVLRELRKRLRKEEMLREVEERARKNKEDIEKSHDEIRKEVEDNIRRDRESHKRIEEEARRVMAEIEK

SEQ ID NO: 4043 - protein, 178 aa, Artificial Sequence; identical to SEQ ID NO: 4042
  Synthetic

SEQ ID NO: 4044 - protein, 178 aa, Artificial Sequence
  Synthetic
SEVERVLKEADKLLKDNDEKNERVDREVEKLIRDSHEKSKKVDERAKRALDKLDDEVRKVKDEELKRELKERIKKVLEEHKRLSDENRDENRKVLERHKELVDRSKKELEEVLKELRKKLRKEEMLREVEKKVETLKKKSDDSHKEIEEKIRRNIEEDDKSHERIREEAEKLKKKIDD

SEQ ID NO: 4045 - protein, 178 aa, Artificial Sequence; identical to SEQ ID NO: 4044
  Synthetic

SEQ ID NO: 4046 - protein, 184 aa, Artificial Sequence
  Synthetic
ELEELMKKIEDDSKKNDEDTERLVKEIRDRSKRNREESKKLHDEDRREAKRVLDEARRDVRDEEKLKRLEDKLEKILRENAEVHKTSEEKNRRINKRLDDLVREDKKKNEDILRKLRELARRVKREEDVRRAIEEVRRLLEKSHRDSRRVIEEVRRLLEKSHRDNRKVNEDSRRLLKKVREDAE

SEQ ID NO: 4047 - protein, 184 aa, Artificial Sequence; identical to SEQ ID NO: 4046
  Synthetic

SEQ ID NO: 4048 - protein, 184 aa, Artificial Sequence
  Synthetic
SLEDLVREIREESERNKKETRKLLRRIEEESKRNLDESERLHREDKKRLEDIAERLERRVRDEDKLRRLKEELERILKRNKDLVDEDREENERIITKLRKLVKEDEDKNRKIITDLEDVLRKVKDEDLVRKVITEVKRLLEESHKESREVIREIKELLEESHEKSKKVNEESKKLAEDVLRKAD

SEQ ID NO: 4049 - protein, 184 aa, Artificial Sequence; identical to SEQ ID NO: 4048
  Synthetic

SEQ ID NO: 4050 - protein, 184 aa, Artificial Sequence
  Synthetic
SLEELLKKIREESKRNLDETRKLHREDKEESRKNLEESRKLHEEDRREAERVKRRADREVRDEEKLRKLRELLKRILDKNKKVLDDDKRLNEKILKENEERVRDDKETNDRIIEEADEALERVKDEKLVREVVERLRELLRESHERSREVNKRSRDLLRRSHEKSRRLNEESRRLLEEVERRVK

SEQ ID NO: 4051 - protein, 184 aa, Artificial Sequence; identical to SEQ ID NO: 4050
  Synthetic

SEQ ID NO: 4052 - protein, 184 aa, Artificial Sequence
  Synthetic
SADELLKKLRDESEKNKDDTRKLLEELRRRAEKNKKDIEDLLREIEKKLREVLEDIKRKVRDEEKLRRLKEMLERILKRARELVEELKKENDKILKELEDMVEDDKRDNKRIIERVEELRKKVRDEEEVKRAVDEVRRLLEESHKKSREVIKRIKKLLEDSHKKVREIVTELDKLIKEVEKKVE

SEQ ID NO: 4053 - protein, 184 aa, Artificial Sequence; identical to SEQ ID NO: 4052
  Synthetic

SEQ ID NO: 4054 - protein, 184 aa, Artificial Sequence
  Synthetic
DLKELVDELRKKSDDNLKETERLVREIEKRLTDNKRESERLVREIEKELRDLRERIERTVRDERKLRDLERKLKKVDEELKEMHERSKRENEEIRRELKKLVEDDERRNREIKKRVEDLLRKVKDKDEVRKAIKEAEELLKRSHEESRRVIERVRKLIEESHRKNREAIKRIRRLIEEIRKEVD

SEQ ID NO: 4055 - protein, 184 aa, Artificial Sequence; identical to SEQ ID NO: 4054
  Synthetic

SEQ ID NO: 4056 - protein, 175 aa, Artificial Sequence
  Synthetic
SEIEKVREELKELLERDEREVKRVIDDLRRLIKDLRERVKEVNKRDDETVKEIKKVIEERGDTEDVKRLLTENKKRNDRMLERLEKILEDIRERVRRALETSEKTNREIDERVKRKIKVEEVAREVEERSRRVKRKLEELIREIKTELDRVREEIERLSKRDREKNERLREEARR

SEQ ID NO: 4057 - protein, 175 aa, Artificial Sequence; identical to SEQ ID NO: 4056
  Synthetic

SEQ ID NO: 4058 - protein, 175 aa, Artificial Sequence
  Synthetic
SEIEDVLRELKKLLTDDKREVERANRDDERTLRDIRRKVEEAIKKLEDLLRDVKRRVDEEGNTEEVEELLRRILKDVERVLRELEKLIRDNKRRNKEMLDRSRRTNEKIKEDADRKLKVKDVAEEVERESRKVEKELEDLSERDKERNDRILRTIEELIKRVEEEIRKVKEDVER

SEQ ID NO: 4059 - protein, 175 aa, Artificial Sequence; identical to SEQ ID NO: 4058
  Synthetic

SEQ ID NO: 4060 - protein, 175 aa, Artificial Sequence
  Synthetic
SEIEDVLRKLRKLLREDEKRVEDANRRDRDTVRKIEKRSEEAFKESKETNKRIEDKVRKTGPTDEVRKELEDDKKRVDDAHRKSEEDIRRNDKENEEFLEESRKTNEDIKEEVDRKIKVKEVVEEVRDDSRRVEEKLRRLSKEDKEENDKIRRRDRKLVEDLRRDSDRILRKVET

SEQ ID NO: 4061 - protein, 175 aa, Artificial Sequence; identical to SEQ ID NO: 4060
  Synthetic

SEQ ID NO: 4062 - protein, 175 aa, Artificial Sequence
  Synthetic
DEIERVVEEVRELLERDKRRSDEVIERLKRLLEKDEEDVDDVIRRSKETNERIRDKIEKEGPTEEVEKLLRDDKRRVDKLLEDSKRTNDDIVRRLDEAHEESEKTNRDIDEEIERKAKVKEVVDDLKRLSKKVYDDNKELIDRVRERSREVLRRLKELADELRKLSEKIKRDADK

SEQ ID NO: 4063 - protein, 175 aa, Artificial Sequence; identical to SEQ ID NO: 4062
  Synthetic

SEQ ID NO: 4064 - protein, 175 aa, Artificial Sequence
  Synthetic
DDIEEVVKEVEDLLRRDAEDVERAIKELRKLLEDDRDRVRKVNEESRRIIEEIRKAIERRGDQEDVKRAVKEVKDRNRKANDESRRTNTDIKRALDEALKRSRETNKDIEDKIREKAKVKEVVDKLREDSERVKKKAEDLVEEIRRASEEVKKEVDDLSREDEERLEKLKEDARR

SEQ ID NO: 4065 - protein, 175 aa, Artificial Sequence; identical to SEQ ID NO: 4064
  Synthetic

SEQ ID NO: 4066 - protein, 182 aa, Artificial Sequence
  Synthetic
SEAEELEDRIRKLLREVEETSRRILKRARELNKRIEEESRRIIKRIKELIDEIKELVRTRGDDRGVEELLKKVLKEIEEVNDEHRKRIEDVTRKSEKVNEDHRKTIEEMEERLRRLLEDLRRRGIDERLLRKLEREVRRLSEEVTRLDEETRRHSDDLRRRVERLDETTRRELEKLADEVRK

SEQ ID NO: 4067 - protein, 182 aa, Artificial Sequence; identical to SEQ ID NO: 4066
  Synthetic

SEQ ID NO: 4068 - protein, 182 aa, Artificial Sequence
  Synthetic
SEAEELIKRAEDLIREIKKRSDDLVREMERLNEEIKRVSDEIIKRIEEVLEEIKKLVKKVRDDRGVEERVREVKREIERLNDEHRKIIEKVLRESRDVNRRHEEEIRRVLKEIEDLLREAEERGIDRRLLEKLKRELKDLERRVREENERSKRHSEELVRRARKLNEKTDKDLKRLEEETRR

SEQ ID NO: 4069 - protein, 182 aa, Artificial Sequence; identical to SEQ ID NO: 4068
  Synthetic

SEQ ID NO: 4070 - protein, 175 aa, Artificial Sequence
  Synthetic
REIEEVRKEVERVRKRYKDEVRKIVEDARRVLEEHKRRVEKLLEELERILREAKRLTDEGDRREEVIERLKELLKRIKERIERLNKRLREVVERIARDLKRLVEESKRELDRIREEVRDEDMLREIEKAVRELNEESKELLERIEREVRKSEERSKEVIKEIAERARKVVEDTKT

SEQ ID NO: 4071 - protein, 175 aa, Artificial Sequence; identical to SEQ ID NO: 4070
  Synthetic

SEQ ID NO: 4072 - protein, 174 aa, Artificial Sequence
  Synthetic
SEAEKVLTDNRDTLRRLKEELKKVLDENRKTLEELDKRLEEVHKRHNEELDRIRKDGLSEEVLREVEKINEELRKELEDLSREVKKLHEDLEREIRELAKEAEDRHKDLERKVRDTKADERVKEELKRIDEDLKRVVDRIKEKAEDIDRKLKKRVKEIMDKARESLKTLEERVK

SEQ ID NO: 4073 - protein, 174 aa, Artificial Sequence; identical to SEQ ID NO: 4072
  Synthetic

SEQ ID NO: 4074 - protein, 174 aa, Artificial Sequence
  Synthetic
DEMREVLKRLRELVEELRRELEEVLRRNRETLKRLEEELRRVHKEHNDVLKEIRDKGLDEDRLREVTEINKRLKKLLDELRERAKKLHEDLKRLIDELDRRLRELLKRLKERLRDTRVDERMKDELKKILDEARRVVERIDREAKRIDDELREVVERISRDAKRSLDELDERTR

SEQ ID NO: 4075 - protein, 174 aa, Artificial Sequence; identical to SEQ ID NO: 4074
  Synthetic

SEQ ID NO: 4076 - protein, 174 aa, Artificial Sequence
  Synthetic
DEMREVLRELEDELRKIKERLKRVLDRSRELLEEWREELERVHRRNEETLRRIEKNGLSEEVLREADELNKELKREADELLDTYRRLLEESEKEAREIIKTVEELVKRLREELRDTKTDEEIKRRAEDILRELRRLVEELERRNEEINRRLAKRIKELMEKIRREDERLKKEVE

SEQ ID NO: 4077 - protein, 174 aa, Artificial Sequence; identical to SEQ ID NO: 4076
  Synthetic

SEQ ID NO: 4078 - protein, 178 aa, Artificial Sequence
  Synthetic
DKAKRVRTELERRLEKLKRDARKVIEEHEKSLRDLEEEVRRVREEHERSLKELKEELDRKPKREEEKKRLKDEMEESRRRLDKLTEDLKRELDKSRDRLRKIDKELDDSAKKLRDELEKKGVDEDVTRELERVLDELRREVDRVRRELEKIDRELRELVKRIEDELRKINKELKEKSD

SEQ ID NO: 4079 - protein, 178 aa, Artificial Sequence; identical to SEQ ID NO: 4078
  Synthetic

SEQ ID NO: 4080 - protein, 179 aa, Artificial Sequence
  Synthetic
DEVEELVKTVRKLVEDHNRKLEEVVRRLREIVKELEDRTRRALEEARRTVKRIEEEVRKRGKSDKLAEDIRRKLKELEKRLKRVKKELDDLHRDSKKKLDDVKRESEEDLRRIDEALKRVDIDERLLRELKDLLEKSKRRVDELVKEIEKRNRDHKEKVRKIVDEIRRLLRELEERVKK

SEQ ID NO: 4081 - protein, 179 aa, Artificial Sequence; identical to SEQ ID NO: 4080
  Synthetic

SEQ ID NO: 4082 - protein, 183 aa, Artificial Sequence
  Synthetic
KLEEILRRIRELLKRHHEKNKKILDDIREKSKKLKKKVDDILTRITEIIKDLEREVDGRPRDRRLEELKRELRDLLDKLRKRVERIAEEHRRLDEELETKVRKLNEELRKLTKDLEERVREGNDERVLEDLRRKADDIIRRADEESRKIKEEADDIFRRSDELLKRLEDEAKRIADEVRKKTK

SEQ ID NO: 4083 - protein, 183 aa, Artificial Sequence; identical to SEQ ID NO: 4082
  Synthetic

SEQ ID NO: 4084 - protein, 183 aa, Artificial Sequence
  Synthetic
DSDRIEETIKKLLKELSDKSKEVLDEIRKRLKDHHDRNRKVLEEIRRILKRLEEEVRRKPNDERLEELKKRLRELAERLRTEVEEINKRLDELRKELEEKVRRLNEKLKKLADDLRKELRKGNDKRALKEMLDRVRKIIKEYEDSLRRLKEEVDEIIERADRLSEELRRKAEKIIRDITDAVR

SEQ ID NO: 4085 - protein, 183 aa, Artificial Sequence; identical to SEQ ID NO: 4084
  Synthetic

SEQ ID NO: 4086 - protein, 183 aa, Artificial Sequence
  Synthetic
DSEELLREIRKRLEDLSRKSEEIKRRIDEISRDLERKVEEIKKRIEELVRRVRTEADKRPKTRELDRLKEELDRLRRELEKEAEKLMEDHRRLNEELREEVKKINEELKRKTDTLTERLRRGNDRKVLERIREEADEIDKDYDRLLKEIRKKIEDIARDTERRLRELKDRVDKIIKKVEEDER

SEQ ID NO: 4087 - protein, 183 aa, Artificial Sequence; identical to SEQ ID NO: 4086
  Synthetic

SEQ ID NO: 4088 - protein, 179 aa, Artificial Sequence
  Synthetic
REIETVTKKSRDLNREIDKKLKELTERVDKLIEEWKRKTDRVREEAKRAVKEIEDKNVREDEFEKLTRELEKRLEDVKEESRKDKERIEKRLKEAEDDLRRLDKEHREELKEVRERLPETEELRRVIEESKRSNDELKKKADELSKRVKEALDRLEEEDKRVLEEIKDILRELRERRRK

SEQ ID NO: 4089 - protein, 179 aa, Artificial Sequence; identical to SEQ ID NO: 4088
  Synthetic

SEQ ID NO: 4090 - protein, 179 aa, Artificial Sequence
  Synthetic
SEIEEVEKKSRELNRRVKERLDEVEEESRRLNEKWERDTRRVRERVEEEIKKIEERNVREDEARRMLEAIKEDLERAERESERTDEEHRRRLEEVRKEVEDMDRRHREELKRVAERLPRTEKLDEVLKRSEDSNRELKRRAEELLRDSERTNEELRRRDEEVKREVEEKLKELEKEIRR

SEQ ID NO: 4091 - protein, 179 aa, Artificial Sequence; identical to SEQ ID NO: 4090
  Synthetic

SEQ ID NO: 4092 - protein, 187 aa, Artificial Sequence
  Synthetic
SSKEILKEIDERVEELKRRNEKVDREIKEKVKRLEEENEKVDREIKEILKELEKEAEKRPRTEDLERKIREVRDTLRRLHEENKEVNDRMRETVRRLHEKNKRMDERAKEEIEKIKEDIKRLEDKGTTEEVLERLRREVRKRIEDYKRKLDKIARDVDETIERYKRKLEEIKRRVEDEARKIKEEIR

SEQ ID NO: 4093 - protein, 187 aa, Artificial Sequence; identical to SEQ ID NO: 4092
  Synthetic

SEQ ID NO: 4094 - protein, 179 aa, Artificial Sequence
  Synthetic
SRKEELKRRLDEALKKYEADLDELRRRHEEDVRRSKEENERLLKELEDAVRRAKEEVKKAGKDKKDLDRLEEELRKLVEDIKRESEKLERDIDRHHKEIKKHMDKSRDELKKVREEIDRRDDEDRRVEKEIREAIERLKRNLERIKRNIEKVREDSKRVNKELRDKIREIIERIDRRLK

SEQ ID NO: 4095 - protein, 179 aa, Artificial Sequence; identical to SEQ ID NO: 4094
  Synthetic

SEQ ID NO: 4096 - protein, 183 aa, Artificial Sequence
  Synthetic
SRKEKLLDDARKILKRAEEELKRLYDKHRRIIEEVKRDLERLKKEHEDVVRRVEDVLRKRVTEEERVRELKRKIEENHKELKERIDKLKEELDRINEELKKRLDKIKKEADELLRRLKEVADRNEKDDKELEEDIRRIEDRLRRLLEELEKLIEDSMRELKRVLDELEKHIREVDEELEEDLK

SEQ ID NO: 4097 - protein, 183 aa, Artificial Sequence; identical to SEQ ID NO: 4096
  Synthetic

SEQ ID NO: 4098 - protein, 184 aa, Artificial Sequence
  Synthetic
SEAERVKRELDEALKKAKKALEDNKRKLEEALRKHREDAKRWKEELEKALKEAEKAAKDLRRDADKEELDRLREDLERKAKKLKDEIEKINRELEELAKRHEDTNRKLEEDLRRLAKKLREEIEKDGADKEAERKLRELEKRAKEALERSKEHSDELEERARKANKEIEDKLKRLAEEAEKEAR

SEQ ID NO: 4099 - protein, 184 aa, Artificial Sequence; identical to SEQ ID NO: 4098
  Synthetic

SEQ ID NO: 4100 - protein, 179 aa, Artificial Sequence
  Synthetic
SEAEKIKKDLDKIREDLKRLDREAEERVRRLSEELDRKDRELRKRIDEILKRMRDEERSDDELRKEEKKVRDELEEMAEDLRRKNEEIREILKRIAERLKKRNDDVRKRLEDIARKKSVPDEDLKRLEDELRKVEEDNRRTLEELRRRVEEVSRRNKESLEDIRRKLEEAIRRLREKTR

SEQ ID NO: 4101 - protein, 179 aa, Artificial Sequence; identical to SEQ ID NO: 4100
  Synthetic

SEQ ID NO: 4102 - protein, 179 aa, Artificial Sequence
  Synthetic
DGAEEVDDRLKKADEELRRKDKESDEKTKRIAEELRKLLEESKKKTEDLVRRLDEEDQRDELVRRTLREIEEDHERIDRRLKEKEEEVKREHEKIARELEKKNKEIRDELKEIADRNSVPEKRLRELEKKVEDVSRTNKKTLEDNRKKIAEVVKRLDEEIKRNKDTVRRVVERVKKDTD

SEQ ID NO: 4103 - protein, 179 aa, Artificial Sequence; identical to SEQ ID NO: 4102
  Synthetic

SEQ ID NO: 4104 - protein, 180 aa, Artificial Sequence
  Synthetic
ERKERLKERLDEVKKEHERLVERWHRENREVLRENRETVERLERELERVLRELRDALREQNRDEKAEKILRDLERKVRELKERAKRLHDKLEEENREVNKKIKKDSDDLREELEDETRKIKERRDEELEKRIEEVERKLRDTNRKIEELLKRLKKRHEEVDRELERLLEKLEREAEETRR

SEQ ID NO: 4105 - protein, 180 aa, Artificial Sequence; identical to SEQ ID NO: 4104
  Synthetic

SEQ ID NO: 4106 - protein, 180 aa, Artificial Sequence
  Synthetic
SEEEELEKELEKVLRENEESVRRLHKRNRDVLKKNRETLEKLEEDLKRVLERLKRALDRKNTPDEARKIIKRLKEKLERLVEEARELHRRLEEKNRDLNRRLKEKHDRLRKEVEDLRRELKARREKEARDEVRRLKKKMDDVDKDVERLVRELEKEHEEVDKDLRRKLDEVRKELEDARR

SEQ ID NO: 4107 - protein, 180 aa, Artificial Sequence; identical to SEQ ID NO: 4106
  Synthetic

SEQ ID NO: 4108 - protein, 182 aa, Artificial Sequence
  Synthetic
SEEERLEKELDEVLEDHKRRVEEWKKKMDEVNKKHKESIDRLREELDRVLDEVRKAGLDEKKLRELEKKARDLKEKIKKRTEEIKESNKRIKDEIKKLSDDLEKEARDLKREIRDLKRRGEPREEALKRLEELVRKLKEKLERINRRIARIVDKNTKEIKDTNDTLRKEVRDLMKELKDRTR

SEQ ID NO: 4109 - protein, 182 aa, Artificial Sequence; identical to SEQ ID NO: 4108
  Synthetic

SEQ ID NO: 4110 - protein, 175 aa, Artificial Sequence
  Synthetic
REDEEVKKELRKILEDHKRRVEDWKRRLKKNLEEHRRRVEEWKRRLDELLEKVRRAGLPEEVLRELEKVVREIKERIDRLDEEYEDLLRKIEEEAEEMNRRLEELVRELERLIERKDLSEEEIKRVIERLARDARRINERLRELLERLSEISERINREIEKIIDEARERLEREER

SEQ ID NO: 4111 - protein, 175 aa, Artificial Sequence; identical to SEQ ID NO: 4110
  Synthetic

SEQ ID NO: 4112 - protein, 175 aa, Artificial Sequence
  Synthetic
SEKEEVKKRLKDNMRRAEELIRRDDREVEENRKRHDELVKEWDKRLREILKKAEDSGLPEEVKKELKEIVDRIREEMKRLNEEYKRLVEEHKKRNEKVLRDYRDLLRRIEELIERNDLSEKEIKEVLEELSRTSKRLIEDSKRSSERLSERSKRTNEEIERIVRAAKRTIEERER

SEQ ID NO: 4113 - protein, 175 aa, Artificial Sequence; identical to SEQ ID NO: 4112
  Synthetic

SEQ ID NO: 4114 - protein, 183 aa, Artificial Sequence
  Synthetic
SVAEELEERLKEIKRESEKSIRDLRRLLEEIERRLRDINRKLDEIVKRVAEKIKDAETKGAPKEELDKELDKDRRDLERRADESRRELRRLEEEMKKKEKESRDRLDELRRRMEDRLRKNKEVDKKVVDDVERKLREIIRRHEEELKKIKEDLDKIREDHERLLREWKKELDELITRVAESAR

SEQ ID NO: 4115 - protein, 183 aa, Artificial Sequence; identical to SEQ ID NO: 4114
  Synthetic

SEQ ID NO: 4116 - protein, 183 aa, Artificial Sequence
  Synthetic
SVSKKLDDELRKMEREIEKSNETIKKLIEDIRRRSKESRDRLKELLEEIKKRLKEAEERGEPKEELDKKLEKMVRDAKRELDESRKELDKLKKEIEKVLRDSRKKLKKIEDELRRELEENKEIDEKVVEDIERRVEKVLTDHERELERVERELDDIIRRHEEELEKIERELEKIKEDVDRSAK

SEQ ID NO: 4117 - protein, 183 aa, Artificial Sequence; identical to SEQ ID NO: 4116
  Synthetic

SEQ ID NO: 4118 - protein, 181 aa, Artificial Sequence
  Synthetic
DELDRLRELLEELKRRSETVIKEAEELLRKLERELRELIREWKEITERLARRMEDLSRKGVDERTVEKLAREVKEANKRLEDRLREVKKKITRDRERLEKRSEELERRAKEELDKLRKGGLQREDLKRIEEELREILKRHRDANKRIKDEVEELLKRVEEMLRRLHEEDRKLLEDLKRETD

SEQ ID NO: 4119 - protein, 181 aa, Artificial Sequence; identical to SEQ ID NO: 4118
  Synthetic

SEQ ID NO: 4120 - protein, 181 aa, Artificial Sequence
  Synthetic
RETEEVKKDVDRIRKASEDVARKMEKITRDVAKELRDLIEEWRRRSEELKKELEDLSRRGVSKEDLKRVAEKIEKINEDIKRRLEETSRKNEELNRRLKEESDKLAKEVEDRLRRLREGGLPEDELKRIEEELRKILKEHEDKNREIKKENDRLNKEVEEEAEKATREDKRLLEKADRDRQ

SEQ ID NO: 4121 - protein, 181 aa, Artificial Sequence; identical to SEQ ID NO: 4120
  Synthetic

SEQ ID NO: 4122 - protein, 174 aa, Artificial Sequence
  Synthetic
SEKEEIEKRLDKLLKEHEEENDKIRRTLKEINDRSKEEVERIEERLKDLLRRLRERIEPREELKKIEDEVREVIREAREELEKLNRKDREIEKTLKKLSDELRKKVDDLKKELRTDEDTKRARDRLEELRRESEELIKTARDLVRRSEKEHRDLIERLRRILEELREKLERKTT

SEQ ID NO: 4123 - protein, 174 aa, Artificial Sequence; identical to SEQ ID NO: 4122
  Synthetic

SEQ ID NO: 4124 - protein, 185 aa, Artificial Sequence
  Synthetic
SVKEEVRTLLRRLERVSRELIRRLKEMLKTLHEENKKLIDDSRKLIRKIKRDLERVAERRARDEELKDLLRKLEELVRRLKEENDRLTDESRKKLDELRKEIKKLSDELRRDIKELEDRLDEKLRDKDTVKKVKEDLKDILRRHEEANERIRDELRRNLRKHEDDSKKSKEELDRILKKARDDAR

SEQ ID NO: 4125 - protein, 185 aa, Artificial Sequence; identical to SEQ ID NO: 4124
  Synthetic

SEQ ID NO: 4126 - protein, 185 aa, Artificial Sequence
  Synthetic
DIEDELRKELEKHHTKSREVKRRLTELLKRHEDRVEEVERRLRKDLKELRDRIEELSKIREEEMVERARRELKKIKEDVKKETEDVERESEEIEKELRERLKRVEEESRRVEEELRKKIEKNKDLDEKVAREVEERLKRDHDDLRRVIEEIRKRLEDSHRELKKTIEDVKRRVEELIEEAERRMK

SEQ ID NO: 4127 - protein, 185 aa, Artificial Sequence; identical to SEQ ID NO: 4126
  Synthetic

SEQ ID NO: 4128 - protein, 185 aa, Artificial Sequence
  Synthetic
SIREKLREVLERHHRTSRKVEEDLRRKLEDHHRKTREVAERLKEKVDRLREEIKRASRIREEEVVREIEERLKRMKEEIKTLADKVRDTSRRVKEELDRLLEEVERRSEKVERELEKRLRENKDLDERVVRKIEKDLRDDHRRLKEIAKRIDDEARRDIKRLEEIIKKIEEEVDRLIEEVRRRDK

SEQ ID NO: 4129 - protein, 185 aa, Artificial Sequence; identical to SEQ ID NO: 4128
  Synthetic

SEQ ID NO: 4130 - protein, 178 aa, Artificial Sequence
  Synthetic
DKDREIERLAKEAKDRHDKTLEDDRRRLEEVRRKIEETIRRIKKKLDEAKKRLKELVRDKPVEEELEKDVERRLKELEDELRELLRELEERVRESEKRFKELTDELKALIDRLREDIKREGVTEEILKELEEIVRRVEEKNKRLHDENEKDTRRVEAVLEDIKRRIDEIVRRLEERIK

SEQ ID NO: 4131 - protein, 178 aa, Artificial Sequence; identical to SEQ ID NO: 4130
  Synthetic

SEQ ID NO: 4132 - protein, 178 aa, Artificial Sequence
  Synthetic
DEKDRIDKRMKEVLKKIEELIRRDERRLEKVRKDHEELVRRIEDELRRVLEELKKLVEEKEVDKKLEEDVRRVVEEIKRKIEKHHEELERLVRESEKRLKKLLEDAKKELDEIREEIKRDGVTEDIERKIRELEEKVERELKKIHDENEKLAEKARRDLERIEREIDKLVKDVEDAIR

SEQ ID NO: 4133 - protein, 178 aa, Artificial Sequence; identical to SEQ ID NO: 4132
  Synthetic

SEQ ID NO: 4134 - protein, 178 aa, Artificial Sequence
  Synthetic
SEKDKITKTLEDAKRDHRKLVEEDEKALEEVERRHEEIVRRIEEKLKEAKEELDRLVRDKPVPDDLKREVRKLLEDLKRRLKKHHDELRKLVKESRDRLKEHHDRLEEELRRIKDRIRKTGVDEKILREIEERIKEVKENLRRVHEENRELAKKVLKDLERILEEIKKIIKELRERVK

SEQ ID NO: 4135 - protein, 178 aa, Artificial Sequence; identical to SEQ ID NO: 4134
  Synthetic

SEQ ID NO: 4136 - protein, 178 aa, Artificial Sequence
  Synthetic
SKKDEIEETIRRARERIKTIVDRIREELKRIRDKHKKLVDEDKKTLEEVLRTLRELVRDKPVDDRLLREVEKLLEDSKEEIKKHHEELARRLREIEEKIKRLLEEAEKKVEDVRDEIRKTGVTDEILEKVKELVREVEEVLRRIEKEIEDLVRKVEEDLRRIHERNRELAKKADDDIK

SEQ ID NO: 4137 - protein, 178 aa, Artificial Sequence; identical to SEQ ID NO: 4136
  Synthetic

SEQ ID NO: 4138 - protein, 178 aa, Artificial Sequence
  Synthetic
SKEEEIEKTLKKIEEDHRELVRRIERALDDARRRHKELVDRDDKELRDAERELDRLVREKPVPEELKERVKRLVKESKEEIDRHHKELEKRLKEIKEEIDKHHRELKERLDRIRERIRKDGATEEILKEIRDLADEARRNLERILRDIERVVEKVERDLKRIHDKNKRDVERVRREVK

SEQ ID NO: 4139 - protein, 178 aa, Artificial Sequence; identical to SEQ ID NO: 4138
  Synthetic

SEQ ID NO: 4140 - protein, 178 aa, Artificial Sequence
  Synthetic
KEKDDIDRDLKRAEEEHKRLVDEIRETLKEIEREHRERVKRIKEKLDEAKRRLEKLKRDRPVEDKLEKDLERRLREIEKKLRKHHKEVKDILRAIEEEIRRHHRTVRERLRAIRERIKKDGVTEKILEDIKREVDRVRKNLKEIKEKIDKEREDVKRDLDRIRKEIEELVEKVDRDVK

SEQ ID NO: 4141 - protein, 178 aa, Artificial Sequence; identical to SEQ ID NO: 4140
  Synthetic

SEQ ID NO: 4142 - protein, 178 aa, Artificial Sequence
  Synthetic
DKARKIEEDIRRAEEEHKELVKRNEERIKEVAERHEETVRDIERKAEDIRRELKKLVDEKPVPEELKRDFEELIKELREELRRHHEKMKRLLDEMRKRHKEHHDRVRELSKRVKDDIDREGVTKEILDEVKKLVDEVRANLEKSHEDIERLVEKVREDLKRIEERLRKIAEDLRRRVK

SEQ ID NO: 4143 - protein, 178 aa, Artificial Sequence; identical to SEQ ID NO: 4142
  Synthetic

SEQ ID NO: 4144 - protein, 178 aa, Artificial Sequence
  Synthetic
EEEREIEDTIRRAEEEHRKRVEDNKRRLEEAEKEHRKRVEDNKRRAEEIRRKLKELVDRKEVDERLDKRADEVLRRLEKRHRDHHEDLKKKLDDLRREHEEHHRRVKELERRVKEEIRREGVTEEILKKVKELVDRVRRNLERSHEKIKRIEDKVRRDLERSHKELEDLMRRMEEEIR

SEQ ID NO: 4145 - protein, 178 aa, Artificial Sequence; identical to SEQ ID NO: 4144
  Synthetic

SEQ ID NO: 4146 - protein, 175 aa, Artificial Sequence
  Synthetic
EKKERIEERAKEVEREHREIVKRDEEELERVREEHEESVRRDRKALEDVERDVRRDGIEKEVLDEIKKRLERSREKLDKLSRDVEKELEESKRKLEKLSRESKKKLEDLRRELTRGEVPMEDMLRKVKEVADENRERLKELHEENERTARRLRKLNRELHEENKRLVEEIKKEAK

SEQ ID NO: 4147 - protein, 175 aa, Artificial Sequence; identical to SEQ ID NO: 4146
  Synthetic

SEQ ID NO: 4148 - protein, 175 aa, Artificial Sequence
  Synthetic
SKAEEIRKELDRVRREIEKRAEEDKRTLEEVRREHEKLVRENEETIKRVEEDVERAGIDEKKKREIKEALDDLRRKHEKLSRESEDAIRRSEKELRDLKEEIDRLLDRLRRILDEGRVPMEDALREIKEVADEVRKKLRELHEKNKKLMDDNRRKLDKSHKDVREVEREIRERIK

SEQ ID NO: 4149 - protein, 175 aa, Artificial Sequence; identical to SEQ ID NO: 4148
  Synthetic

SEQ ID NO: 4150 - protein, 175 aa, Artificial Sequence
  Synthetic
DKERRIEEELEKARRDHKEDVDRDRERLKEVREEHERLVRENKKRLEEIRKELEDRGIERELLEEARKLLEDLKRKHEELSRRSEELIKRSEEKLKRLSDESERLLRELREKLKRGEVPMEDLLREVKRVVEKNKEDLKRLHDENEKLAEENRRRLKKSHDEVEKVAEDLKRKAK

SEQ ID NO: 4151 - protein, 175 aa, Artificial Sequence; identical to SEQ ID NO: 4150
  Synthetic

SEQ ID NO: 4152 - protein, 175 aa, Artificial Sequence
  Synthetic
EKKERIEDDLRRVKEEIDDLLRKNEKRLREAEDEHRKRVEDDRRRLDEVRKEVDDEGIDERVKREIERLLRESEEELKKLSDESRRTMKKLRDKHREDEEDIKRLLEELKRELDRGEVPMEDALRKLKRVADEIRKRLDESHKEIKKVVDDNRKKLEELHRKNRELERKIREDAR

SEQ ID NO: 4153 - protein, 175 aa, Artificial Sequence; identical to SEQ ID NO: 4152
  Synthetic

SEQ ID NO: 4154 - protein, 171 aa, Artificial Sequence
  Synthetic
KDEERIKKKLKKLVDENRDLNRRIEETNRRVAEDLDRRLKEIEKRNRDMAEELRKSDRSRETVKEMLKRLEDEDRKLSKEIRDRLRDLEREDERLHEEDKRHLERVDEELKRSNIDDEIRKRAEDAERETRETNRRIRDHTRRVAERVEKVLDEIRRHTEEVKKEVDEKER

SEQ ID NO: 4155 - protein, 171 aa, Artificial Sequence; identical to SEQ ID NO: 4154
  Synthetic

SEQ ID NO: 4156 - protein, 171 aa, Artificial Sequence
  Synthetic
SDEERIKDKLEKLVKENEDKNRRILEENKRVADENRRLNEEIEKRLEEMVEELERRDDSEESVKKALDDLEKELRDLNREDREHLRKLSEDLRKMKEEDKKHAEDVRRDLERANIDEEIRKRVKEAEDKTEETNRRIEKHHREVKKESEESNKRITDRLEEVKERVTRKRK

SEQ ID NO: 4157 - protein, 171 aa, Artificial Sequence; identical to SEQ ID NO: 4156
  Synthetic

SEQ ID NO: 4158 - protein, 171 aa, Artificial Sequence
  Synthetic
KREEDIKRRLEKLAKENRERNEEIKRRLDELVDRNREENEKILRELEKMVRELERSDRDRSVVEKELRDLEERIRRMHERDKEDLRRIEETLRELKERDKRHLDEVEKRVEDDNLDEEARKRLEELKKETEDTNRRIDEAVERAKEETRRTNERIKEELKRVKKKVTDKRR

SEQ ID NO: 4159 - protein, 171 aa, Artificial Sequence; identical to SEQ ID NO: 4158
  Synthetic

SEQ ID NO: 4160 - protein, 178 aa, Artificial Sequence
  Synthetic
SEVETAKEDLKKKVEENEKRIKDVEDKLRKTVEDNRKRLEDVLEELRRSVETLRDLLRKGTREEELETMLRDHRRKDKEVEDENRKSIKEHREENRRVEEENKKSKEELRRRLEDLRRKGVVDEELEKRLREAEEKSDRLLRRLKEESRKAEEDSKRLLKELKEESRRAEEEVRRARD

SEQ ID NO: 4161 - protein, 178 aa, Artificial Sequence; identical to SEQ ID NO: 4160
  Synthetic

SEQ ID NO: 4162 - protein, 178 aa, Artificial Sequence
  Synthetic
DEKEEAKERLKELRRRLEETDKRVDEELEKLMREMEDTDRRVKEKVDRSRREADEVLRRGTDDETLKRLKEKHERDDKDIEDKNEELERRLERRLREIEKRNRELNERAKRELEDLERKGVVDEELKRRLRKVSEENKESNERLRRKVKRVVDENRRTNKELKETSKKVKEDIERKRK

SEQ ID NO: 4163 - protein, 178 aa, Artificial Sequence; identical to SEQ ID NO: 4162
  Synthetic

SEQ ID NO: 4164 - protein, 181 aa, Artificial Sequence
  Synthetic
SELEEVTDRLRKLAEKARRLDKEYEEKSRKLKEEVERIDEDLDRLLKELTDEVREIAERGTDEEVVKDLKRKLKKLKRDIEELHKRLHDRNRELERELEEIHRRLREELDKLRDDIRKAGLPEEALRRIEKEIREVEKENRDTLERLRRHDEEVNRTNKETLDRLDEKLKRVEREIDERRK

SEQ ID NO: 4165 - protein, 181 aa, Artificial Sequence; identical to SEQ ID NO: 4164
  Synthetic

SEQ ID NO: 4166 - protein, 182 aa, Artificial Sequence
  Synthetic
DEEEDLKEKVKKVETEHEETLKEIRRKLEDVKREHEKTVEEIRDHNRKVEERIRDVERRKDDKSRELEERSERLKRKLEKHNRELDELSKELEELIERLKRDIDRVTEEVRRKLRKLERDVDREGATERIRERLEELMRDARRLNRELDEKVRKLVEKARRDNTRVKKKSRELMKEIDDELR

SEQ ID NO: 4167 - protein, 182 aa, Artificial Sequence; identical to SEQ ID NO: 4166
  Synthetic

SEQ ID NO: 4168 - protein, 182 aa, Artificial Sequence
  Synthetic
DEEEELKERIERVKDENRRSVERLRRELKRVEDDHRETVKDLERRLREVKKEIEELVRRKDDRDERLKKILKELEEELRKLKEDIDRVSKELKERIEELKKRVDRIHKELKKKAEDLEREVRRDGATEELKKKLEELMKEVRDLDRELKREVEELEREIRRLNKEIRERIEDLVRKAREAIR

SEQ ID NO: 4169 - protein, 182 aa, Artificial Sequence; identical to SEQ ID NO: 4168
  Synthetic

SEQ ID NO: 4170 - protein, 182 aa, Artificial Sequence
  Synthetic
REEEELKKKLDDVRRENEESVKKIKEDIDRVRREHEKTVEEIRRHNKKVEEEIRAEVRRKDDRDSRLERILRELKRLLEEHNKELDELSERLERELRAVEEKIERIHDDLARKLEKLAEEIKKDGADDRIREEIEKLAEEIRRLDERLEEELREIVRKMRELNRRVAEKSKELTEDARRRLK

SEQ ID NO: 4171 - protein, 182 aa, Artificial Sequence; identical to SEQ ID NO: 4170
  Synthetic

SEQ ID NO: 4172 - protein, 178 aa, Artificial Sequence
  Synthetic
SEREEIRERLRRNLEELRKSIKKIEDDLRRLEKRHRDAVKEIEDRLRRLEEKLDEMAKRDSDEETVRKIKEEVRRKVEKIKEEIRKHHEEIEERLRRIRKELKEVEDEHRRRVEKLERDDLPREDVKRAVDEIHKHTKEKEDRLRKLLKDLEKNIEDAIRRLEKLLRDLEEEIKEAAK

SEQ ID NO: 4173 - protein, 178 aa, Artificial Sequence; identical to SEQ ID NO: 4172
  Synthetic

SEQ ID NO: 4174 - protein, 181 aa, Artificial Sequence
  Synthetic
EESERILEKIRRAAEEDKERIRKAIEELRKLAEEDERKLRKANKEARDSARELRRLLKEGLDREEVKEVRERHRRRSDEVHRENEEERRRVDEKLKRVHEENRKIEETLKRELEDVLRKTGEAEVVEEARRLIKKWREEVERLNEEIKKLVEDWDRRVKELNERHRDDDRKIEKEVEDEEK

SEQ ID NO: 4175 - protein, 181 aa, Artificial Sequence; identical to SEQ ID NO: 4174
  Synthetic

SEQ ID NO: 4176 - protein, 181 aa, Artificial Sequence
  Synthetic
SELEKALEEIKRLAEDDMRRIKKVIKELEKLARDDEKRLREVIERLETEVRKLEELLKRGLSDEEVRRILERIKRELKRVHEENERITRKVETDLRKVHEDNKRSLEELKKKLDDLVRKTGDTEVVDELRKRLKEVKERAEDLNRKLEELIRRWKERVERLNRELEKRMRDVEEKVRREEK

SEQ ID NO: 4177 - protein, 181 aa, Artificial Sequence; identical to SEQ ID NO: 4176
  Synthetic

SEQ ID NO: 4178 - protein, 181 aa, Artificial Sequence
  Synthetic
SDLEKILEELKRLAEEDKRKLEEVIKKLEEAARKDAEDLKKVNEEAKKSARELEELLKRGLDRKEVREAEERHERRSRDVHRRNREKKDRVTKELRKVHEDNKRSLEELKRKVDDAVRRTGDAEVVREIEELLKKIEEEVRRLNEELKRLADEWRREVRRLNEEHKDTDRRIKERVKRAEE

SEQ ID NO: 4179 - protein, 181 aa, Artificial Sequence; identical to SEQ ID NO: 4178
  Synthetic

SEQ ID NO: 4180 - protein, 181 aa, Artificial Sequence
  Synthetic
KDMERMLKEIEDLARKLREELKRVLDELRKTAKRDEEELKKVNKEAKESARELEEKLRRGLSREEVEKDVRDHRKKSEEVNRRNRERRKKTREDVERVKRETRRKEEALERRLKEVVDRKGDTEVVKELRKLLKKIKDDVRRLDKELDELLRRWEESVERLNREHKKTDEKVEEDVKRTTT

SEQ ID NO: 4181 - protein, 181 aa, Artificial Sequence; identical to SEQ ID NO: 4180
  Synthetic

SEQ ID NO: 4182 - protein, 182 aa, Artificial Sequence
  Synthetic
SEEEKVEKELRDLVREDDRRLREVEERVRKVVKEAEDDHRRVKEDIRRMVEEIRKKLDKDGKSDRIARELDELLKRLEERLREVEKRSKELNEKLKREIEKVHEENKKLLDEIRKRLEDATRRGTSSERLEDEVRKVEDRSRRMNERIDERLKRVEEESKKAIEELRRELERVKREVEERKR

SEQ ID NO: 4183 - protein, 182 aa, Artificial Sequence; identical to SEQ ID NO: 4182
  Synthetic

SEQ ID NO: 4184 - protein, 182 aa, Artificial Sequence
  Synthetic
SEVEEVKKELEKLAREDEKRLEDVKEEVKESARRDKRRLEEVEEDLDRLVKELEDKLRDDGKDDKLKKEVEDLLRKLEERLRRVHEENKKILEEHKRRSDKVHEENKETLKDIRRRLKEAEDRGTSTDELKRKLKRVEERSREVNRELRERDKKIEEDSRRINKRLKKKVDEVKEKVREDTR

SEQ ID NO: 4185 - protein, 182 aa, Artificial Sequence; identical to SEQ ID NO: 4184
  Synthetic

SEQ ID NO: 4186 - protein, 182 aa, Artificial Sequence
  Synthetic
DEEEDVRRKLEELARRLKRRLEEIEKRLRDSVKEDRRKLEEVKEKLRELIKKLEDEIRKKGTDRRLRDEVKKILDEIKEEITRVHEDNKRRLKEHKETSEKVKREIEDALRKIEDELRKAEERGTSTEKLKEDVERVKRDVRRVIRELEKTDERIERESRKVNEELKELVERVERSVKKADE

SEQ ID NO: 4187 - protein, 182 aa, Artificial Sequence; identical to SEQ ID NO: 4186
  Synthetic

SEQ ID NO: 4188 - protein, 182 aa, Artificial Sequence
  Synthetic
DEDREARKKVEALLKEVEDRVRESKKRTKDLLREIEKRLRDTTREIDELRRRIEDLSRRGEPKEDVLRELKKKLEELLRKDEKINRDLRRKLERLRREHEKILKRLEELLKELEDELREAGLPEEVLRELKELLDKIRETIERASKENEELLREIEKRIEDANRENTERLRRIEKRIDDDAR

SEQ ID NO: 4189 - protein, 182 aa, Artificial Sequence; identical to SEQ ID NO: 4188
  Synthetic

SEQ ID NO: 4190 - protein, 171 aa, Artificial Sequence
  Synthetic
SEKDELRKRVEDIKETAKKVVEELREASRKIHEDNKRVNDRLRKESKRIKDKADKLDIPEESLKRLKKEHEDTDRRIRETDKKLNDDHEDKNRKIEEELDRLIKEIKERDERKPVDERAREEVRRIEKTIRDTARRVRERVRDSERRFRKLVREWEKLVEDSERKIDELSK

SEQ ID NO: 4191 - protein, 171 aa, Artificial Sequence; identical to SEQ ID NO: 4190
  Synthetic

SEQ ID NO: 4192 - protein, 171 aa, Artificial Sequence
  Synthetic
SAKEEIKERVKRIEERLRRLLKELEEKVKRIHDENRKVNKELTDRSKEIKDRLKDLDIPEEALRDLDRRHDETNKRIREEDEKLNREIKERLERLKRKAEKLREEVEERDKRKPVSEEVREELKRIEERLDRTLREVRKTLEDIERRIRKAVEDWRRLVKESEERVKRLTD

SEQ ID NO: 4193 - protein, 171 aa, Artificial Sequence; identical to SEQ ID NO: 4192
  Synthetic

SEQ ID NO: 4194 - protein, 178 aa, Artificial Sequence
  Synthetic
SEEERVRKDLKELHEHLKREVDKARKDLEDMHRHSEELAREVRERHERSKRELDELERRGTDEKTIRDVERKNRDTNRRIREEMERHKKKLDEILERIRKSLEDHTKRVREVLKELAKENVKSEEIEERVRRNEDTLRRVLKELRERAKRNKDDIRRVLKELEDRSREIEKKLREAER

SEQ ID NO: 4195 - protein, 178 aa, Artificial Sequence; identical to SEQ ID NO: 4194
  Synthetic

SEQ ID NO: 4196 - protein, 178 aa, Artificial Sequence
  Synthetic
TEEERARETLDRLNKHSKELVDRVREKLKRLVEHSRELLRRVDRKHKESEKRVREVSRRGADSKTMREIEKDNDRTNKEIKERLDRHKKKLDEILEEIRDELRRHKEKLDRILERLAENNVKTDEIERRVERNKREIDKVLKELEERVRTNKDEIDKALEKLKRLSEEIKRKMREDET

SEQ ID NO: 4197 - protein, 178 aa, Artificial Sequence; identical to SEQ ID NO: 4196
  Synthetic

SEQ ID NO: 4198 - protein, 178 aa, Artificial Sequence
  Synthetic
KEKEELDETIRRLEEHSKKKVDKVRKELKEMDEHSRDEARRVRREHEKSEEKVRRASEEGRSKEVMKRLKEENRDINRRIRERVKEHKRRLDEIEERIRRTVEDHKRKVEEVARRVRERGVESEEARERLRKNEEEIKKVLEELERRVRENKERIDDVERELEDLSRKIEEKLDRDDT

SEQ ID NO: 4199 - protein, 178 aa, Artificial Sequence; identical to SEQ ID NO: 4198
  Synthetic

SEQ ID NO: 4200 - protein, 178 aa, Artificial Sequence
  Synthetic
KEEEEARRTLERIERRIRKALKEIDETLKRLNDHSAKRVKEVREKHEESRRKVDDVSRRGTDDDVARRLKRENDEINKRIEDTVRDHKRRLDKILKDIKKRLDDIKRDLDRVAKELRERNVQTEEIRERVKRIKEEMDRALKRLKDKVKENKERIDEVLKDLRRTSKEIKERLDRSTK

SEQ ID NO: 4201 - protein, 178 aa, Artificial Sequence; identical to SEQ ID NO: 4200
  Synthetic

SEQ ID NO: 4202 - protein, 174 aa, Artificial Sequence
  Synthetic
SKKEELERLLEEAKKKHEESERRLRESSKKLEEEIRRMKEHSKKSSEDAEDKLRRNRASEELLKEVKKMNEELKKKHEDLEREIEESNRRIEEKLKRNKDKSRKEEEDVRKILEDGDTGDELLERIKDLVRRSEEENKKLLDEHRKIVKTLKERLEKLNEEHERIVREVERRTR

SEQ ID NO: 4203 - protein, 174 aa, Artificial Sequence; identical to SEQ ID NO: 4202
  Synthetic

SEQ ID NO: 4204 - protein, 174 aa, Artificial Sequence
  Synthetic
SSEDELRRLLKEARDTHRESEKRLRDSSKRAEDMHEKSKEDVERSSRELEKELRRRRADEELKRKVKEKNDEIKKKLEDNEDKSRKENEKLRDKLRKNKEESDRLVKRLEDIARRGDTGERLLDEVRKEMKRSEEENRRLLREHEEVVKKSIKENKELLDKHKEIEDRLREEIR

SEQ ID NO: 4205 - protein, 174 aa, Artificial Sequence; identical to SEQ ID NO: 4204
  Synthetic

SEQ ID NO: 4206 - protein, 174 aa, Artificial Sequence
  Synthetic
SEKETLKRLLDEIKKRHKESEDRVRKLVEDAREELDRVADELRKSSEDLRRDLKRANADEELKKKVEKLNRELEKKLRDLRRRMKEEEEELRRKLEENKKESDERVKRLEKIAKDGDTGSKLLREVEKLMEESRKRNEDLLKELRDIIEDLREKLRELLREHREAAKRLRDEIR

SEQ ID NO: 4207 - protein, 174 aa, Artificial Sequence; identical to SEQ ID NO: 4206
  Synthetic

SEQ ID NO: 4208 - protein, 174 aa, Artificial Sequence
  Synthetic
DERETLEKLLKEVRDMHEESKKRLTDSSRKLREDLRRVKEELDKTLRDIEERAKEENISEELKRKLDDLKRRLKEKVKKIEDEVEEKNERIRKKVEENETKSAEIEKRLRDIVRRGDTGSRLLEEAKKLIEESKRENEELLKEHDKIVKELIKKLRDLLKEVEDRARDVTEEAK

SEQ ID NO: 4209 - protein, 174 aa, Artificial Sequence; identical to SEQ ID NO: 4208
  Synthetic

SEQ ID NO: 4210 - protein, 174 aa, Artificial Sequence
  Synthetic
SSRETLDELLRRAEEIHRRSEEELRRSSEEVRRKHEKSERDLEKLLRDAEELLRRENVSDELRDEMRRKVEEVKKKADRNREESEDSNRKVDEDVKRNKEKSRELVKELRKIADAGDTGDKLLDTVRKLVETSRDENRKLLEDHKKMVKESEDRNRELLRDLERVIEELSRRIR

SEQ ID NO: 4211 - protein, 174 aa, Artificial Sequence; identical to SEQ ID NO: 4210
  Synthetic

SEQ ID NO: 4212 - protein, 179 aa, Artificial Sequence
  Synthetic
SEVEEILDRLRREVERSKKKVEDILRELKKLAEDTKEKVERVLDRNRKTIEELKKARLPDEELERALRKDRDELRRIKEDLERRHEEIARRVKEVEDRLRKEHERLEKELREVERDLKISEDLVTKLRDLLRRHHETLRRLAKELRDLLKKHHEELRRLIERLEKSLEDLERELDKTRR

SEQ ID NO: 4213 - protein, 179 aa, Artificial Sequence; identical to SEQ ID NO: 4212
  Synthetic

SEQ ID NO: 4214 - protein, 179 aa, Artificial Sequence
  Synthetic
SEVEKILEDLKKLIKESKDEADRILTDHRRLVKETEEEARRALERNRKTVDDLRKANLREDELRDALRRDEKELEDIVRRLRKLHEDLHRKLKKVTDKLRELHEELKRRVEEVERDLKISEEALRELRRLLKEHHEILRKVEEELRRSDEEHHRRLEEVERRLRKSLRELEETVRETTR

SEQ ID NO: 4215 - protein, 179 aa, Artificial Sequence; identical to SEQ ID NO: 4214
  Synthetic

SEQ ID NO: 4216 - protein, 179 aa, Artificial Sequence
  Synthetic
SEAERILEKLDRLVKETDRRVKEVLEDNRRTVRRLEEEVKRILKENRETARELEEANLPKEDLERRLRRDEEELRKMVEELRERLKRDAEKLEKIKRELRELHERLKRDVEDVTRRVKLDEEVLRRLKKLLDEHNERLRRLERDLDRSLKEAKETLDELERRLEKSLRELKESVDRTRK

SEQ ID NO: 4217 - protein, 179 aa, Artificial Sequence; identical to SEQ ID NO: 4216
  Synthetic

SEQ ID NO: 4218 - protein, 177 aa, Artificial Sequence
  Synthetic
SSEERLKEEFKRAAEKVRKVEEELRELHERVEKSSRDSKRRIRELLKRAEEEVKRVEDRGTDRRKKEEIKRVVDELRKDVRRVEKENDEELKKHNEDLKRVTDEIRKILKEMKEELDKRGASDEVLRDLKRLIEELEDKARRVLDKSRRIIERLRRKDEEVLRKLEKEIRELKKKAN

SEQ ID NO: 4219 - protein, 177 aa, Artificial Sequence; identical to SEQ ID NO: 4218
  Synthetic

SEQ ID NO: 4220 - protein, 177 aa, Artificial Sequence
  Synthetic
DEERELRRLLEDVKRRVREVEEELRRLHEEIKRTSKRSKEELRKLHKELEDAVREMAKRGTSKEKLDELRKELKKHNDRLRKVEEENDRKLERHNRRLRKVERELRELVKKLEEDVRRRGASDKVLRDLEELVKELKRRLDEVLETSRREAEKLKRDDEKVLRESKKIMEDLRRRAE

SEQ ID NO: 4221 - protein, 177 aa, Artificial Sequence; identical to SEQ ID NO: 4220
  Synthetic

SEQ ID NO: 4222 - protein, 177 aa, Artificial Sequence
  Synthetic
SEEDELRKLLEELRRRSKEVNDRLRKLHDELRRRVEDLKRKLRELHKEAAKIVEEMKARGTPEEKLRELEKSLEDHNRDLKRVEDEIDDKLRRHNEILKEVHKRDRDSLRRIEEEVRRRGASDKVLEDLRRLVEENTRRLEEMLKRSEKIARDLLEDVKRFLDESKKKIDTLRRRAE

SEQ ID NO: 4223 - protein, 177 aa, Artificial Sequence; identical to SEQ ID NO: 4222
  Synthetic

SEQ ID NO: 4224 - protein, 177 aa, Artificial Sequence
  Synthetic
SLEDELRRLLTEAEKRSKDVNERLRDLHREVRELSEDVNRKLEELHRELEERVKELKREGRDEEELRKIEETLKRHNEELKRVHERDRDTLREHNEKVKKVHDDDRRSLEELRERLKREGASDEVLKKLKELVRRNEEELEKALKESKDIVEKNKRDLDEVEKKSREIVRELIERTK

SEQ ID NO: 4225 - protein, 177 aa, Artificial Sequence; identical to SEQ ID NO: 4224
  Synthetic

SEQ ID NO: 4226 - protein, 177 aa, Artificial Sequence
  Synthetic
SLEETLEKLLREAEDISRKANKRLEEAHERIKRTLEDLERKLEKLNKEVRDRVERVKERGTPEEKLKDIERRLREHEKRSKEVRERLREDLEDHNRDLKRVHDEDKKSLDRLREELERKGVSDKVLEKLKRLIEENKKRLERVLEKSDKILDDLRRKVEEVLKRLEKTVKDLEDEAR

SEQ ID NO: 4227 - protein, 177 aa, Artificial Sequence; identical to SEQ ID NO: 4226
  Synthetic

SEQ ID NO: 4228 - protein, 179 aa, Artificial Sequence
  Synthetic
SEDEELLRRLEETIRRATERVKRLLDTLRKLAEDVRKELERLLDTHRELAKRIEDELREGRSKEVSDKVREENKEHHKEVERRLREIEERIRRHHKKVDEILKEIEKRLKEIIEEILRTRGRTPEEVERVLREVTKRLRDLKREHRKLLEKVKRELEKVEEDHRDSSRKLEEIIKEAEK

SEQ ID NO: 4229 - protein, 179 aa, Artificial Sequence; identical to SEQ ID NO: 4228
  Synthetic

SEQ ID NO: 4230 - protein, 182 aa, Artificial Sequence
  Synthetic
SEAEKLAKDIREAAKRLREHAERDKEELKKAADKLRDEARRDAEKLKRAAEKLKDLARRTGNTEELEKEAREIHERNKRNLERLEKEAREIHEENKKNLERLDREAERIEKEVRDAVRREQLDEEAAKRIKELLDKARKDLEDAKREAEELNRRAREELEKAKKDAEDLNRRAKEELDKARK

SEQ ID NO: 4231 - protein, 182 aa, Artificial Sequence; identical to SEQ ID NO: 4230
  Synthetic

SEQ ID NO: 4232 - protein, 182 aa, Artificial Sequence
  Synthetic
DDKDKLLEELRKVIEELEKKLEDNNRELEKVLEKLKREAERDLERLREMIRRLEELLRRDGPTEELRKDVERIHRENRENLKRIKKEVDEIKEKSKRSLEELKKEVDKIEEDLERLAREKNLSEEVLDRLRRIIEELRERLKRAEKSNRDILERIDRELEKLKRRAEELNEELRRRLKERRD

SEQ ID NO: 4233 - protein, 182 aa, Artificial Sequence; identical to SEQ ID NO: 4232
  Synthetic

SEQ ID NO: 4234 - protein, 182 aa, Artificial Sequence
  Synthetic
SRTEEVLKELRTLMRELRRRLEEVIKELEKSAEELERIAREVAKRSRKVIEELKRKADKDGTSDRLLEEVDKLLEEHNEELERVKKKLTDDLREHRRRSKEVKERLEKKLREIEKRLKEVVDRDGPREELEDLLRRIRETLEDMKRRLDELDTELEKRLREVARTLDELHKELEETLRRLKK

SEQ ID NO: 4235 - protein, 182 aa, Artificial Sequence; identical to SEQ ID NO: 4234
  Synthetic

SEQ ID NO: 4236 - protein, 175 aa, Artificial Sequence
  Synthetic
DAEDELRELSKRNKDEVREVKERLKKLSEENRRDLERVKRKLEKDSEENREALERENKENKEVVDRVEKVHRDIEERVKKIKREVDKLHREVEEEVERIERDLERVHRELEEDVKREGVTEELKKRIEELIRRSRKLAEDLKKKLEDIHRETERLVRELAELVRDLHRRTKEKAR

SEQ ID NO: 4237 - protein, 175 aa, Artificial Sequence; identical to SEQ ID NO: 4236
  Synthetic

SEQ ID NO: 4238 - protein, 175 aa, Artificial Sequence
  Synthetic
SAEDRLRELSKRNREEVEEVEKRLRELMERIRRRLREVKEDLRRLSEENRKTLERKNKDQRELVKRVEEEHRKIEEEVERTERRVEKVLEDIEREMDRIKKKLEDDHRKLEDEVRRRGVTEEIEERIKRLIKESRDLARELEEKLRKLLEELEKLAKRLREKVKELHDDTERAAK

SEQ ID NO: 4239 - protein, 175 aa, Artificial Sequence; identical to SEQ ID NO: 4238
  Synthetic

SEQ ID NO: 4240 - protein, 175 aa, Artificial Sequence
  Synthetic
SEEDELRELSRRNEEEVKKAKRDLEKLSRENEEDLKRVKRKLEKKSEDNRRILERDNREAEEVVRRVEERHKELRKRMEEIEREIRKVHEELRREVEEIEKDLRRVHDEIKKEIEDKGVTEEVKKKIEDLIRRSRELVERLKRKVEELHKTTKRLVEELEKTIDRIIEETRERAR

SEQ ID NO: 4241 - protein, 175 aa, Artificial Sequence; identical to SEQ ID NO: 4240
  Synthetic

SEQ ID NO: 4242 - protein, 183 aa, Artificial Sequence
  Synthetic
SAEDELRRLLRENRERNKKADKDIKKLLDDNRRDLERLRRELERILREIEKRLKDVEKDVEGRRLEEIRKRLERLRREARRELERLERHNRELLEEHKRKNEENEKHNRELEKEAEELSRRGTTEDVVRELMKKVDDDHKESEKLVRESEEKLERDNERTRRIADKLRKELDDTREEIERDAK

SEQ ID NO: 4243 - protein, 183 aa, Artificial Sequence; identical to SEQ ID NO: 4242
  Synthetic

SEQ ID NO: 4244 - protein, 181 aa, Artificial Sequence
  Synthetic
DSEERAEDVARENKEILERVDEKARKLLDDNRKVVEELKKTNEESSRELKRVLDELNIDEDLLREIEKLNRTLKKKTEDLAKDNKKIDDDLRRELEELKRENKEKDKRLREELEDLKRKGSSEETVEELLKKMRAISRDSERKVKELLDKIRELSDRSRRRAEELNKEHKKIVDDIAERRR

SEQ ID NO: 4245 - protein, 181 aa, Artificial Sequence; identical to SEQ ID NO: 4244
  Synthetic

SEQ ID NO: 4246 - protein, 181 aa, Artificial Sequence
  Synthetic
SVEERLRELVKENRDVVRRAEEEFRRLVEENKRILEEIDRRARESSRKLKDVLDKLNIDEDALRRIEERNKDVERKLEELKKRNKDKDEKLAREIEKLKAENEKEDRDLEREVRDLKKKGSSEETMERLLRKAKEISRRSKERLKRLLDKVKKLSEDSERELKKLLDEHEKIVEDIEREAR

SEQ ID NO: 4247 - protein, 181 aa, Artificial Sequence; identical to SEQ ID NO: 4246
  Synthetic

SEQ ID NO: 4248 - protein, 181 aa, Artificial Sequence
  Synthetic
DDERRLREVSDRNRRILDRIKKEVERLLDEVRKILKEAEDRLRRSSERLEELLRKDNIDEDKVREIRRLNEEIRKKVEELRKEIRDLLEELRKRADKLTEENKDTDDKLRRRAEDLKRKGSDEREVKKTLDEMRRRSRESEEELKKLLKEIKEIVEELKRKLDTLLKEHKEIVEEIKRRTT

SEQ ID NO: 4249 - protein, 181 aa, Artificial Sequence; identical to SEQ ID NO: 4248
  Synthetic

SEQ ID NO: 4250 - protein, 181 aa, Artificial Sequence
  Synthetic
SDEERVRRLEEEVDKTLEKVERELRKVSEENKRTLDRLRAEMEKSSKELERVLEELNIDEELRKEIKRRNDELRKELEELLTRNRKKDEDLKRRAEKLKREIERLKEELKRELEDLKRKGSDERDVERTLRKIEETVKKLAEDLKRLLDEIKKISEESKRRAEELLRKHKKIVDDIDKRTR

SEQ ID NO: 4251 - protein, 181 aa, Artificial Sequence; identical to SEQ ID NO: 4250
  Synthetic

SEQ ID NO: 4252 - protein, 182 aa, Artificial Sequence
  Synthetic
SMKEELDRLLKELRERNKEIEDRAEELLRRSTDSLRKVKEKLDKLLEESTRILRKVEKENRVSEDTLRELREIHERLRKELEDAKRDLDRDHKELAEKLEEIIRRNRENLRRLEREVEEMKKRNDLSEKVLKDIKRVIDEDEERLKRVLDDYERRVRELEDKVKKILDRYKTEVDKLRERAR

SEQ ID NO: 4253 - protein, 182 aa, Artificial Sequence; identical to SEQ ID NO: 4252
  Synthetic

SEQ ID NO: 4254 - protein, 182 aa, Artificial Sequence
  Synthetic
SVEEEIRDLLRKLREIVDRVRRRLKEILEESTRRLEEVTRRIDESNEDLKRAVDDVKRRNTRDEEVKRELDRKLKKIHDEDKREKDKLEKIHRDLTDKLEKAKRKLEELVKRIEKEVEDVRRENKLDKEVLRKLEEEIEKLRKEAKKILDEYRKLVEDLADKIKKILDRNRKLIEELVREVK

SEQ ID NO: 4255 - protein, 182 aa, Artificial Sequence; identical to SEQ ID NO: 4254
  Synthetic

SEQ ID NO: 4256 - protein, 182 aa, Artificial Sequence
  Synthetic
SESEKTLKDLDEISKRYEKKVREMLERHKRLSEETKKRDDEALERLTRLVKELKDVARRGDISEDEIRRTLEELRELVKDVKRRNDETNRELEERSDRVNKDLERINRDLKRLVDEAAKRGISEDVKRRLDELLERHKRISEEVEKRNEDLLREHEEISRRSKKRIDDLLREAERILDEMRR

SEQ ID NO: 4257 - protein, 182 aa, Artificial Sequence; identical to SEQ ID NO: 4256
  Synthetic

SEQ ID NO: 4258 - protein, 182 aa, Artificial Sequence
  Synthetic
SESEKVLRDLEKISEDTARRLEDELRKHKEIVDRIKEEDDEMLDRLRKLVETLKRLAERGDISDKVIRDMLRELRKRVREVEERNKRLNEELKKRSDEVNKELEETNRKLERDVREAERRGTSEEVKRRLEELLKRHKEESDRARERNERLLKEVRDLSEESRERIERLLRELEERVREDER

SEQ ID NO: 4259 - protein, 182 aa, Artificial Sequence; identical to SEQ ID NO: 4258
  Synthetic

SEQ ID NO: 4260 - protein, 182 aa, Artificial Sequence
  Synthetic
SRSEKSLKELREISERTRKRLEDKLDRHEKESKKVEDKAREVLKELEDLVRTLEEVARRGDISEEMIDRELKKLRERVKEIKDDLKRLNDELRERSKRVNDRLKEENEKLKRKIDEVEREGIDEEVRRRLRELLERHKRISDEARKRNEDLLREHEKRSRDIEKRLDDLLKEAEDRLRERKR

SEQ ID NO: 4261 - protein, 182 aa, Artificial Sequence; identical to SEQ ID NO: 4260
  Synthetic

SEQ ID NO: 4262 - protein, 183 aa, Artificial Sequence
  Synthetic
SDEEELRRLIEEHEKILKEIEDRVRESSKRNKEILKRLEDEVRKLLETVKDRLEKARERVDERLVKRVEERLEEIKRRVEELLKENEETDERLKKRVKETLDRSREEVKRVEERLRDLKRKGSSSETAKRVLDELKERSERSMEDLKRLLKEHKERVDEMRRRAEELLKRLREVIRKVEEEIR

SEQ ID NO: 4263 - protein, 183 aa, Artificial Sequence; identical to SEQ ID NO: 4262
  Synthetic

SEQ ID NO: 4264 - protein, 183 aa, Artificial Sequence
  Synthetic
SRDEEVKRLKKEHEDILEEIRKRVDESSKRNEKILREIKERVKRSSDDLKRLLEELRERVREREVERVEDENRRMEERVDRTLEKNRDLDRRLKEEVDRTLEESKKTVEELEKKLRDLKRKGSSEEDVERVLREFEEVSRRSEETLRRLLEKHKELVERAARELETLLKEHRERVRKIEEEAK

SEQ ID NO: 4265 - protein, 183 aa, Artificial Sequence; identical to SEQ ID NO: 4264
  Synthetic

SEQ ID NO: 4266 - protein, 174 aa, Artificial Sequence
  Synthetic
SSKERLEKLLRELEEDLRRAHEEHKRLIKRLREILDEIRKRVEKLNRDLDRVLERAREEGKLDEDLRREVEDIKRRNKENLKRLEDEVRRTEREIEELNKKLEKEVRDIAEDLKRKPVDEELLKEVKEMIKRLRKKIKKSLDDVRRVIRELEEHARRDLRKLEKDLKDIEDKLR

SEQ ID NO: 4267 - protein, 174 aa, Artificial Sequence; identical to SEQ ID NO: 4266
  Synthetic

SEQ ID NO: 4268 - protein, 174 aa, Artificial Sequence
  Synthetic
DSEERLKELERRLRELLKRVSERSKKLNKEHEEINRKAEEEVERLNRELERDLEDAARKGLLDKDLKKKVDDIRRDNRRNLEDSKRRSEKVSRENRERNERLRDRVRKIEKRLRERPVTDELLREAEKMLKELEELVREDEKRLKDISKEVEEHYRKDLEDVKRAIKEIRDRLK

SEQ ID NO: 4269 - protein, 174 aa, Artificial Sequence; identical to SEQ ID NO: 4268
  Synthetic

SEQ ID NO: 4270 - protein, 174 aa, Artificial Sequence
  Synthetic
DSERRLEKLLRELKELLKRVEESLRRLNEEHKRINDEARERSKRLNEELEETLRKAREDGRLDEELRKKVEEIRKRNEDKNRESEKDSERVRKENEDNLKRLKEKVEEIERRLRAKPVTEELLKEIKDRLKELAEHVERDERRLKRISEEAEKRYREDVREVKEMIEEIERELR

SEQ ID NO: 4271 - protein, 174 aa, Artificial Sequence; identical to SEQ ID NO: 4270
  Synthetic

SEQ ID NO: 4272 - protein, 174 aa, Artificial Sequence
  Synthetic
ESEERLRDLIRKIRELLEEIERRLRDLNRRLREILKRIEEESEKLNRELKKILDEARERGLLDKDLEREVRKISKDNKKKNDDLRRDVERISRENRKNLEKLKKKVKDIEEELRRKPVTEELLKEVRERLRELEEHARRDLETLKRMIRKLEEEAKKDLRELEKMIKDIRDKLK

SEQ ID NO: 4273 - protein, 174 aa, Artificial Sequence; identical to SEQ ID NO: 4272
  Synthetic

SEQ ID NO: 4274 - protein, 179 aa, Artificial Sequence
  Synthetic
SLEEALRKLEEELERLNEEAKRRIDRLIEELRRLNEEARKKIERLIEETRELLKRLAEEGKVDEELEKEVRRIEKENKEALDRSREETKRIEEEIKRVEEDSRKKTEEIKEELKELIRRDGGIDREILERAKELLKKLEREYRELLKKIEKVVRDLEEKYRELLKRHRKETERLDREVR

SEQ ID NO: 4275 - protein, 179 aa, Artificial Sequence; identical to SEQ ID NO: 4274
  Synthetic

SEQ ID NO: 4276 - protein, 179 aa, Artificial Sequence
  Synthetic
ELAERVKRLIEEHRKTDKEVEDRIRKLIEDHDRENRKVEDEIRKLIKELREIVDRARKEGKVDERVEEKLRRLEEEIERVLRELREESKRLEEEIKEVLDRLKEESKKLEEDIKEVLRRDGGIREEILDKIREVHRRVRKKARDLAERIKDAHRKLRKKVEELLRRIKEMIRRLEEELR

SEQ ID NO: 4277 - protein, 179 aa, Artificial Sequence; identical to SEQ ID NO: 4276
  Synthetic

SEQ ID NO: 4278 - protein, 179 aa, Artificial Sequence
  Synthetic
SDRERLTRLIEELRKLLEKWEREVKKINDEIRRTVEKVEEDSKKSIEDLRRLLKEMEDRGSVDEEMRKRVEEVERRNEKVLRDLRETLKKVHEDNKKITREVRERVKEVEKRLEDLRRRQEEDTKDLERRIEDVIRRLKKLADDDLRDLRRFLKELKERADKLRKEDEEALKELRDRAE

SEQ ID NO: 4279 - protein, 179 aa, Artificial Sequence; identical to SEQ ID NO: 4278
  Synthetic

SEQ ID NO: 4280 - protein, 179 aa, Artificial Sequence
  Synthetic
SREDDIRRLIEEARKLVEDAERRSKKSIDDIRRLVKEWEEEVKRINDDLKRLIDEARKRGDVTEEIEEDLRRMHKKNREIADRVRRELKRVEDDNKRVLDELREVLERIEREIEDLRRRNREPDKDLKERIKKLLDELRRLVEELEKRDKEMLDRIKKLADDDRRELERILKKLEDDLR

SEQ ID NO: 4281 - protein, 179 aa, Artificial Sequence; identical to SEQ ID NO: 4280
  Synthetic

SEQ ID NO: 4282 - protein, 179 aa, Artificial Sequence
  Synthetic
SAEDTIRTLLERHDDLDREVEERSKESIRELRRLIKEWRERVRKLNEELKRLLDDLRRKGLVDERLTKKVKDVHDDNDRIKKELTKRLREVEERNKEDLKRHKRESDEVKKKLTDLRRRKRNRKEELIEEIKEMNKKAKKSVDELEKKDRDVLDEIRKMAKEDLDRLRKALEDLERDAR

SEQ ID NO: 4283 - protein, 179 aa, Artificial Sequence; identical to SEQ ID NO: 4282
  Synthetic

SEQ ID NO: 4284 - protein, 179 aa, Artificial Sequence
  Synthetic
SSEDRVRDIERRHKEEDDRVEEESRRSTREIRELLRTAKERSDDSIRKLRKLIDDLRKEGLVDERLKEKLKRVEEENEEVLRRLEKRLRDVERENKKLLDDHKKKSKEVKDRLRKIETDQKRRTEELEKELEDVNRDVDRSAKRLKERDEEALKTLEDEIRKLEEKDKKVLEDLEREAR

SEQ ID NO: 4285 - protein, 179 aa, Artificial Sequence; identical to SEQ ID NO: 4284
  Synthetic

SEQ ID NO: 4286 - protein, 181 aa, Artificial Sequence
  Synthetic
SDKEEVDKLKERNERVLEEVRRRLEKLEKDNKDTLKKIRDDSERLREKIKRVRDREQISEEVEKKIKRDEDENTRHNEELEEDNRRKTERVKEEMKRIEDENEKKDRRFDERVKRAKENNSSREFVEKALREYEELLKRSRETLEELLRRYKKLLDESRKTAKEDLDRSEEIIKKLADESK

SEQ ID NO: 4287 - protein, 181 aa, Artificial Sequence; identical to SEQ ID NO: 4286
  Synthetic

SEQ ID NO: 4288 - protein, 181 aa, Artificial Sequence
  Synthetic
SDEEEVKKLHDENKKVNDEMREESKKLHDENDRVNKEVKERAKKVSKELEDMLRREQRPEEELKRIEEELRRLAEKVKDLNKKNKEIDDRNKDHNRELNKENKELDEELKKELDRAKRENSSEETVRRLLEKVREEIRRSKKRADDDLKTTKELIEKSEREVDRLLEEIKKIIEELERRAR

SEQ ID NO: 4289 - protein, 181 aa, Artificial Sequence; identical to SEQ ID NO: 4288
  Synthetic

SEQ ID NO: 4290 - protein, 179 aa, Artificial Sequence
  Synthetic
SELEKVLREVEENLREVKRENEEKLRRNEENIKRLEEEDRRRLEEIEKMIEEIERARIREDELDRRLRELRERVKKIEKKNRDHLRRDEKELRDVLRKHKKHAEETEKRVEDAKRRVLDGKEVEEELRRLREEYEEVSRRSKEELEKSLRRLEEVHKESRKRLRDLLKKLDDVAREERK

SEQ ID NO: 4291 - protein, 179 aa, Artificial Sequence; identical to SEQ ID NO: 4290
  Synthetic

SEQ ID NO: 4292 - protein, 179 aa, Artificial Sequence
  Synthetic
DELRELLKDIKRTTEDVEREVEEILRKVEEMIRRLEEEDRKVLEDIRRKIEDIRRANIPREELEEELKRLEEEIEKILRDNKRKLDELKEEVDRARRKLEKLSRDLEEKIKELARRVLDGEEVRKEMERLRREHEDVDKKVRDELRKLEEELRRVHRESEKALRDLLRKLREVAEREKT

SEQ ID NO: 4293 - protein, 179 aa, Artificial Sequence; identical to SEQ ID NO: 4292
  Synthetic

SEQ ID NO: 4294 - protein, 179 aa, Artificial Sequence
  Synthetic
DELEDFLRKVERVIKELRDDDKRALDRIREVTKDVERKAREILKRVEEVIRRIEESNIREDELKEVLERLKEEARRLKRELEKLSEELKKEIKEILDRNRKKLRDLEEEVKEVRKRVVRGREAEEALERLKTRLEKVHRDSKRALEKLRRDHEEVDKRITEELRKLMERLKRVVDELRR

SEQ ID NO: 4295 - protein, 179 aa, Artificial Sequence; identical to SEQ ID NO: 4294
  Synthetic

SEQ ID NO: 4296 - protein, 181 aa, Artificial Sequence
  Synthetic
SADEALRELEERNRKVNEDVKREDERLHREDREVNKRIREEDKKLHKTLRDVLEELRKKVSEEELKKIEERLKRVNDTNEDLHRRNEEKVRRLNEENRKKHEENEKKSRDLKEEFERDKDGDERRVEKLLRRYKKVLDEVKRELKESLDKAERVTRKSEDDARRSLEEIKKEIEEVRERIR

SEQ ID NO: 4297 - protein, 181 aa, Artificial Sequence; identical to SEQ ID NO: 4296
  Synthetic

SEQ ID NO: 4298 - protein, 181 aa, Artificial Sequence
  Synthetic
RVDEELRKLVEDNKRKNEEVKKELKKLKEENERVNKEVRERDRKLHEKLRRVLEEVRRTIREDELREIEETLKRLNDRNEELHRRNEEESKRAEDKVRTELEKNRKISEEIKKKAEDRKDGDEEEMRRLLEEYEELVRRVLKRLKEILEEYERLVRRVEEEVKKSLEDIERKIKEAKDRVD

SEQ ID NO: 4299 - protein, 181 aa, Artificial Sequence; identical to SEQ ID NO: 4298
  Synthetic

SEQ ID NO: 4300 - protein, 181 aa, Artificial Sequence
  Synthetic
DVEEEVKKLKDKNRRINEEVKKRMRELEERNKELNKRIREEDERLHRELRKVLEEARKTIDEKDLKRIEDELKKMNEENEKETEENERRSKEVKDRVREELERNRKESRDIEERLRRIKDGSREEVEKLLREYEERLERVRKRVEEILAKYKELLDRVEERARKSLKEIKETIEDARRRIK

SEQ ID NO: 4301 - protein, 181 aa, Artificial Sequence; identical to SEQ ID NO: 4300
  Synthetic

SEQ ID NO: 4302 - protein, 181 aa, Artificial Sequence
  Synthetic
SMDEELDKLTRENEAVNERVEREARRLKEENRKVDEEVRRAVEELKERVRRVLEEVRRKISEEKLRKIEEDLKRIEEEIERLEERNRRESEKFEKEVEDKLRENDKKSKEVRRDVERIKDGDEEDVRRLLEEYARLVREAEREVREILRKYEELVRKARKDAKKLLDDIERKIEKIKRDVD

SEQ ID NO: 4303 - protein, 181 aa, Artificial Sequence; identical to SEQ ID NO: 4302
  Synthetic

SEQ ID NO: 4304 - protein, 181 aa, Artificial Sequence
  Synthetic
SMDEELKKLVKENEDLNRRVREEAERLRKENEKVDEDAEREDKRLHDKAERVLRELRRRIRKEELDRVRRELERVNEENRELLERNKEESKRFREEVERTLEENRKLSEELKKKMEDIKDGDERTVTELLKEYRELVRRVEERVKKILKEYKEEVEEVKRRLEESLKDIERKIDEIRRRAT

SEQ ID NO: 4305 - protein, 181 aa, Artificial Sequence; identical to SEQ ID NO: 4304
  Synthetic

SEQ ID NO: 4306 - protein, 181 aa, Artificial Sequence
  Synthetic
SMDEALEELTRRNEEVNKRIEEEDRKLHKRNKEVDDEVRKRDKDLHDELRRVLEDARRTIREEELKRIEDKLRRLNERNEERLKRNEDRSREVNRRNKKLLDENRERSKRMKDDADRIKDGDEDEVEKLLREYKRRVEEVKKRAEDSLKRYEEEVKELEDEVRESLERIRRDIEDVKRRID

SEQ ID NO: 4307 - protein, 181 aa, Artificial Sequence; identical to SEQ ID NO: 4306
  Synthetic

SEQ ID NO: 4308 - protein, 181 aa, Artificial Sequence
  Synthetic
SMDEAVEKLKKENKDIDEEVRRRLDELRKRNEEVNKKIKEDDDRLHKEAKEVLEDVRKTISEDELRRIKERLEEINKRNEELLRDNRRRSEEMTRRVEELLKRNEDESRRLEETLKRVKDGDEDIVRKLLREYEKLLREVRERARRILEEYKRLVKEVRERAERSLEELKREIKKVRDRAK

SEQ ID NO: 4309 - protein, 181 aa, Artificial Sequence; identical to SEQ ID NO: 4308
  Synthetic

SEQ ID NO: 4310 - protein, 176 aa, Artificial Sequence
  Synthetic
SEKEELLRKAKEVIDRIRKELEELLRRAREVNKDSRRTVEEVLRKAREVSERVRKASERGTDDKEELAKENERLVRELEEEVKKLHDDDRKKDETLRREVEELARRIRKLLKELEEEVGRDEELDDLRRRAEELLKRAEDEIRKLHEENKRSNEEAERAIRELAKRNKELDDKTRE

SEQ ID NO: 4311 - protein, 176 aa, Artificial Sequence; identical to SEQ ID NO: 4310
  Synthetic

SEQ ID NO: 4312 - protein, 176 aa, Artificial Sequence
  Synthetic
KEKEDLIEKMKKVLEDIRKRLEELLKRARKVNEDSRKLVKEVLDKIKKVNEDVRKVATESTDDKKKLAEENRKLVEELRKELKEVHDEDKKLDDELRDRLRRIEEDIRRLLRDLEREVGRDEELTRLAREIEKLLEEARRRVEKLHEENKRSNEEAKERMERLRDHNRKLDDDTRK

SEQ ID NO: 4313 - protein, 176 aa, Artificial Sequence; identical to SEQ ID NO: 4312
  Synthetic

SEQ ID NO: 4314 - protein, 176 aa, Artificial Sequence
  Synthetic
REREELIKKVRTVHKRSEEELRRHSEEVKKVNRDSRERVKEHLKRVKEVIKELEDVARESTDDKKKLLEEVRKLLEDLDRHLRELHKRDEKLDRELDKHLRDLKRDNERLLRELEKEVGRDRELKELADRNKKLLEDIEREHKKLHEDNRRSNEDARRRHEELKREVEKLLDELRK

SEQ ID NO: 4315 - protein, 176 aa, Artificial Sequence; identical to SEQ ID NO: 4314
  Synthetic

SEQ ID NO: 4316 - protein, 183 aa, Artificial Sequence
  Synthetic
SLEEEIKRLVKHHEELLREVRKRLKELEDHHRELDERHRRMLEELVREARKLIKDVKDDIDRKLVEELRKKLDDLARELEELNRESNRKLKKLVEEVEKILEESLRRVEELKRDVERKRSKPTDEETVERILRTLKTTDERTTDTVREILRKIKRTNEESKETADRTVKRAKDLIREIRERVR

SEQ ID NO: 4317 - protein, 183 aa, Artificial Sequence; identical to SEQ ID NO: 4316
  Synthetic

SEQ ID NO: 4318 - protein, 183 aa, Artificial Sequence
  Synthetic
SAREAIKEIKKHHKKLLEDVKETIDRIEEHHRKLDKDHRDELKKLLEEVRELLRDIRSRIDKKLVDDLERKLRELEKKLEEENERSNRRLEKLKREIEDELRESEERVRRKEEEVKKTESKPTDERTVEKILEELKDMNRATKRRVEEILRRLKKTNDESEKRARDTLTRIKELIEEVERRAR

SEQ ID NO: 4319 - protein, 183 aa, Artificial Sequence; identical to SEQ ID NO: 4318
  Synthetic

SEQ ID NO: 4320 - protein, 185 aa, Artificial Sequence
  Synthetic
DESEELKKEAKEILDRLEKVLRELTDRNREMLKRIEKLIRENEKRLEDILREIAKRASEDRDERVLREIVRDVRRLIKENREEDDRIRRDVERYLRKSRRDMEELTRRLEEVIKRLEDKVREARVPEEVEKELKRIKDELKRLVEKAERSLRESEERLRRLLEEAEKRNRKVEREIEKLLDDTRK

SEQ ID NO: 4321 - protein, 185 aa, Artificial Sequence; identical to SEQ ID NO: 4320
  Synthetic

SEQ ID NO: 4322 - protein, 172 aa, Artificial Sequence
  Synthetic
SKEEKITRDAEEVLRRSEEIIRRLLRRLEEVLKDLERSARENKKRLDKILEDLAKLDTDRSVLKKAVEDVHKRDRETLKRHDEESKKVKDELEELLRRHNKELRDVRDELRRRGADEKRVKRMEEELRRLHEEVRRRVEKVKRDMDRLNKKIKEDSRRVNEEIRKLLEDKTR

SEQ ID NO: 4323 - protein, 172 aa, Artificial Sequence; identical to SEQ ID NO: 4322
  Synthetic

SEQ ID NO: 4324 - protein, 172 aa, Artificial Sequence
  Synthetic
SEEEKVRKELEEVLRRSDEDIERNRRRLEKVLDDLRRSAEENKRRLKEILDRLKDTDTEERVLKKIAEEVHRKDRKTEREHEERSKRVHDEDERSLREHNKKLKKVKEDLDRRGADEKEVRKVKDRLDKLHEKVKRISEEVNERIRRLNKRIKEISKRLNEELEELLRRRRT

SEQ ID NO: 4325 - protein, 172 aa, Artificial Sequence; identical to SEQ ID NO: 4324
  Synthetic

SEQ ID NO: 4326 - protein, 172 aa, Artificial Sequence
  Synthetic
DELEKFKEDVKEVIKKLAETIKRLLDDVRRVLEKLRKLAEENKERLDRILDELRRLRTDEREVERKVEEVHRRDKKTLDELRRDVKEVKERIEEVLKRHDEDSERVDKELKDRGADEKEVARLREEIKKLNERLKREVERLKRELEKLLRDIEKTSEDANRRLKELLDRTRK

SEQ ID NO: 4327 - protein, 172 aa, Artificial Sequence; identical to SEQ ID NO: 4326
  Synthetic

SEQ ID NO: 4328 - protein, 172 aa, Artificial Sequence
  Synthetic
RREEELLERAEEVLEKLERIIEETERELKEVLDRLRKSIEDNLRRLKKVLKELKDNDTDRETLRRELDKVHKEDRDTLREHKRESERVKKELDEKLRRAEEEVRRVEEELDRAGLDEKDLTEVKKRLRDLLKKMEDVLREVKKRLDDLNREMDDRSRKANEELRDLVRRKEK

SEQ ID NO: 4329 - protein, 172 aa, Artificial Sequence; identical to SEQ ID NO: 4328
  Synthetic

SEQ ID NO: 4330 - protein, 181 aa, Artificial Sequence
  Synthetic
DVERKLREVEERHKDVLKKAKELLDKVEEDHKKSSKEVEDVLEEMRRRAEKLVRDAVRKKGGSPRDLEELKKELEETLRRIRERNKRHHDEVKKRLEEVEEELKRHHDEVKKTLETLKDIRGDELARRIEEELEKLLRTLEELVTEIIKELEKLLKTHEDLLREVEKTLRRIIEELEKRDK

SEQ ID NO: 4331 - protein, 181 aa, Artificial Sequence; identical to SEQ ID NO: 4330
  Synthetic

SEQ ID NO: 4332 - protein, 181 aa, Artificial Sequence
  Synthetic
SVEETLRTVEEEHRKSSKEAEELLEEVERRHEESSKRLEDTLREAEKEVRRLAEDVVRRRGGSPEELRKIMEDIKRKLDRIREENKKHHEEVRREAEEIRKRNKKHHEEVKRVLERLKDIRGKELVDEARRELKELLETHKETVKRVLDKLRDLLRTHEEKMKDVEETLRRLLERLKEETR

SEQ ID NO: 4333 - protein, 181 aa, Artificial Sequence; identical to SEQ ID NO: 4332
  Synthetic

SEQ ID NO: 4334 - protein, 181 aa, Artificial Sequence
  Synthetic
KVEDSLREVKKRHKDKVDEVRKRLREAEEENKRLLDEVRRELERVEERIRRIVEEIVRKKGGSPKELERIKKEIEDELRRIEKELEDSERRNRELLREIEKRLEDHHRKVEKVLRDLKDIRGDEEARDIERRLRDLERTLEELVKEADERLKRSNEEDEERIRRVRKKLEELLRELEKRDE

SEQ ID NO: 4335 - protein, 181 aa, Artificial Sequence; identical to SEQ ID NO: 4334
  Synthetic

SEQ ID NO: 4336 - protein, 181 aa, Artificial Sequence
  Synthetic
DEDRDLKRELDRLLREHEELVDRSTKRLEKLLRKHEREARESKKELEKLNDELREIARKPTEERDLERSKRRLDKLKKELEDKNREARKELEDLREELREINERVRKKVKELEDDIRRKNSSEDVKRKLEEVRRRIEESVKRHRETVEEMRRRVDESVRRHERTVDELRRTHEELIERVRR

SEQ ID NO: 4337 - protein, 181 aa, Artificial Sequence; identical to SEQ ID NO: 4336
  Synthetic

SEQ ID NO: 4338 - protein, 181 aa, Artificial Sequence
  Synthetic
KDEEKIIEDLKRLLRKHEKLVEESRERLKRLLETIRKIAKDIVERLKRLNEELREIAKRPTPDEDLKRSKEKLDELEREIRELLEELEKRLRELEKELREINETVKREIEELRKEIERRNSSEEAREKIKRVVEELKESVERHERDVDRVRREAERLLEEVTRRIETVRRTHERLIEEIKK

SEQ ID NO: 4339 - protein, 181 aa, Artificial Sequence; identical to SEQ ID NO: 4338
  Synthetic

SEQ ID NO: 4340 - protein, 181 aa, Artificial Sequence
  Synthetic
SEKDEIKRELEELLREHEKLAEESRRRAEELLRDIERRARESLTELRELNKKLREEARRPVPDEVLEKSEKELEDRLRELEERNRKLKEDLDRLREEVEKLNRDVERKVEKLRKDIEERRTSEDVEREIRKVREDLKRSVDEHRKDLERIRRELEELLEKHHEDLRDVERTHRELLKEIKR

SEQ ID NO: 4341 - protein, 181 aa, Artificial Sequence; identical to SEQ ID NO: 4340
  Synthetic

SEQ ID NO: 4342 - protein, 179 aa, Artificial Sequence
  Synthetic
DVEDELRRLHEENKDLLREAEEELERLHRENKKLLEDARRLLERLEEELERIERRLKTDERDRREIRREADELRKRFEKLEKENRDINRKLREEFKRLKERNEKEDEDAKRRVEEKRGGDREEVEREVRKIEKLIRDSRERVRELIEKIERTLRDSERRVRELVKEVEKRLREIERKVE

SEQ ID NO: 4343 - protein, 179 aa, Artificial Sequence; identical to SEQ ID NO: 4342
  Synthetic

SEQ ID NO: 4344 - protein, 179 aa, Artificial Sequence
  Synthetic
DVEKELKELHDKNEEILERARRLLERLHKENEEINKRVEEALRRLAEELRRLKEELDDDESVKDKIDKLLEEAKKEVKRLNEENRELNRRLEERMRDLERRNRETNERLKKEAEEKRGGDRREVKELIRKIDELLRRSKEEVDRLVKEVERLLRESKRRVEEVIEKLRKIIEELEREVR

SEQ ID NO: 4345 - protein, 179 aa, Artificial Sequence; identical to SEQ ID NO: 4344
  Synthetic

SEQ ID NO: 4346 - protein, 179 aa, Artificial Sequence
  Synthetic
REVEEVIKDARRLLEELRKHSEDEVRKVEEEIKRLRDDNKRAVDDIERLLRELEEANLPEDEVEKVVREIRERAKEIKKRHEDKLRELRKKLEEVKKKHKKLVDDIKTKLKRVRDELVRDRRAETKLEELRRRLDEILRTTEELLRRLKRELEKLSEESKARLDELKRKLDEILKETRR

SEQ ID NO: 4347 - protein, 179 aa, Artificial Sequence; identical to SEQ ID NO: 4346
  Synthetic

SEQ ID NO: 4348 - protein, 174 aa, Artificial Sequence
  Synthetic
DEAREIVRELEKRIKDIEDRARKLIRELEKSLEDLKRRVEEMLREWEEESKELERRNVPRERVKEVKEKSDEKVTRIREELKKVNEENERRLREIEEELKKLAREMEKRLEEARDKIDREKVKEIKKRLDELLKRIEDELRRIREEDKRIHDEVEKELRKLERRDEELLKRLED

SEQ ID NO: 4349 - protein, 174 aa, Artificial Sequence; identical to SEQ ID NO: 4348
  Synthetic

SEQ ID NO: 4350 - protein, 174 aa, Artificial Sequence
  Synthetic
SEAEDIVRKIEELLKRHHDRVEEMLRRWEELTRRHSEKAEKIVREVEKLIDELREAKVPREEVERVARELEEKHKRVDEEHKEVTERSKRRAEEIRKESRDVAEDLKRRLSEVRDTIDEEEVKRLEKEIRDNLREMEERLKELEKRDKDNLDRIRELHRRLREELEKLLEDARR

SEQ ID NO: 4351 - protein, 174 aa, Artificial Sequence; identical to SEQ ID NO: 4350
  Synthetic

SEQ ID NO: 4352 - protein, 183 aa, Artificial Sequence
  Synthetic
SMDELLKRLEEEDRKLNEESKETLERLRKHDEDLNRKNREKLKELKDRVDRVLEDAKKRVPDEDLERIKKRLEELRRTNEELDRENEKLAEDLAREVKKTNEENRRTSKRIKEEADKLKKRKISEDDVRREVEDVKRRIEDSREKLRKLTEKWKKLNRESDEKVKKHVEDVEREIEKVRKEAE

SEQ ID NO: 4353 - protein, 183 aa, Artificial Sequence; identical to SEQ ID NO: 4352
  Synthetic

SEQ ID NO: 4354 - protein, 183 aa, Artificial Sequence
  Synthetic
SSEEELKKLSDKARRLNDENRKILERLKEHDERLNKRNKEELKRLREDVERLLEDARRRVDERVLRTITEILKRLEESNEELTRKNEREMEKLARTNEDEDRKARKKLKELEDEARRLRERNTSEEDVKRKLDTIDKVIRDVRRRIEEHVRRWEELNRRSKKEIEDHVKTVEDVIKEAKDRID

SEQ ID NO: 4355 - protein, 183 aa, Artificial Sequence; identical to SEQ ID NO: 4354
  Synthetic

SEQ ID NO: 4356 - protein, 175 aa, Artificial Sequence
  Synthetic
DEDEEVDREVREMIKRLEEHVKRDEDTLEEMLKRLRDHVERDRRRLEELLKDLERLVRERGRDEELEKKVKKIIRENRENLKRLEERVEKIRRDNEKNNEDLRREVEDIRKKLRDKVDDKEELKRLDREAEELLRRVDRLNEEVEKKLRKLLEEVRRENKRLEEEAKRLLDKAEE

SEQ ID NO: 4357 - protein, 175 aa, Artificial Sequence; identical to SEQ ID NO: 4356
  Synthetic

SEQ ID NO: 4358 - protein, 175 aa, Artificial Sequence
  Synthetic
DEDEEVRKKVEEEIKRLKKEVEEDRRDVERLDEESKDKVRRDEKKVKDLLKELEDLVRRDGRTEELRKRMEEILKENDEINKKLRKENEKINDENDKKNKELRKRVKEITERLRKEVDDKEELKRLEEEAKDLLRDVERLNRELHKRNREILEEATRRNEELKRELKELLDRARK

SEQ ID NO: 4359 - protein, 175 aa, Artificial Sequence; identical to SEQ ID NO: 4358
  Synthetic

SEQ ID NO: 4360 - protein, 175 aa, Artificial Sequence
  Synthetic
SEEERVKEELDKAIKTLEKLVKDDLKKVADALRRLREHVEKDLRDLEEVLRELKELVDKTGRTEELRDKVRKIEEDNERNNKKLADEVKRIADENTEINEELRRRVEEIKRELRERVRDTEELKRAERELDRLLTEADRRNDELRREAERLLEKVNEDNRTVKERARRLLDDARR

SEQ ID NO: 4361 - protein, 175 aa, Artificial Sequence; identical to SEQ ID NO: 4360
  Synthetic

SEQ ID NO: 4362 - protein, 175 aa, Artificial Sequence
  Synthetic
REDEEIVKEMERLLERLEELSRRIMEEVKRIDKESEDHIKRDEDKLREELERLRDLVRREGTTDELRDRVRRIKEENTENNKRLEDKNREANKRLKDLSDKLREDVKRIRDELRKKVDDKEELKELEERAKRLLERHERTNEELHRRNEEILRKANELNEEVRRRLDKLLDEVRT

SEQ ID NO: 4363 - protein, 175 aa, Artificial Sequence; identical to SEQ ID NO: 4362
  Synthetic

SEQ ID NO: 4364 - protein, 175 aa, Artificial Sequence
  Synthetic
DREREVRRRVKEALDEIKRHVDRDRKKAEDMDRRSRELSDELRRRVDDLIKRLKELVDRDGRTEELEKTVRKIERDLTEESRRLKDENRKINEENKDNNRRLRERVEDIKRRLKEEVPDTEELDELRKELDKLLTEVDETNKKLHEDNKRILDDHDRINEELRRRMEALLREATR

SEQ ID NO: 4365 - protein, 175 aa, Artificial Sequence; identical to SEQ ID NO: 4364
  Synthetic

SEQ ID NO: 4366 - protein, 175 aa, Artificial Sequence
  Synthetic
SEEEDMVRRVREMIKRLRDHVRRDKDKLDKEDKRSADHVDRDRKRLEDLLKELRDLVRDTGRTEELARRVERIIEENRENNERLRRENEKINRENDRNNKKLEEEVRRITEELRRKVDDTEDLKRLEKELRDLLDEVNKENEKVHRRNREILKRADELNEEAERRLRELLREAEK

SEQ ID NO: 4367 - protein, 175 aa, Artificial Sequence; identical to SEQ ID NO: 4366
  Synthetic

SEQ ID NO: 4368 - protein, 175 aa, Artificial Sequence
  Synthetic
KEDEEVKDKVEKLIRKLEKESRDISEEVKRLDEESKKLARDLTEEVDRVIKRLRELVERDGDTEELERRVREIEKELDKRLRDIEDRNEKANRELKRLSEELERRVEEIRRRLRKEIDDKEELKKLEKKLEELLERHRRDNKRLHEENRRILEELRRRIKELKERLRRLKEEARK

SEQ ID NO: 4369 - protein, 175 aa, Artificial Sequence; identical to SEQ ID NO: 4368
  Synthetic

SEQ ID NO: 4370 - protein, 185 aa, Artificial Sequence
  Synthetic
ETDERLDELRRRLEKSLKDHKKLLDEVRKKAEELLDRNARLLEELKRELDELLKKVEEDNRMRKDELKKIREDVERLREENRKTDREIRERLKELERRAEEIDKRAKETLDEIEREIERLKREGTTREVVEELLRRAEEEIRRHRKKVKESLDRLEDEIRKVEEDSRRSEKKVRKLIEDVKRRVK

SEQ ID NO: 4371 - protein, 185 aa, Artificial Sequence; identical to SEQ ID NO: 4370
  Synthetic

SEQ ID NO: 4372 - protein, 185 aa, Artificial Sequence
  Synthetic
STEETLEKLDRDLKDSSRRNEELLKRVDDRLRESSKENRKILKELSDRLRDLLEKVKKDNRAEEEVLERIRKEVEDLMRKNEDTNRRARERVKELEERNRKTNKDVEKRLEDLKREIKRLREEGTTDKVVRELVKRAEDEIRDHKRLSKESLDRLDEEIKRHRELSKESMEEADRLIKTVKERVR

SEQ ID NO: 4373 - protein, 185 aa, Artificial Sequence; identical to SEQ ID NO: 4372
  Synthetic

SEQ ID NO: 4374 - protein, 185 aa, Artificial Sequence
  Synthetic
ELDDLLREVEKRVRDLNRRNEEELRRVEDRMRESLRKSEEDLRRVEERLKKTLTRVKTERRVPDKDLDEIRKRVEKLSREIREINKDAKRRLKELVDENRKRDDEIRREVKKRKDDVKDLARKGDDRRSAKKILDDLERTLEDVERRSRESVRRLREEIETHRKLVEELKKRLDDLEEEVKERVR

SEQ ID NO: 4375 - protein, 185 aa, Artificial Sequence; identical to SEQ ID NO: 4374
  Synthetic

SEQ ID NO: 4376 - protein, 180 aa, Artificial Sequence
  Synthetic
SSDEILKRVKEELDRLLEENKRLLEEARKRLEDLIRKNREDLKRVEEKMRRLLEETPEDKKLEEIRERLKRLKEENERLNDEARRRLEKLRKENEETNRRIEEEVRRLAEEVERLKREGTTEEVVRRLAEELRRLIEEVKRKIEESERRLKETLDRYRKLVEDSLRKLEETIRRVREESR

SEQ ID NO: 4377 - protein, 180 aa, Artificial Sequence; identical to SEQ ID NO: 4376
  Synthetic

SEQ ID NO: 4378 - protein, 180 aa, Artificial Sequence
  Synthetic
SSEELLRKVKEDAKKIIKENEELLRKVDKDMRDIIKENRDLLEELTERVKRLLDRTPESDDLDRIRKIVEKLRRENEKLDEDAEKKLEDAKRRNKRTDRELEKRLKKLAEEVKDVRDKGTTEEVVKRILEELKKLLDEAERLSRESLKELEKMLREYRESVERSLRKVDDTLRRVEEKSR

SEQ ID NO: 4379 - protein, 180 aa, Artificial Sequence; identical to SEQ ID NO: 4378
  Synthetic

SEQ ID NO: 4380 - protein, 188 aa, Artificial Sequence
  Synthetic
DDKRLLEEIRRRADELIKENEELLRRLEKLNEDLERRNKELNERLAERVKRLEEDVRRRGLPREDVRRKIEDLRRLARELHEEDKKLNEEAKRLTETSRKRNKELNDEIRKLVKEIEERIEELERRGSDRRIVEEEVDRVRKTIEELKRKSEDLVREHEEIVRDLERKSRELVKKVEKLLRDVRERAR

SEQ ID NO: 4381 - protein, 188 aa, Artificial Sequence; identical to SEQ ID NO: 4380
  Synthetic

SEQ ID NO: 4382 - protein, 181 aa, Artificial Sequence
  Synthetic
SVDEMLKEIRDRAKKVDEDNRRLVERLEERNRELDERNKRLLDDIRRKVEEVMRIADERVDKKEELDRLKDELRRSLKRLEDLSKENHDRNRELNKRSKDRSEELHEELRRLLKEITDIIRAGDSGKELVDRVRKLLEEVRRKSEKLVREHEDLVRRNEEHSRRLVEEADRILERAKRELD

SEQ ID NO: 4383 - protein, 181 aa, Artificial Sequence; identical to SEQ ID NO: 4382
  Synthetic

SEQ ID NO: 4384 - protein, 181 aa, Artificial Sequence
  Synthetic
SVEEMLRRLRERDEEINDRLRRLAEDLKRENKRLDDENKKLVDEIREDVERLKEKLDRKLRDKDRMRELKRELEELLKELEEKSKRNHDRNKRENEKSEKILRELHKENREEVKRATEILEEGDTGSELLKRWEELLRRLEKRIRDLVEDHKRLVEENERHSRKLVEEVKKALTDAEKKVE

SEQ ID NO: 4385 - protein, 181 aa, Artificial Sequence; identical to SEQ ID NO: 4384
  Synthetic

SEQ ID NO: 4386 - protein, 181 aa, Artificial Sequence
  Synthetic
SVEELLEDIRRRVEKVKEDNKRMLEDLERKNRELKKEADDLAREIKKRVRDLEKELDEKLTDEEKVERLKRRLKKKLDELDRKLKENEDRNREENEKSKEDSKRLHEKLERLRERIERIVRAGDSGSKLVEEVRKLLEEARRESEELLRRHKKLVDDNRRHIRKLFEDVKKILDDARKEVE

SEQ ID NO: 4387 - protein, 181 aa, Artificial Sequence; identical to SEQ ID NO: 4386
  Synthetic

SEQ ID NO: 4388 - protein, 175 aa, Artificial Sequence
  Synthetic
SEEEEIVKDVERVIRELEERHKDLVRRAREDIKRLREHIRRSIRALDEDIKRIEEKIRRDGDDREVEEHIKRSKDELRKDEKRIEDHIRRSREKLDRDVERMEEEHKRLEKELRDRGLSEDLVRDLERKNKRVIDESRRLLEELRRRYEELLREYRELLEDLRRKYKRIEDEAKR

SEQ ID NO: 4389 - protein, 175 aa, Artificial Sequence; identical to SEQ ID NO: 4388
  Synthetic

SEQ ID NO: 4390 - protein, 175 aa, Artificial Sequence
  Synthetic
SEKEEIVKTVKTVIDRLEEEHRKILEDLRDDIRRADEYIKRSIDEVEEDLRRIEETVRRDGNTKEVEKHIEDSKRELEKNADKLRRHIEESRKELERLIREADEKHKKLDEDLKRAGLEERLVRELEKENEKLKRRSERMLEELEKEYRRLLKKYEDLLRELERKYEEIKDKLRK

SEQ ID NO: 4391 - protein, 175 aa, Artificial Sequence; identical to SEQ ID NO: 4390
  Synthetic

SEQ ID NO: 4392 - protein, 175 aa, Artificial Sequence
  Synthetic
SEDEDIVRKAKEDIERLKREVEETIKRVEDDARKVEKEVRDIVERTRKEIKKLEDEVRERGNTKEVERKIEELKKEHEDRNKKLVDHIKRSEEELRRLAKELEELIRRLKEELEKAGLKEKLVEELRRELEKLKKEIDDLLRDLEKKYDDIRKKIRKLSEELKKLLEELKRKLDE

SEQ ID NO: 4393 - protein, 175 aa, Artificial Sequence; identical to SEQ ID NO: 4392
  Synthetic

SEQ ID NO: 4394 - protein, 175 aa, Artificial Sequence
  Synthetic
SELEKIVEEVRRDIKRVRERVEEIIRKTDEMIRRLEEHIKRSIERVRKDAEDIERTVRRDGNDKELEKHLEKSKRELDKDAREVDERLKDLERRHREANKRLEDHIRRSEEELRRRGLDKDLLDELRRRYEELEERIRRLSRELEEKLKKLRKRYEDLLEELEREYRRIAEEARR

SEQ ID NO: 4395 - protein, 175 aa, Artificial Sequence; identical to SEQ ID NO: 4394
  Synthetic

SEQ ID NO: 4396 - protein, 175 aa, Artificial Sequence
  Synthetic
SEEEKIVEEVKRDIKKVDDEVKDIIRRTDKAIKDLRREHKELIDRTRKAIEELEDEVRKRGDDEKLRRKIRELEKRHERANEELERKHRKLETDHREMNERLKRHIRESEKKLEKDGLREDLVDELRKLYDTIREKIKRLSDRLREKNEKLKKESDDLSRRLRKELEKLEREVRR

SEQ ID NO: 4397 - protein, 175 aa, Artificial Sequence; identical to SEQ ID NO: 4396
  Synthetic

SEQ ID NO: 4398 - protein, 184 aa, Artificial Sequence
  Synthetic
SKEELLKEIRDELRKLKKKHDDLLEEIKREYDRLREKVRKDLEDIERKLRKLEEDVERKDVREEEKTDLDRLAKELREELKRIKKKIDDHIRRSEEELKRHHDEIRKILKKLKEELDTAASQDLREEEVKRVVERVKELIKRLEDNIREAIRKLREDIKRLEEEVEKARKDVEDFLRELRKKVK

SEQ ID NO: 4399 - protein, 184 aa, Artificial Sequence; identical to SEQ ID NO: 4398
  Synthetic

SEQ ID NO: 4400 - protein, 184 aa, Artificial Sequence
  Synthetic
SSDELAEELKREYDRNKEEHKKLLEELKKEYKRLLDEHRDLLRRIKERLDRLLRRIEEKDVREEDLKRLRKLVDDLRKRLKKHHEEVKEHIDRSRKELEDHHRELDEDHRRAEEKLRRMRSQDLREELVERVIRDVRKHIEDNTENIRRDIERVRKDIETLEENVKDAAKKVEDILKTLEDEVK

SEQ ID NO: 4401 - protein, 184 aa, Artificial Sequence; identical to SEQ ID NO: 4400
  Synthetic

SEQ ID NO: 4402 - protein, 184 aa, Artificial Sequence
  Synthetic
DKERLAEELRRLYERNKREHEKLLKKIEDDLRKLEEDHERLLREIEEAAERLRREIERKDVDEEKVRRLETELRKLREELKKHHEEIKRILDKLRKDLKKHHEELKRDHDKAEEELRDVESRDLREELVKRVVDRVRRHIEENTKNIEEAIKRVEDVIRELRKNIEEAIKRVREVLKRLKDEIK

SEQ ID NO: 4403 - protein, 184 aa, Artificial Sequence; identical to SEQ ID NO: 4402
  Synthetic

SEQ ID NO: 4404 - protein, 184 aa, Artificial Sequence
  Synthetic
SEDELLDRLREKYERNKERHKRLLDELRKRYEDLKREHEKLLRDIEEELKKLEDKIRRKDVPEEDLKRMKKLADDLRRELEKHHEDIKDHIRRSEEELREHHERVKDDHRKAEETLKDVRDRDLREDLVRKAIEDVDRHIKENTKNIEDTIRKVKKNIEDLKRNVEEAIKKVKEVLREIEERTR

SEQ ID NO: 4405 - protein, 184 aa, Artificial Sequence; identical to SEQ ID NO: 4404
  Synthetic

SEQ ID NO: 4406 - protein, 184 aa, Artificial Sequence
  Synthetic
SKEELLKRLKERNERLNEDSERLAREIKRRLEELRKEHRRLLKEIEERLKELEEDIRRKDVPEEKLERLKREIDRLREELKEHHKRVKDELDRLKKRLEDIKKDHDRKDRKVKEELEDMARRDLDEEDVKRVIRRWEELLKELEKDNRRVVKEAKELIDRLERNIRERIKEVRDALREIRKKVK

SEQ ID NO: 4407 - protein, 184 aa, Artificial Sequence; identical to SEQ ID NO: 4406
  Synthetic

SEQ ID NO: 4408 - protein, 184 aa, Artificial Sequence
  Synthetic
STDEKLKELEKRNRDLNEESRKLAEEIRKRYEDLKKEHEDLLREIEKRLRDLMREVERKDVPEKDLEELKEDARRLREELRRHHEEIERHIRESEKELRRIEDEHRKEDEKVKKELKDVRERDLDEKSVDDVIRRWEELLEELRRRNEEAVRRMERNIDELRRNVRETIDRVRKLLEEIKRKVD

SEQ ID NO: 4409 - protein, 184 aa, Artificial Sequence; identical to SEQ ID NO: 4408
  Synthetic

SEQ ID NO: 4410 - protein, 178 aa, Artificial Sequence
  Synthetic
SEAERVVEELERLLKKNRDDNERVIRRLEELLDRLREKNERAIEELRKLLDELKKVVDRGDVSERVVDKLLKEIKEKIDRVREEHRKLLEDIERTIRKVEKEHKESIERIRRRAEELKDLIRRELLREIEERLKTLSEESKRLIDRIREELKRLTKESEDLLKDIERLLREVKERART

SEQ ID NO: 4411 - protein, 178 aa, Artificial Sequence; identical to SEQ ID NO: 4410
  Synthetic

SEQ ID NO: 4412 - protein, 180 aa, Artificial Sequence
  Synthetic
DEMEDLRRDVERIHEESRKLSEDSVRTAEKIHRESEKLIDDLRRKVEKILKEVEDVVRRGDSDEKLKTRLRDLKRKLEKEAKEIMDRHERLAEELKERNKRINDDHRRKNEELKDELRRKRVGPEEELKKLEDRSRKLLEENKRLNEDLDRRSEELKARLKDILRRIDERLRDLEREADR

SEQ ID NO: 4413 - protein, 180 aa, Artificial Sequence; identical to SEQ ID NO: 4412
  Synthetic

SEQ ID NO: 4414 - protein, 180 aa, Artificial Sequence
  Synthetic
DEVEELKRRAEEILRKYDEDSKRIVEEAERIVRTSAEKIERLRKKAEDILREASKVVDDGRSEEELARRLTELTKRLEDEAKRIADEHDKLDEEIKRKIEELNKELKKLADDLRDRLEKERAGPERDLEKIETDVERLERKSKKLLEDLREKSERLKKRLEDILKRIKEEVERLKRKVEK

SEQ ID NO: 4415 - protein, 180 aa, Artificial Sequence; identical to SEQ ID NO: 4414
  Synthetic

SEQ ID NO: 4416 - protein, 180 aa, Artificial Sequence
  Synthetic
DEMEELKKEVEEILKEYEKRSRDLFKELKEILRRSKELSEDSKREADKILRDAEKVVADGDRREKLMETLERLLRRLEERNKRINEEHDKRDKDIEERVKKLNKELRDLVRRLREELRKRRAGREDDLRRIEEKVKKLEKESRELLKRIKDESEELKRDNKRLNDEVREELEKLKERVRK

SEQ ID NO: 4417 - protein, 180 aa, Artificial Sequence; identical to SEQ ID NO: 4416
  Synthetic

SEQ ID NO: 4418 - protein, 180 aa, Artificial Sequence
  Synthetic
DEMDELRREVKEILKTTEELIKRLEDKVRDILRRYKEVSDDIVRKAEDILRKAEDILRRGDSREEVSRELKRLLDELEKEIRKLNEDLKRLLDELREELERIVKTHRKLDKDLEDRLRKRRAGEERELEEIKKESEDLERRLKKVLERIEREVRRLEEETKELLKRIAEEVERLIREAEK

SEQ ID NO: 4419 - protein, 180 aa, Artificial Sequence; identical to SEQ ID NO: 4418
  Synthetic

SEQ ID NO: 4420 - protein, 180 aa, Artificial Sequence
  Synthetic
KEAEDLVREVERILEDYDRVVKELKDDADRILEESRRLIEELKKKAEDILRRVRKVVEDGDSRDDLKRELDKLAEDLAREAKEIADRHRKLDEELERRIRRLDEELKRLARELEERLARDRVGPEELLERIKDRLRKLHEKSKKLLTDIKRESRRLEKRLEDILKRIKEEADKLKEEADR

SEQ ID NO: 4421 - protein, 180 aa, Artificial Sequence; identical to SEQ ID NO: 4420
  Synthetic

SEQ ID NO: 4422 - protein, 174 aa, Artificial Sequence
  Synthetic
REEELERRVREESEELNRRLAEVHKRLRKKSKELNDRHKELDDRIRREADRLRKDIRRQGKEDDKLDREIKEIERELRKRSEELHDTNRKILRENEENLRRLHKENRDIERDLERKRLDDEVLKELKEMHDRLREHVKRDSERAERMHEELKRLSDELERRVREALKRLKEKVR

SEQ ID NO: 4423 - protein, 174 aa, Artificial Sequence; identical to SEQ ID NO: 4422
  Synthetic

SEQ ID NO: 4424 - protein, 174 aa, Artificial Sequence
  Synthetic
KKEEVRKRIEEELRRLKKDHRRLDEEIKRKLKKLDEEIKEVHERLKKAARDLEDEARRNGKRDDKLTEEIKEIIRRNKKNVDDLRRELKRIDEELKKESEKLERKADEIEERLRRREQTKEVEKDVEDLLKELEDDSRRLEEEVERLIERVKRHVERDERRVREMLREIKEKIK

SEQ ID NO: 4425 - protein, 174 aa, Artificial Sequence; identical to SEQ ID NO: 4424
  Synthetic

SEQ ID NO: 4426 - protein, 174 aa, Artificial Sequence
  Synthetic
SKEDLDRELRRLSEELNREHKELDERIRRELEKLRTRIDKVHEDIRREMKRLEDEVRKRGREDDRLRTKVKKILDDNKENVDRLRDELRKIKEELDRESKKLHDENEKIKRDLEARELTEEVFEDAERLHRELKKKSRDLEERVKKLLEEIEDHVRRDETRVRKVLRDIEEDIR

SEQ ID NO: 4427 - protein, 174 aa, Artificial Sequence; identical to SEQ ID NO: 4426
  Synthetic

SEQ ID NO: 4428 - protein, 174 aa, Artificial Sequence
  Synthetic
SKEDMLREAEERSRRLNEDHKRLDDELRKESEKLNRRHRDLDEKIDRELRRLKKDIRRRGKQDERLEREMKEKKDELDRLSKELHDKNREIKERLDRLSETLHKENEDIKEELRRRELTRELLERLRKVHEDLKKKSEDLKRTAEKLHRELEKESRDLVRDVERALDELRRKVE

SEQ ID NO: 4429 - protein, 174 aa, Artificial Sequence; identical to SEQ ID NO: 4428
  Synthetic

SEQ ID NO: 4430 - protein, 177 aa, Artificial Sequence
  Synthetic
SSEELLRDIERRLEEMNRDTERVVEEIRRRLEELRKRHKETIDKIREELKKVEDLVRRRGLDEDTSRELKELMRRLEEKLKEHHERLRELLERLEKELREAKERLDRKTEKIKKDLRKDGADEDVLRRAKRLIEKYKEDTKRIKEKLEKVIEDLRKNIEDFEEDVRRVLEELKKRIK

SEQ ID NO: 4431 - protein, 177 aa, Artificial Sequence; identical to SEQ ID NO: 4430
  Synthetic

SEQ ID NO: 4432 - protein, 177 aa, Artificial Sequence
  Synthetic
SSRELLERIKEELKELEDRHRDLLRRIEEKLERLNRRTREVLERIKRKLDELKKRVEEAGLDEDSRRRLEKKLKEIRDKLDEIRRRLEDETRKIKEELRRHHEEVRKRLRDVERRLREKGVDEDLLREVKELIERLRENIKRAKDKVEELIKKYKRDTDEAKKEVDEEIKRLKEEVD

SEQ ID NO: 4433 - protein, 177 aa, Artificial Sequence; identical to SEQ ID NO: 4432
  Synthetic

SEQ ID NO: 4434 - protein, 177 aa, Artificial Sequence
  Synthetic
DSERLVREIRERLKKLEKEHRELLEEIKDRLRRLNEESKKLLDDIKRRLEELRDRIRRAGLDEKTLTDLERILRKIEEDLKRMKEELDRLTREIERELEEHHKDIKRRLDEVRKELEKRGADEDVLRDLEKLIEDLKRNIERARAKVEKLIKEYEDKLEKIVRDAEELIKDLDRKVK

SEQ ID NO: 4435 - protein, 177 aa, Artificial Sequence; identical to SEQ ID NO: 4434
  Synthetic

SEQ ID NO: 4436 - protein, 177 aa, Artificial Sequence
  Synthetic
SSEEILRKIEEELERLEREVRKIHRDNERKSEELNRRSKKILDDIRRELDRLKKEAEEKGSSEETKKDLERLRRELEERLKEVEKESEELRREDKERNDRVREKLKELKKDIKRLLDEKGIDKEVVKEMRRALEEIKKEIEKVRKELEKRNREYRKRSEEVREEAERKLEEIKRRTD

SEQ ID NO: 4437 - protein, 177 aa, Artificial Sequence; identical to SEQ ID NO: 4436
  Synthetic

SEQ ID NO: 4438 - protein, 177 aa, Artificial Sequence
  Synthetic
RSEEILREIRDRLRKLNEESEKVHEENERRSRELNERSREILKRIDEELKRLKKEVDDKGADEKLKDELRRLVRRVEEELRRVEEESERLKREDDRKNEDVRRKSEELARDIERATREKGIDDDVVRDLKKKLERYKRETDRVRKELRDLNKKYEDRSREIKRELERLLRDIKRRID

SEQ ID NO: 4439 - protein, 177 aa, Artificial Sequence; identical to SEQ ID NO: 4438
  Synthetic

SEQ ID NO: 4440 - protein, 184 aa, Artificial Sequence
  Synthetic
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 4441 - protein, 184 aa, Artificial Sequence; identical to SEQ ID NO: 4440
  Synthetic

SEQ ID NO: 4442 - protein, 184 aa, Artificial Sequence
  Synthetic
DVKEVLDDAERKLREVLKLIEDSLKKLKELSDEVIERIARSLEKLEKLIRDVDEELKRKVSDKDKLKRLKEKLDKVLRENEKLVEDLRRENKKVNDRNKRLVDELRRRLKKVKEDLERRVAEEDDKEVVKEIKERVDKVVDEARKLVEESERSIRELVERSKKVVEESERSIEELRRELKETVK

SEQ ID NO: 4443 - protein, 184 aa, Artificial Sequence; identical to SEQ ID NO: 4442
  Synthetic

SEQ ID NO: 4444 - protein, 184 aa, Artificial Sequence
  Synthetic
DLEEVRERARRLLRKLEEDLERVHKEMEELLRELEERIKASLERLDELLKRLADKLRRDVKDDDKLRKLDKKLKEAKKTNKDLADELRKELEEALRESRRSIDELRKDLERVTEEIEDILRKRKTKEVVKEIEDRVRKVAEKVREVIERNRKLVRDVLDKIRRMLKESERSVEEVLKRLDDELK

SEQ ID NO: 4445 - protein, 184 aa, Artificial Sequence; identical to SEQ ID NO: 4444
  Synthetic

SEQ ID NO: 4446 - protein, 181 aa, Artificial Sequence
  Synthetic
SLDEVVKRLEDLLREVEEKSKESSKRMEDLNREVNERLRRSSERLKRLNDEVKKRLEDAGRDDKIRRTLERLSEDTKRKSDKTNEDLKRLSDETRERSKRLNEELRRLVEEVRRRLEDLRRKGSPVEEIKKLADKVVTELEKLVEDDRRLAEESFERARKIVEEDERLARESVDRARRLVD

SEQ ID NO: 4447 - protein, 181 aa, Artificial Sequence; identical to SEQ ID NO: 4446
  Synthetic

SEQ ID NO: 4448 - protein, 184 aa, Artificial Sequence
  Synthetic
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGEDEKLVEDLKRRAEEVIRELREIVKRNTEIAREVVERAKRIVEKNEKLLKDVVEEAKKIVK

SEQ ID NO: 4449 - protein, 184 aa, Artificial Sequence; identical to SEQ ID NO: 4448
  Synthetic

SEQ ID NO: 4450 - protein, 173 aa, Artificial Sequence
  Synthetic
SELEKAKEDVDRLLEDVNRVSEEVEDRVRKLLADSDRVLEEVERRVREVLKRLKDAGVPDEELERARRTLEDIIERLREKNKEVKERLRKIIKEDREVNERVEERVERLTREAKDKDVKTVADELRKVVKELLEINRRSLEELTKLVDESRRVNEKVMEELKKLVDDLRRRIE

SEQ ID NO: 4451 - protein, 173 aa, Artificial Sequence; identical to SEQ ID NO: 4450
  Synthetic

SEQ ID NO: 4452 - protein, 178 aa, Artificial Sequence
  Synthetic
SEIEKVKEVVREVIERSRKLLKEVRDTVEKVIDESRKLSDTVRRRVEDAIRDVLERRGDEDDELRRVKEELKKVIDENEDLNRRVEETLREIIKRLAEENKRVEDSLRKVIKDIERVRSREEVKKVIEDLTREAKRSLERNREVVKELKKLADDLKDLNKKSVDRLDDLVRRLKERTE

SEQ ID NO: 4453 - protein, 178 aa, Artificial Sequence; identical to SEQ ID NO: 4452
  Synthetic

SEQ ID NO: 4454 - protein, 184 aa, Artificial Sequence
  Synthetic
KRAEDVLEKLREDAKRVLKRNRDSVKEAEDLVRKSLRTSEEVVKTLRTELKKLLDELDRVKSEEARKRVEDVRDRLKREVDKLDRVSEEVEKTLEDLNRKNTEDNKRVVDRLREELDRLRREGLPEKVLRDIEREVRKIIKELEDMDDELRRILEEVIERSRRVNERLKELLKEADDRLREKLR

SEQ ID NO: 4455 - protein, 184 aa, Artificial Sequence; identical to SEQ ID NO: 4454
  Synthetic

SEQ ID NO: 4456 - protein, 181 aa, Artificial Sequence
  Synthetic
DAAEELLRLVEDVARELKRLVDELLKENRETVERLKKVVKRSEEINREVVRTLRELVANNGDKKEIDRIIKELKDANDKVAEDLRRVIEEDRRRNDEAAKTLRKIIEDLRRALEDVVRKRGEDEKIKEVRRSIEEARRRVEEALREVNEASKEAERTVREALKRSREAVEKAVRDVTEAAR

SEQ ID NO: 4457 - protein, 181 aa, Artificial Sequence; identical to SEQ ID NO: 4456
  Synthetic

SEQ ID NO: 4458 - protein, 178 aa, Artificial Sequence
  Synthetic
KELEDVLRESEKTAEELLRRVKKSIDRTRDVVRRLLEEIRKSIEETKRVADEAKREDRDEEVLKKIIRELEERSKKVEEDLERIIRELREESRKVEKELRDLIRRNEEKIKRVIERRGETDLVRRLERISEEVRRRVEKLVREDRKILEDVARALRELVKEDEEILRRVVKDLRDKTR

SEQ ID NO: 4459 - protein, 178 aa, Artificial Sequence; identical to SEQ ID NO: 4458
  Synthetic

SEQ ID NO: 4460 - protein, 175 aa, Artificial Sequence
  Synthetic
DEDKKVVRKVERIIKRVKELHDKSVRDSEEVVREVLKRHKESVEKIKEIVRRIVEIAARGDFREEVKKRLEEVIRELREENAKIHRELKELLERSRRRNDEIHRELKERLKEILEEAKDIEELKEVIRRVEKLSEDVKRENEKSNDEVRKLSEDAIRENEEVLRRARKLVDDLRR

SEQ ID NO: 4461 - protein, 175 aa, Artificial Sequence; identical to SEQ ID NO: 4460
  Synthetic

SEQ ID NO: 4462 - protein, 175 aa, Artificial Sequence
  Synthetic
DEEKEVVKKLRDIIREVERLHTESVRKVEEIVRRVLRLHKETVRELKEIVKRIVDIARNGDRREKVEDELRRRLEEIERKNKEIRDELKRLIDEVRKENTEIHDRLKKELKKILDEAREIRELEKVAKEVEDRSKELLDRNEEVLDRVRKLSEDVLRENREVIERVREEVKKESK

SEQ ID NO: 4463 - protein, 175 aa, Artificial Sequence; identical to SEQ ID NO: 4462
  Synthetic

SEQ ID NO: 4464 - protein, 180 aa, Artificial Sequence
  Synthetic
SEADKVVAELEKIVKDVVDAHKDSVRKLREIVRRAVERLRKDVDDTRRVVKEIVDIARSGDMREEVRKRLEELLRRSEEHSEKVERDLERVLKEVEDTNRDIKRRLEKRIREIEEKIKDLDERVRRKLEEVVKKVRDLSRRATEEVEEVIKEVRELVRRLKEENKRVVDEVRKRVEDTRK

SEQ ID NO: 4465 - protein, 180 aa, Artificial Sequence; identical to SEQ ID NO: 4464
  Synthetic

SEQ ID NO: 4466 - protein, 182 aa, Artificial Sequence
  Synthetic
KSMEDVVRKLDELVKTDKEIADRVVKELKDIVKRVEELVEDIVTKSRASVERVRDVVTRGVSEEELKRIHDENRRLIEEAKKRLEEIRREIEELVRRVEEESKRLNEELKRLIDDVTDKKRDVREAKELLDRLKRRLEKSTEEVKKKLETVLRELEEVIKRVKEELERVNRELRKVIEDAKK

SEQ ID NO: 4467 - protein, 182 aa, Artificial Sequence; identical to SEQ ID NO: 4466
  Synthetic

SEQ ID NO: 4468 - protein, 177 aa, Artificial Sequence
  Synthetic
ELEKLIRDVVRENEESAKEAHRRIKEVVRTSEDLVREVRERVRRIVESSKRVVEEVRKKMDEEELRRLVEESRRNVEEVRKALKKVEEDSRRNVEKVERDLEKLDRDNEREIRELRKRVKDMEKLLRDLKKLIEDNERVVRELKKNLDDDSERVKRVADELLKNLKKDTKKVKDTAK

SEQ ID NO: 4469 - protein, 177 aa, Artificial Sequence; identical to SEQ ID NO: 4468
  Synthetic

SEQ ID NO: 4470 - protein, 186 aa, Artificial Sequence
  Synthetic
DEAEDVVKRADDIVKRNRELLERVVRDLERIVRKNKDIVRKVVDEAKKLVKTVEDLSRQDNKREELRRRLEEVKERLERLVDKLRRESEKSKRELEKLLKELRDLSRKTEEELRKLVEDLRRKLKNVKEVEDLLRRVEEKLRKSVKEVEELLDTVRRRLEDSSRDVKRLLKEVLDRLEDVLDKEEK

SEQ ID NO: 4471 - protein, 186 aa, Artificial Sequence; identical to SEQ ID NO: 4470
  Synthetic

SEQ ID NO: 4472 - protein, 186 aa, Artificial Sequence
  Synthetic
SAVEEADKEVRRILKKNTDLVRRVVEEAKKILDRNEKRVREVFKELTRLLDELRKLIEEGNREERLRELLDRVRKRLKEEMDKVRKEDEKSREDLRRLVRELEELSKRTKEELDELTRALRKDLKDVEEVERLLRELERRLEDSVRKARELLKDIERRLRESIKRSEELLRDVERRLKELEERLEE

SEQ ID NO: 4473 - protein, 186 aa, Artificial Sequence; identical to SEQ ID NO: 4472
  Synthetic

SEQ ID NO: 4474 - protein, 177 aa, Artificial Sequence
  Synthetic
DVEEELKRVVEKLRDVERKVRELNKRVTDKNEDVVRTVRELNERVTRENRRVVEDIDRKKRTKDLKKLLEDSERNVDRVNKESERLIRESKKNVKDVNEESERLIRKVAKDLERLTERVSDLDDVLRRLEELVKDLERLIEESVRYLERNVERSRELVERSLRYLKENVDRSRKLAE

SEQ ID NO: 4475 - protein, 177 aa, Artificial Sequence; identical to SEQ ID NO: 4474
  Synthetic

SEQ ID NO: 4476 - protein, 175 aa, Artificial Sequence
  Synthetic
DEVREVVERARKLVKDNLDAARKAVKRLRELVKENLDTVRDVVRKLRKLVEDLKRLIRSGGSEEAVKRLKEELERLIKEVKERSDETRKRLEDLIRELEERSKRTAEELEKLIREKAKGKELADEVRELAKRSHEELKRLLDEVRKLLKDSERALRKLLEDVRREADKVAEEVRT

SEQ ID NO: 4477 - protein, 175 aa, Artificial Sequence; identical to SEQ ID NO: 4476
  Synthetic

SEQ ID NO: 4478 - protein, 175 aa, Artificial Sequence
  Synthetic
SEVDEVVRRARELVKKNRDDVKKVVEDLRRIVKEDLDTARRVVKRLRELVEELKELIRSGGSEELLKKLKEDLKRLLDKVREESKRTNDRLEELIEKVARDSRKTLEELKDLIRKKVRGKELADEVDELMKDSDRELKRLLEEVRKLAKRSTDELERLIEEVRKELEDVLDEARQ

SEQ ID NO: 4479 - protein, 175 aa, Artificial Sequence; identical to SEQ ID NO: 4478
  Synthetic

SEQ ID NO: 4480 - protein, 179 aa, Artificial Sequence
  Synthetic
SREEELLERLRRVVERNKKLVDDLADRADKVVKENEKLVRDLLEESRKTSEILDRLVKNRGDERRLEDIDREDRKTLKDVKDTSRESKKRLEDELKKVEDESRKLTRELEERLERAVRERGREPELVEEVRRLSEKSNRDLKELVKDIERKLDKVHKDLEKVIEEVERSNERVKEEVKT

SEQ ID NO: 4481 - protein, 179 aa, Artificial Sequence; identical to SEQ ID NO: 4480
  Synthetic

SEQ ID NO: 4482 - protein, 182 aa, Artificial Sequence
  Synthetic
SDAERIVEEAKRLVEENTELVERVLEKLERLVRENRTLVERVIEELDDLVRRIEDVVRRGVDEKDIAKLEKELRERIKEVRDRSKKTRDDLEKLIREVEERSKESTRKLEELLRDVTRKNKDSKKLEKLLREVERLMEESHKRLKEVADTARRLMDDSERELDRLLREAEKKIRDVREEIRR

SEQ ID NO: 4483 - protein, 182 aa, Artificial Sequence; identical to SEQ ID NO: 4482
  Synthetic

SEQ ID NO: 4484 - protein, 182 aa, Artificial Sequence
  Synthetic
SLVDEILKDLDRLVEENEKLVKKIVEDAEELVKRNTDLVEEVLRELKEIVETIRDLVRRGVDEDTIKKLEDDLRRKEEKVRRESKRSVERLEELAEEVRRESKRLTEELKRLVEDVLRRAKDVEELKDVLRRVEEKIRKSNEKLEKLLEEVSRLAKRSDERLKKVLEDIKEEIRKVKEDLER

SEQ ID NO: 4485 - protein, 182 aa, Artificial Sequence; identical to SEQ ID NO: 4484
  Synthetic

SEQ ID NO: 4486 - protein, 181 aa, Artificial Sequence
  Synthetic
SLEEVVKKAEDLLKRVNDELKKVSKKVRDDLRRVNEKLKTVVEDVLRKLEAVVDKIRKSGVDEERLRELKELIERAKRELERILEESEKTTRDVERESEESLDRSRRTTEEAKRELDDVRRRGVDVKDVDKRIRDVVRRHEEVVETNARRVDEVVKRHDKLVKDLERRVEKVVRELEEKVR

SEQ ID NO: 4487 - protein, 181 aa, Artificial Sequence; identical to SEQ ID NO: 4486
  Synthetic

SEQ ID NO: 4488 - protein, 181 aa, Artificial Sequence
  Synthetic
SLDEIVKRAEEELKRLNEELKRVSDRVKERLDRVLDELRRISERIKELLERVKRKLEREGVDEDTLRELARELKELEDRSRESLKRVEDLIRKVEEDSKESLKESKRLTDDARRRLDEIRKAGVDAEDLRREVEEIIRRHKEVIRKNEEDVKRVLDTLREMLKKNKKLVDDMVRKLDETIK

SEQ ID NO: 4489 - protein, 181 aa, Artificial Sequence; identical to SEQ ID NO: 4488
  Synthetic

SEQ ID NO: 4490 - protein, 177 aa, Artificial Sequence
  Synthetic
SEAEKVLEKVERVAREVLERIKRIVEHTKRVVEDVIRRADESVRRSEEIMEDVRRKVDSEKVEEIERRVREVVKENRRLVEELRERVRRVVEENKRLLEEIERIVREVVRRVEELARRNGPKEDVERLVRTVKEELDRLVDESRKLSRDVRETLEELVKRSEDVTRRVEETLREIVK

SEQ ID NO: 4491 - protein, 177 aa, Artificial Sequence; identical to SEQ ID NO: 4490
  Synthetic

SEQ ID NO: 4492 - protein, 177 aa, Artificial Sequence
  Synthetic
DELERILEEVKKVVEEVVRRAEESVKKTEDVMRKVVERVARSLEESRRVAEEVERRIRSEKLRRVREIVKEVVRINEELVKRVKDIVREVLERNRDLVRRVRDIVRRVEEEVKKLADNNGPEKDVKRLVDEVRKELEELVRRSEELTKEVKKTLEELVKESKEVVKDVEKKLREIEK

SEQ ID NO: 4493 - protein, 177 aa, Artificial Sequence; identical to SEQ ID NO: 4492
  Synthetic

SEQ ID NO: 4494 - protein, 181 aa, Artificial Sequence
  Synthetic
REVDEAVKNNEEDAKESRRVVEEAVKRDEDIARDIERRAREVVERDKEIVDEVRRRVKDEKKLREVVTLSKKIVDETKEIADRVLELSKRIVKETRDIAKRVLKLNDDSVKDVRRIAREVRSKEVKDLLDENSKRSNEISREVKKDLERTVRENKKIVDEVRKKLEDTVDKNRRIVEEVTT

SEQ ID NO: 4495 - protein, 181 aa, Artificial Sequence; identical to SEQ ID NO: 4494
  Synthetic

SEQ ID NO: 4496 - protein, 181 aa, Artificial Sequence
  Synthetic
SEVDKMLKRSNDIVREIARVVEEAVKTDERIMREILEHARKVVEEDKEIVDRVRKEVEDEEKLREVVERSRRIVKETEESAEEVLRRSAEIVKDTKRIAEEVRRRSKRISDEIRRIAREVRSEEVVRRLRTLVEENRKIVEDVKRELERTVRDNRRIVEEVAKRNHDTVRENKEIVDRVKT

SEQ ID NO: 4497 - protein, 181 aa, Artificial Sequence; identical to SEQ ID NO: 4496
  Synthetic

SEQ ID NO: 4498 - protein, 180 aa, Artificial Sequence
  Synthetic
KEAEDVIELVRRILEEVDRRVRDVLRKDEESLRRVKKTVEEVLKRHKDIEDEVRRRVRSEKLRRLVKKVRDMLKNVEKLARELIEKVARSIEKTKKIAEDLIRKAEEVLREVERVRDELDSEEVKRVLEEIVKKVEEIVKDVERKLRKTVEENEEVVRRVKRYLEKSVEDLEKVVRDVTT

SEQ ID NO: 4499 - protein, 180 aa, Artificial Sequence; identical to SEQ ID NO: 4498
  Synthetic

SEQ ID NO: 4500 - protein, 177 aa, Artificial Sequence
  Synthetic
SAEDILREVEELVRRTRKHLEDSLREVTKLVEETKREADRILKEVRDRVKEVIERGRDKKDLVRELEKAIEEVERRIRENVRRNEKVVEDHERLIRENEKKNDDAIERIRKIVAETKDEEVLKTVREELRDIIRRSVEHNRDSLRRLREIIERSLRHVEEVLERVRKEIERIKRETK

SEQ ID NO: 4501 - protein, 177 aa, Artificial Sequence; identical to SEQ ID NO: 4500
  Synthetic

SEQ ID NO: 4502 - protein, 177 aa, Artificial Sequence
  Synthetic
SAEDILREIKRLVEETERLLKRILEEVRKLVEETRRRLETILRRVEEKVRRLVEKGRDKRELKKRLEDVIEEIRKIIEDNIRRNDRVVEEVERLIEEDLRDNRRLVRRIEEIIRRVKDEETLKRALDEARKIIEESKKHVKDVLRKVTDEIRESKKDVERVEDEVDKRIREVDERTK

SEQ ID NO: 4503 - protein, 177 aa, Artificial Sequence; identical to SEQ ID NO: 4502
  Synthetic

SEQ ID NO: 4504 - protein, 181 aa, Artificial Sequence
  Synthetic
SIDEVAEEVERLLEEVKETSREVLERVKRELEKIIDTSRRILEEVRRLLERVLEEVERRKKNRERVRELVRRLLERARKVLEDNKDSVRRILEKLKEVLKRNEESVARIKEELERVRRDVKDDRDVKRVLDKVRKKIEENKDTVRRVEEEIKKLIEDNKRTSEKVRKEVTDIIEEIKEEIK

SEQ ID NO: 4505 - protein, 181 aa, Artificial Sequence; identical to SEQ ID NO: 4504
  Synthetic

SEQ ID NO: 4506 - protein, 176 aa, Artificial Sequence
  Synthetic
DVEDVVREAEDLLRKLEEKSRKVVEDAKRLLDEVKRKMEESVKEAKRLLDEVLRKSDEEKIRELVKRLEEINRRSLEEIKKLVKTLEEKLREMNERNKESVERLRRELTEARKRIRDKKIVEEVRRRVEEVVRRDEKSVEDLKREVDRVITELDRLVKRNTEEVERVIRRLDEETR

SEQ ID NO: 4507 - protein, 176 aa, Artificial Sequence; identical to SEQ ID NO: 4506
  Synthetic

SEQ ID NO: 4508 - protein, 179 aa, Artificial Sequence
  Synthetic
SEEEDAERLLRDLKRRADEVVKESEKILEDIVRDAERVLRESKRISEEIVRRADEIRRKVRGEEELEKVVRELEKLTRENKERVDRIMKKLAKLVEENERRVRELEEELKRILEEIVRRIGRESRLVEELRRLVEEVRERLDRSVKKTKELLKEVIKELEKLLKKDEDDVERVIRRLED

SEQ ID NO: 4509 - protein, 179 aa, Artificial Sequence; identical to SEQ ID NO: 4508
  Synthetic

SEQ ID NO: 4510 - protein, 178 aa, Artificial Sequence
  Synthetic
SEVEDILRRVEKRARDSLKHLEDVLRKVDKRVRESLDNLRRVLEEVERIVRELERLLDEGTDIEELLRRMEEMIRRIEEKVRRNLDDNRRVVEEVRKEVAKDLRDNERVVKDVRREIRDERLLEEIVRRLEDSLRKVEEIARRIEKRLRDSLRETKRIADEIRKRLEDALRRVEERAR

SEQ ID NO: 4511 - protein, 178 aa, Artificial Sequence; identical to SEQ ID NO: 4510
  Synthetic

SEQ ID NO: 4512 - protein, 178 aa, Artificial Sequence
  Synthetic
SDVEKILDDVRKDAERSLENLKEVLEKVEEEVRRSLEDLRKVLEDVERIARKLEELLKEGVDIRELKKELERVLEEIRRIAEENLKRNKDVVREIRKIVKENLDRNRRVLEKVRREIKDEELLRRIERTLRESLEAVKRIAEEIERTLEESLREVERIVKEMEDLVRAALKRVEDKAR

SEQ ID NO: 4513 - protein, 178 aa, Artificial Sequence; identical to SEQ ID NO: 4512
  Synthetic

SEQ ID NO: 4514 - protein, 178 aa, Artificial Sequence
  Synthetic
SEVEEILRRIKEEVRESLEDLRRVLEEIEKKAKESLRELKEVLERVKEIADKLKRLLDEGRDIRELEEELKKVDEEIDRIARRNKEENRRVLDEVRKVAKRNKDRNKEALRRVEKDIRDEKLLRDIKRDLERSLEAVDKIVKEIMERIKESLKATERIVKEMKDLITRVREEVKRRAE

SEQ ID NO: 4515 - protein, 178 aa, Artificial Sequence; identical to SEQ ID NO: 4514
  Synthetic

SEQ ID NO: 4516 - protein, 177 aa, Artificial Sequence
  Synthetic
DEVEELKERAKRSNEELKRKVEELKKRAKKAIDDVRRVVDENKKLVKEAIDRLRKTDVDEKIIEDLKRKLEKSVKESEDLVRRLEELMKEVVERLKKLVETNKRLTDEVVKKLARVREKETLKKLLEELKKLVDESRRRLDELRKEVEKKVEEMLERARRLLKKTEDLVREVKRRVD

SEQ ID NO: 4517 - protein, 177 aa, Artificial Sequence; identical to SEQ ID NO: 4516
  Synthetic

SEQ ID NO: 4518 - protein, 177 aa, Artificial Sequence
  Synthetic
DELKELEDRLRRAEEEARRLLEEIKKRLKESNEELKRLVEENEKLVKEALRRLENTDVDKKIIETLKRLLEESVERSRRLVERNREESEKVVERLKRILEELRRLLRRVVEEAARVKDKDVLRKLLEEVERLVKRVLDELRALLKEVEDLVRKSVEDLRKLLEETRKLVREMEERVR

SEQ ID NO: 4519 - protein, 177 aa, Artificial Sequence; identical to SEQ ID NO: 4518
  Synthetic

SEQ ID NO: 4520 - protein, 177 aa, Artificial Sequence
  Synthetic
SLVEKLEKRLRDVIKTIEDIIRENEERLRRSNRELEKLVDENRKLVEEVLKRLADTDVDKKIIEELERRLKESLDRSRELVKENKRLSEESVRRSRRLLEELKKLAEEVIERLRRVKDERVLEKLLREVEELAKRVLTELRRLLRETERLVRESEKRLRDLLRDTERLAREVEKRVE

SEQ ID NO: 4521 - protein, 177 aa, Artificial Sequence; identical to SEQ ID NO: 4520
  Synthetic

SEQ ID NO: 4522 - protein, 177 aa, Artificial Sequence
  Synthetic
SLVEDLKRELEKAKEEIEKIVRDLERELDRVIKENERLIRENEDTVRKALERLRRQDVDERIIRELEKKLRESVEESKKSLEEVEREVDEVRKRLDELVKELEKRVREVIEELRRVREEDVLRELKDRVRRIVEEVARRLEELLKKVKDLVKKSLKTNEDLLRKTEELVRRAEERVK

SEQ ID NO: 4523 - protein, 177 aa, Artificial Sequence; identical to SEQ ID NO: 4522
  Synthetic

SEQ ID NO: 4524 - protein, 181 aa, Artificial Sequence
  Synthetic
SEVEEVLKRLKELVDTVLEELKDVIRRIEELLERVRRDNERTIREDEELVRKVLDELRKISDKKTIERIVRRITRESERLLEENHRINKRITEELERLVRELERVVEEIIERLKELLERVKSGELAEEIERVIREAERRLKKLLDELRRLVEEVRRELEELDERLKRSSEEAKKRLDELVK

SEQ ID NO: 4525 - protein, 181 aa, Artificial Sequence; identical to SEQ ID NO: 4524
  Synthetic

SEQ ID NO: 4526 - protein, 181 aa, Artificial Sequence
  Synthetic
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 4527 - protein, 181 aa, Artificial Sequence; identical to SEQ ID NO: 4526
  Synthetic

SEQ ID NO: 4528 - protein, 185 aa, Artificial Sequence
  Synthetic
SEAEELLRRLKELVDEVLKRLRDMIKRSEDLARDVLRKHEDLIRKLEELMKKVEDLADKISDKDTVRELVKEVKKRLERLLRESEKLSKRVKEELKRSLDRSKELVDRVVETVREILKRLRDAGVPEEVVREIERIVREVTERLRRLVEENAEVVKRVEKELKELNDELRRVVEEIVRKAKEKTK

SEQ ID NO: 4529 - protein, 185 aa, Artificial Sequence; identical to SEQ ID NO: 4528
  Synthetic

SEQ ID NO: 4530 - protein, 185 aa, Artificial Sequence
  Synthetic
SEAEELLKRLEDRAEEILRRLEEILRTSRKLAEDVLRELEKLLRESERRIREVLEELRRIKDKKELEDVIREVEKELDESLERSRELLKDVLKKLDDNLKESERLVEDIDRELRKILEDLKKAGVPKEVVDEIKRIVDEVRERLKRIVDENRKIVEDARRKLEKIVKENEEILRRLKKELRELRK

SEQ ID NO: 4531 - protein, 185 aa, Artificial Sequence; identical to SEQ ID NO: 4530
  Synthetic

SEQ ID NO: 4532 - protein, 183 aa, Artificial Sequence
  Synthetic
DMRKELEKRVEEIRRAVTELVKRNEDIVREVKKRVEELVKRNEDITKKAEDDIRDLVRKRDREELRRLVERLKKLLKESNEELRRLVRELEERLRESIRNSRRVVEDLERKLEEIRKEISRVDEEEKLRRLLERLEDIARRVLKYLEEDLRETEKLAKEVLDRARKILEETKELVKDVLEKAR

SEQ ID NO: 4533 - protein, 183 aa, Artificial Sequence; identical to SEQ ID NO: 4532
  Synthetic

SEQ ID NO: 4534 - protein, 183 aa, Artificial Sequence
  Synthetic
DMDEELRRVVKEIEDELRRLVEENRDVVRKVEKLNRDLLKRNEDITDEARKRVEDLVRKRDDERVRELVRKLTEELKESNERNRKVVEESKRRLEESIRNSERVVEELKRLLREIIRTIDDVREREKLEKLIRRLREIAKEMLEYAKRDIERTKELAKRSLERHKESLDRTEKLVKEVLDKAR

SEQ ID NO: 4535 - protein, 183 aa, Artificial Sequence; identical to SEQ ID NO: 4534
  Synthetic

SEQ ID NO: 4536 - protein, 183 aa, Artificial Sequence
  Synthetic
DMVRDLERIVEKIKEDIKELVKRNREVTEKVVRDVEELVKTNREVVREATRRVEKLVEEEDREEVRRIVEELRRRLTKSIENSERVVEKLKKDLEKSNRDLEDLVRRLTELLKKIIEEIRRVKDEDTLRKLLKTLRELARRVLEEARKIIERSKELAERVLRYLKRDIEESKKIVKEIEDRAR

SEQ ID NO: 4537 - protein, 183 aa, Artificial Sequence; identical to SEQ ID NO: 4536
  Synthetic

SEQ ID NO: 4538 - protein, 183 aa, Artificial Sequence
  Synthetic
DMERELDDVVRKAEEDNRRLLKENEDIVREVVDRNARLLEENRRVVEEAVRRVEDMLRRRDRERLRDIVDRLRKELKKSEDNSRRSLKESEDRLRESIENSRRSIEESRKLLEEIRETIRRVKDERKLRKLIDDLRKLVRESLEYNKDDLEKTKELARRSLKYNKEDIDRSREIVRDVRRKAQ

SEQ ID NO: 4539 - protein, 183 aa, Artificial Sequence; identical to SEQ ID NO: 4538
  Synthetic

SEQ ID NO: 4540 - protein, 183 aa, Artificial Sequence
  Synthetic
SVIEALEEIAEKIERDVRKLVEENREVVKEAEKRVEEILRTNSKRSEEVRREVEDLVRKDDREEIRKLVEDLTRRLEESNRELKKLLEELKDLLRRSIENSERVVEKLRREARTLIEELSRVKEERVLEELLRRLEEIAKRALEYLTRDIEETKRLVEEVLKRLKEILDKTDDLAREVLERAR

SEQ ID NO: 4541 - protein, 183 aa, Artificial Sequence; identical to SEQ ID NO: 4540
  Synthetic

SEQ ID NO: 4542 - protein, 185 aa, Artificial Sequence
  Synthetic
SEVEKIEEDLKRLVKRLREINEESKKRLEELIRTAEEINKKTTDELERLAEEVDRLVKRVTSKEVKDLLREIEEELKKLLRKNREINEDIVRRLEELVRRNEKINKEIVERLDKTVKDVKKDLRSVREAVDRLRRVVDEIRKEARKLNEEIRKRVEDVVRKLDKMDEDLRKRVEEIERKVREATR

SEQ ID NO: 4543 - protein, 185 aa, Artificial Sequence; identical to SEQ ID NO: 4542
  Synthetic

SEQ ID NO: 4544 - protein, 185 aa, Artificial Sequence
  Synthetic
SEVEEILERLRRLVKEVDKRNTDSLDTLKRLIDELERKNRDSLRRVDELAKELEKLARRVTSEEVKKLAEDVVRRLEELVKENKEENERIVKRLTELLEENRDENRRIKEELEELLRDLKRKLRSVKDAVTELEKDVREIKKRLDEMDKRLKDVVDEVRRRAEEVNRRIERLVREIEKRAREEVR

SEQ ID NO: 4545 - protein, 185 aa, Artificial Sequence; identical to SEQ ID NO: 4544
  Synthetic

SEQ ID NO: 4546 - protein, 185 aa, Artificial Sequence
  Synthetic
SEAEEVLERLKRLRETVKEENDDSLRKDRELVDRLEKDNRDSLRKLKELIERVREILKRVTSEDVRRLLRRIVEELKELVERNKERNKRIVETSKRLVEKNRKRNEDITRDLRRLVEDLKRRLKEKKDVVETVKRVVEEIEKELEEANRRLEKSSREVEDRIRKANKRLEEVVDEVREEVDKATR

SEQ ID NO: 4547 - protein, 185 aa, Artificial Sequence; identical to SEQ ID NO: 4546
  Synthetic

SEQ ID NO: 4548 - protein, 185 aa, Artificial Sequence
  Synthetic
DEVREVLTRLEELVRRVTKELEDSLRNTERVRRTIRKLAEEVNRDSKRLKDEVKKVLEKIKDKDTLRKVVDDVEKELEELNRTLERLVREVSRYLRENNDRSRKLVEEVIERARRIVDTLRRAGVPEEAVETLKRKVEEIERRLKRMVEEDRKTIEEIEEEVRRLVKTNREIIKEIVETLREAVR

SEQ ID NO: 4549 - protein, 185 aa, Artificial Sequence; identical to SEQ ID NO: 4548
  Synthetic

SEQ ID NO: 4550 - protein, 185 aa, Artificial Sequence
  Synthetic
KEVEEVRTRLKKLRDDVKRLLDEVNEESKRLAEEVRRRLEESNRNTERVVEEIERVIERIKDKDTLERMVREVKRYLEENNKRSEALVDKVEKDLKRLNDKLREDVKRVIERLRRLVEELKRAGVDDKVVDEVRRRVEEAEREVKDMVRTNNEIVRRIVEEARRLVDEDRDRIKKIEERLRRELQ

SEQ ID NO: 4551 - protein, 185 aa, Artificial Sequence; identical to SEQ ID NO: 4550
  Synthetic

SEQ ID NO: 4552 - protein, 185 aa, Artificial Sequence
  Synthetic
SEAEEVLREVDELAKRLERVATESLKNTKKVVDDVRREVKRVNERSEEIMRRIEDVLRKIKDKDTLRRTVEEVIKELEDLNRELEKRVREVIRYLRENNRTTKEKVDEVRRRLEKLLDDARKAGVPEELIREIERIVREIDKRARELVERDNREVERIVEELKELVKTNNDIVRRVVEKLKETVR

SEQ ID NO: 4553 - protein, 185 aa, Artificial Sequence; identical to SEQ ID NO: 4552
  Synthetic

SEQ ID NO: 4554 - protein, 183 aa, Artificial Sequence
  Synthetic
SEAEKILEDLKRIVRRIKEELRRVLDHTRELVERIRRLAKKILDDTEKIVRDIRDKAEKVRDKDDLRRLVEEIRERLRRSDEELRKLVEKIARDLDKNLEDSERLVEKITKELEELLEDIRRLPEDVVRELKREVERIKREVKKMVDDNRRTVEKIKRDAEKMVRDNEELSRRIEKDVDDKTK

SEQ ID NO: 4555 - protein, 183 aa, Artificial Sequence; identical to SEQ ID NO: 4554
  Synthetic

SEQ ID NO: 4556 - protein, 183 aa, Artificial Sequence
  Synthetic
SEAEKIEERLKRVVEKLRRDATRVRKHTDDLVKEITDLAEESKRRVEEIRERVKRLRERVTDKDTVRKLVEEIKKRLDDSDKTLEDLVERIERLLEENLKDSERLVTEIEKELRRLLEEVRRLDEKVVKRLEDEVKRIKDEAKEMVDENKRKVDEIRKELRRLVEENRRESEKIKKKLDEDLK

SEQ ID NO: 4557 - protein, 183 aa, Artificial Sequence; identical to SEQ ID NO: 4556
  Synthetic

SEQ ID NO: 4558 - protein, 183 aa, Artificial Sequence
  Synthetic
DEIREILRRIREVVADATRRAKESLDNLKRVVEEVDRRVKESLDRLKEIVDRVRELSKRVTDKETVKELVERIRKELDDSNEELRKLVRDVEKYLKDNVRRIAELVKKIEKELRDLLREISRLPKDVVKRVEDEVRDIRRVLEEMVRRDKKVVDEIRERLKEAVRRNEEVSRKIKKDLKDETK

SEQ ID NO: 4559 - protein, 183 aa, Artificial Sequence; identical to SEQ ID NO: 4558
  Synthetic

SEQ ID NO: 4560 - protein, 177 aa, Artificial Sequence
  Synthetic
SMEERLREVVTEIRKKVEKLLRDNRKSNKEIKETVDDLVRRNRELTERAKRRVDARGIREDVVRRLEKRLRESNEKVERVVEEIEKRLRESDKKVEEVIERLDRLLKELIKRISRVTREREAEELLRELADVVRRAEELAERSLRESEKVMEDITREAERILRDTKRLIEEIERRAR

SEQ ID NO: 4561 - protein, 177 aa, Artificial Sequence; identical to SEQ ID NO: 4560
  Synthetic

SEQ ID NO: 4562 - protein, 177 aa, Artificial Sequence
  Synthetic
SLREDLEKDVRDIVREIDEAVERNRRSVEEVDKRVEDMLKNNRDSNKKIEEDVRRAGIPEEVVEELRRRLEESDREVERILKELRDRLREIIERSEDLVRRLREELKRLIDTIDRITREEDAKRLKDELREVVDKIRRDLKKSNDDIRRLVEKIKRELEELNKRSRELVERARETVR

SEQ ID NO: 4563 - protein, 177 aa, Artificial Sequence; identical to SEQ ID NO: 4562
  Synthetic

SEQ ID NO: 4564 - protein, 177 aa, Artificial Sequence
  Synthetic
SLEETIEEKVRRIREEVRRMLENNRRINEEVDRRVTEMVERNRKTVEEVVREVDRDGIPESVVDELRKAVEAVIRKSEKIVEDLRREAEKSDDELRKVVEKISERLEDIRRKVRKLTREEDAKRLLEEVEDIVRRLRKELEDSNRKSRKLVEEIRKRAEESNRELRELIKRIKDRAR

SEQ ID NO: 4565 - protein, 177 aa, Artificial Sequence; identical to SEQ ID NO: 4564
  Synthetic

SEQ ID NO: 4566 - protein, 177 aa, Artificial Sequence
  Synthetic
DVLERLAEVVRRVVKEAEDLVRNNRRLNKEVEDEVDELVRNNRRLTKDVVKKVEDAGVPEEVVDEIRKLLTTSNERVERLVDELKKRVETSDERAKRIVDRLRKIVEKLIREASKVTSKEEVKRLEDELRKVVDKVRKDMKRSNDDSERLREDITRKAKRLNEETRKVMEDVTRRAT

SEQ ID NO: 4567 - protein, 177 aa, Artificial Sequence; identical to SEQ ID NO: 4566
  Synthetic

SEQ ID NO: 4568 - protein, 185 aa, Artificial Sequence
  Synthetic
KEAEELIREIERKAEEVRKENERSIRENERLAREVEKRLKRTNEELKRLVRELEEKLKRDDDGETVKREVKKIDEDLRRLVEESERIVKEIVERSRKSVEDNRRRNEEIERDLRRLVEELKRRGVDEELIRRLEEVVKRIREDLKKLDDDLKRSVEEIERRLKKVIEDNRETLERARRRLDERVK

SEQ ID NO: 4569 - protein, 185 aa, Artificial Sequence; identical to SEQ ID NO: 4568
  Synthetic

SEQ ID NO: 4570 - protein, 183 aa, Artificial Sequence
  Synthetic
DEAEEILEELRRLIEEDKKTVEEVLRRDEETIKRLEEENREALKDNRRLIEELEDIVRRIKDKDTLREILKRVLEESEELLRRVHKRNREVIEENRRSVEELKKINEDSIKRIEDLLREIRRVDEKVREKVERILDDLRRVVEETVKRAEDLLRKSREVVKRVDEELKESHDRLDERIKRDLK

SEQ ID NO: 4571 - protein, 183 aa, Artificial Sequence; identical to SEQ ID NO: 4570
  Synthetic

SEQ ID NO: 4572 - protein, 183 aa, Artificial Sequence
  Synthetic
DEAREILKTLKDLIKELEDRNREVLERDKKTIEDLERRNARVLEENKKLIDEIRRIAKDIKDKDTLSEILKRVLRESEKLLRKIHKENREVIKRNEDSLKEVHDENRKVREEIKRLLDDARRVDRSVEEALKKILRELEKKVEEVDRRLKRILEDSRRVVRRVDEEARKSHEELKRELDRIRK

SEQ ID NO: 4573 - protein, 183 aa, Artificial Sequence; identical to SEQ ID NO: 4572
  Synthetic

SEQ ID NO: 4574 - protein, 183 aa, Artificial Sequence
  Synthetic
KEAEDLLRKLRELIKKLDDTNRRVLERDRKTIEELERRAEKILTDIERLIRELEDRVRRTKDKDTLRELLRRAKDTIRKLLKDLRDELEKVIKENERSLREVHKRNKEVDEDAERLVAEVRRVDEKVVEKARRILKELRDRIREVDKRLRELLEESRKRVEEVERELERLVRELEKKVREAEK

SEQ ID NO: 4575 - protein, 183 aa, Artificial Sequence; identical to SEQ ID NO: 4574
  Synthetic

SEQ ID NO: 4576 - protein, 182 aa, Artificial Sequence
  Synthetic
SEVEDVVRKIKEILERLKKEVDDVLDRNRKLLEELKKRADEVLKRNKDLLETLKREADRDGKDEDVVRRARKILKELRDHSKKVVEDMERILEESKKHSEDAVRRLREIVKRLAEEVDEVTKRGVDKDELKRLLDELREIVKEAEERLRKSDEDLERIIREVKKRLKESNEELERTIREVER

SEQ ID NO: 4577 - protein, 182 aa, Artificial Sequence; identical to SEQ ID NO: 4576
  Synthetic

SEQ ID NO: 4578 - protein, 184 aa, Artificial Sequence
  Synthetic
REVEEVVKEAEDLLRKLRELAKEFLTRHKKLIRDVTEKVKEVLKRSADSIRELEKIIDKVTSDEVRRLLEEINKRNREEIERLLRELEKILRESRELSKELKKILDEILKRIRELVEKVKARGLPEDAVRKLEEMVERLARIVEDVERKLKKLNKELEEIVRDAKRRLERLNEELRRRIREAER

SEQ ID NO: 4579 - protein, 184 aa, Artificial Sequence; identical to SEQ ID NO: 4578
  Synthetic

SEQ ID NO: 4580 - protein, 184 aa, Artificial Sequence
  Synthetic
DEDEDIERKLKELIDRLREEVKKAEDEHKELIKRDHRRVEEVERRSEKSIKDLRDLAKKVSSEEVERLLEDINRRNRELIDRLRKELEKTNEESKRLSEELKRKLTEVLKRIRELVEEVRKRGLPEDVARRLEELVEELEDIVRKVKESLRRLNEELRKNSETVKKKLEDLNRELRKDIEEKRR

SEQ ID NO: 4581 - protein, 184 aa, Artificial Sequence; identical to SEQ ID NO: 4580
  Synthetic

SEQ ID NO: 4582 - protein, 184 aa, Artificial Sequence
  Synthetic
SEAEKVLEEAKRLIEELERRVREVLKRSKKTIEDLRREVDRVVKEHKKLIRELREIIKRVTSREVEKLLEDILRDSRRLTKELDEKLKEINKRNAELIEELKRILDKIRKDIKRLIEEVEKRGLPEEVAKRLKDVLRELKDLVEKIEEEARRLNEELKEIIDRARKTLEDLNRELEEVVRRARK

SEQ ID NO: 4583 - protein, 184 aa, Artificial Sequence; identical to SEQ ID NO: 4582
  Synthetic

SEQ ID NO: 4584 - protein, 178 aa, Artificial Sequence
  Synthetic
SEVDEVRRELERVITDDKRLVDESRRKNEKSIRDDEELIKTSRRINEESIRRLKELVERGVPEEELERIVKENKEKVARVVEESKRLVERNKREAEKVVEESRRRVKRLREELKDVVRKGVDEETLRRLVKRLDETSEELEDENRRLNETLKRSSDELRKTNEELNKRLKEVVDRAKK

SEQ ID NO: 4585 - protein, 178 aa, Artificial Sequence; identical to SEQ ID NO: 4584
  Synthetic

SEQ ID NO: 4586 - protein, 178 aa, Artificial Sequence
  Synthetic
SVEEKIKEMVDKIKDSVRRSTEENDRLVKEIDKVLKEAEKRNRDLLKEAADVLKRVLDKRRESEELRRIVEEVEKTHRDLLKKTADLVRKVREDHDRLLKESKELNDRSERRAEELERKVDDIDTVLKDMKKILDDNKKLVDDSRKKHKESIDRLRKLVKDSLDEHRESIERLERAAR

SEQ ID NO: 4587 - protein, 178 aa, Artificial Sequence; identical to SEQ ID NO: 4586
  Synthetic

SEQ ID NO: 4588 - protein, 179 aa, Artificial Sequence
  Synthetic
REVEELERELEESNKELRKLIKELDDLLRETNKRLNDLIRELKERLDRVLEELRKIIKDDRRLVEELRRLVEDVRRELKKAIDELKKIVEDSERELERMIKRLRDIVDESRKRLKEVSRTREVEKLVEEAIKRNEDLVRTVERKVDEAIKENRRSVEKVAEEVKKAEEELERIVDTVRR

SEQ ID NO: 4589 - protein, 179 aa, Artificial Sequence; identical to SEQ ID NO: 4588
  Synthetic

SEQ ID NO: 4590 - protein, 179 aa, Artificial Sequence
  Synthetic
REVEELKKEADKTNEDLNRLIKELEERARESNRELKRLIDELRRRLEEVLKRLKDIIDKERRSTEELRKLVKDVEDELEKVIRDLERIVDRSRKELERVIRELEKIVRESERRLKEVSRTEEVERLVTEMIKRNRTSVDAVRRKVKEMIDRNKALVETVRDEVRRAREKLRDILRKAEK

SEQ ID NO: 4591 - protein, 179 aa, Artificial Sequence; identical to SEQ ID NO: 4590
  Synthetic

SEQ ID NO: 4592 - protein, 180 aa, Artificial Sequence
  Synthetic
SIEEIVRKVKEDLKRSLDELRKVSEDMARRLRESLKELEEVVREMEERLKRILDDIRRKVPEDRVRELERRVRELIERLRKKVKENKERLEKIVKDSDDHVERNVEELEKIVRELEKLVRDGRDERDLKRRVDEVLTRSKESVDENKRTADRVLEESRESIKELKERAKRLLERLEEERK

SEQ ID NO: 4593 - protein, 180 aa, Artificial Sequence; identical to SEQ ID NO: 4592
  Synthetic

SEQ ID NO: 4594 - protein, 178 aa, Artificial Sequence
  Synthetic
KEVEELEREARRMLEHTKRLIDEVRDRAKKSLDNTRRVDREVEKLVEDTERRLDELRKRGEPEERLKDIHRENRELVKRIEEYLKRDLDRSRKLVREIEERLRENLETSEDLVRRLVKGEELKRTAERMIEENRRLVETLKRVLEEAIRRNEELVKTLLRKLEESDKKIRKLIEETRT

SEQ ID NO: 4595 - protein, 178 aa, Artificial Sequence; identical to SEQ ID NO: 4594
  Synthetic

SEQ ID NO: 4596 - protein, 178 aa, Artificial Sequence
  Synthetic
SELEELRDRLKEILEHTKKLIKESVERLEESLRNTRRVIRKVEEEVERTRTKLDDLRRRGEDETKLREIHRENRELVRRIVKYAEDDLRRSRKLVEDSKRRSKKNLDDSEELVRRLVRGEEMADVARRVIEENKRLVEENEDRLRKAIERNRELVEEVKKRLEDSDREIERLIREVKK

SEQ ID NO: 4597 - protein, 178 aa, Artificial Sequence; identical to SEQ ID NO: 4596
  Synthetic

SEQ ID NO: 4598 - protein, 178 aa, Artificial Sequence
  Synthetic
DEVETLRREARKLLERIKREIEEVRRRLKESLDNTKRVEDEARKLVKETKDKLKRLAERGSPKEDLERIHRENRDLVRRIEEYLKRDLDESRKLVEEIERRLEELLRTLEDLVRRLVRGEEMRKVAEDMEREIRRLITDLRRELEEAIERNEELVRRLARELERSDREIKKRIDEIET

SEQ ID NO: 4599 - protein, 178 aa, Artificial Sequence; identical to SEQ ID NO: 4598
  Synthetic

SEQ ID NO: 4600 - protein, 178 aa, Artificial Sequence
  Synthetic
SELDELRKRAKRSLETTEELIRRSRKLMRESLDNTRRVEEKVRRLVEKTLRDLEDLKRRGVPEETLREIHKENRELIRRIEKYLEEDLRRSRELVKESKKRSKDDLDRSRDLVRRLVRGREMEETAREAIERNRKLVEDNERDLKKAIEDNEKLVRDLKRELERSDEEIKKLIREVKN

SEQ ID NO: 4601 - protein, 178 aa, Artificial Sequence; identical to SEQ ID NO: 4600
  Synthetic

SEQ ID NO: 4602 - protein, 178 aa, Artificial Sequence
  Synthetic
DSREELRREAKRLLDDIKRLEEKVERLAREVLKHTEELDEKLKRLVEETLKKLEDLRRRGEPDESLRRIHEENRRLVDEIRERLKENLRTSKKLVKEIEERLKELLEELRDLVRRLVRGEELKRTAEEMERRIRELIKRLKDRLEDMIRRNKELVDRLKKKAERSDEEIERLIRETKK

SEQ ID NO: 4603 - protein, 178 aa, Artificial Sequence; identical to SEQ ID NO: 4602
  Synthetic

SEQ ID NO: 4604 - protein, 182 aa, Artificial Sequence
  Synthetic
KEIEDVVRELERKVRENKRRNDEVIKRLERLVEKNTELVRRLIRTLEKLVEDLEDIVRRIKDKDELEERLERIRRRIKELVRKLEELNKKSLDDIRRLVEKLERENERSLREIKRDVDELVRSEEAKKVAEDVERRIRRSVEEARRLLEEVKRKMEESVEESKRLLKKVEDEAKDVVDRARK

SEQ ID NO: 4605 - protein, 182 aa, Artificial Sequence; identical to SEQ ID NO: 4604
  Synthetic

SEQ ID NO: 4606 - protein, 182 aa, Artificial Sequence
  Synthetic
SEIDKVIEELKDLVRKNEKRNRDVVRRDDKSVKDNTKRVEDVIRDLDRLIRELREIVERIKDKDTLRRILKEIKDRIKELVRRLDEENKKSIRDNERSVEEVEKENRESLKTIRELVRNLVNDKRAAELAKEVIDRMEESVKEAERLLRELKRKSEDSVRKSKELLDEVEKKVEEVVREAER

SEQ ID NO: 4607 - protein, 182 aa, Artificial Sequence; identical to SEQ ID NO: 4606
  Synthetic

SEQ ID NO: 4608 - protein, 182 aa, Artificial Sequence
  Synthetic
EEIERAIEKVEREIRELEERVREIIERDRKSVEDNSRRVRTVIKELEKLVEELRKTVKDIEDKDTLRKILDEIRRRIEELVRKLKRENDESNKKNKKSVKDLEDELETILKRIEDEVRKLVNSEEARKLAEELRKEIKRVVDEVRKLLRDLERKSKESVREAEELLKRVRDELKEVVDRTEK

SEQ ID NO: 4609 - protein, 182 aa, Artificial Sequence; identical to SEQ ID NO: 4608
  Synthetic

SEQ ID NO: 4610 - protein, 177 aa, Artificial Sequence
  Synthetic
SLREAVERLRKRHEDVVRELEKLVRRVKEELERVNKDLRKVVEEVRRRLEKVLEDAKDVERIKEIKDEVERVIRELKKIVDESRKNSKDLKEELDDVLKKSEDNVRRVTEELKDVVRRGGPVTDLLKRADDNVKRNRDLIRRLKEKADEIVKRNEDLIEDARRKADEMIKDLEEKAR

SEQ ID NO: 4611 - protein, 177 aa, Artificial Sequence; identical to SEQ ID NO: 4610
  Synthetic

SEQ ID NO: 4612 - protein, 182 aa, Artificial Sequence
  Synthetic
SEVDELRERAKRIVDDLRRKIEEVVKRLEDSDEENKKLIEKAVRELEKIIRDLEEVIRRGVDREEVRRIEKELRDKLEKVKEESKRTIDENRKIVTEVIKTVEEVLKRLREELDRVIKEKKDVRELKELVDRLDKEATDVLRKVREDLRKAIERSERSHRRLEKLIEEIERELKRVVDEVTR

SEQ ID NO: 4613 - protein, 182 aa, Artificial Sequence; identical to SEQ ID NO: 4612
  Synthetic

SEQ ID NO: 4614 - protein, 180 aa, Artificial Sequence
  Synthetic
DIEELLRKVAEEITRSVKESRDRLDEVEKKAREVVERSEKRLREVEEKIERVVRRIVKSDELRDLARKVLDEIRKLVEKLRRLNEKSLRDIERLVRKLEELNKRSLDEIRKLVEELKRVDREEDADKVLKEAEELVRRNRRLVEEVLRRLEEIVKRDEDLVRKVLKEADEIVRRLEEAAR

SEQ ID NO: 4615 - protein, 180 aa, Artificial Sequence; identical to SEQ ID NO: 4614
  Synthetic

SEQ ID NO: 4616 - protein, 182 aa, Artificial Sequence
  Synthetic
SRVEDVVRRLKELNDENSEDSRRVLEKLKDEVRKNSDEIEKAAEELKEKLTRLKRLIEGGVDEETVRRVLEEIRKDLEDLLRRSKESVERIKRELEKSLKRSEESLRKSDEDLKRLLDESRDVKEVKELVKRVRETSKKSLKEDEDMVREVKKKLDDSLRRVDELVRRVEEEARRVLEEVKK

SEQ ID NO: 4617 - protein, 182 aa, Artificial Sequence; identical to SEQ ID NO: 4616
  Synthetic

SEQ ID NO: 4618 - protein, 182 aa, Artificial Sequence
  Synthetic
DEVERVVKELRDKVDRNSREIEKAVTELRKIVKRNSDESKEVIERLEELLRRLEELIKSGVDEKTVREVLEEIDRRLKESERRSEESKDEIRRLLKRLLERSKESLDEIEKELKRLIERSKTSSRVKTLVDEVRKRAEDSLDTVKKLVDRVRERLDESLRDDKRLVDRVREEAERVVREVEK

SEQ ID NO: 4619 - protein, 182 aa, Artificial Sequence; identical to SEQ ID NO: 4618
  Synthetic

SEQ ID NO: 4620 - protein, 182 aa, Artificial Sequence
  Synthetic
SDVEKIFDELRKLLEDLRRKVEEVFRRLKELVERNTRLNREVVKELKKTSDDLRDMVRRTKDKDTLDDLLKKVKKEHEDLVKRLEDLNDRSEKEIRRILKELRDTLRTITRRIEDLVRKAEKDEKVRKLVKEIRERIEKVLRDAEELLKEIEERVKESKKEAKKLLDEVRESVDDVKRKAEK

SEQ ID NO: 4621 - protein, 182 aa, Artificial Sequence; identical to SEQ ID NO: 4620
  Synthetic

SEQ ID NO: 4622 - protein, 182 aa, Artificial Sequence
  Synthetic
SDVEEIVRKLDKLVEDNTRENEEAFKRLDETSKKLEEEVERVFRELKKLVDDLEKIIRDIEDKDTLRKIVKEILKEIEEIARELEKRLEDVLREHKKLLDDIRRRNERSKREIERLVREMEKDEKVRKLVREVEKKVDESTERAERLLKRVEDSVRDVLRRAKELLDEIRKRVKDVERKAEK

SEQ ID NO: 4623 - protein, 182 aa, Artificial Sequence; identical to SEQ ID NO: 4622
  Synthetic

SEQ ID NO: 4624 - protein, 179 aa, Artificial Sequence
  Synthetic
DEAREIRRRLKEVVDEVRKRLEDSLEEIDRRAKEVLEKVKRSLDRLRKVAEEVLDKLRRKGVDEKKIRELKKKVEDLEDKNRRVLREVEEIAKKNKEDHKRVLKELEKEVKDLEDELRELKELDERVKRRVDEVVRKLREIVRKLTEENKRTVEDLERIVERLDRDNRKMVEDMEREVK

SEQ ID NO: 4625 - protein, 179 aa, Artificial Sequence; identical to SEQ ID NO: 4624
  Synthetic

SEQ ID NO: 4626 - protein, 181 aa, Artificial Sequence
  Synthetic
REVEELKKRLEKIVEELKRIVDDHKRKVERIVEELEKLVEDHKRTVEEIVERAKRIVEKDKEKREELDKLVERVKRISDEVRKELERITKRVREESKKVLKRLEEIVKEVRDELDKVKRERDDERLEEVAREIEEALKKVKRDLKESNRELEEVADRVRKELDRSDEDLERRMREVREELK

SEQ ID NO: 4627 - protein, 181 aa, Artificial Sequence; identical to SEQ ID NO: 4626
  Synthetic

SEQ ID NO: 4628 - protein, 182 aa, Artificial Sequence
  Synthetic
SVLETLAERVKEVKDNLRKLVEDLKRLVDRIKETLDKLVEELRELVERLDDRLRKNDKSEEMLERLAEEAERRAKEIEDRLEKHVDESRKRAEELLRRLEDHVRKSKRELERIREEVNSTRDLLKRLEEIMRRLEKEHKDVSKLLRDIEREIDRVHREVKRKIEEIVRKVRKSLEEVKRRAK

SEQ ID NO: 4629 - protein, 182 aa, Artificial Sequence; identical to SEQ ID NO: 4628
  Synthetic

SEQ ID NO: 4630 - protein, 172 aa, Artificial Sequence
  Synthetic
SRAETVLKEVTDKIKKLKDSSDELLRRNKENIDELKKSSEELLRRLTKAIEEIEKANVDEKTLEELIRRVEEELERHHRELEKNSREDEKRNRDHHRKLEEEMRRVEERLEREGIDDEVVKRVRDLLDTVRRRNEKVNEDVKRMNDKLRRDNEDVIRRVEKLLRELEEKRRT

SEQ ID NO: 4631 - protein, 172 aa, Artificial Sequence; identical to SEQ ID NO: 4630
  Synthetic

SEQ ID NO: 4632 - protein, 182 aa, Artificial Sequence
  Synthetic
DLEEVVKEARRLLDTVRKKLDESIKEARELLREIEERFKKSADEVREELKRVEDELRRKRVPEEVERRLDELRKRLEELTRRLKKELDDLKEELERRNERTKRELKRLIDELERRLRRVTRDKDDDVRELRKEVEDIIRRLDELVKKNTEDNRRVIKELRELVEEHTRRVKKIIEDLEREVR

SEQ ID NO: 4633 - protein, 182 aa, Artificial Sequence; identical to SEQ ID NO: 4632
  Synthetic

SEQ ID NO: 4634 - protein, 182 aa, Artificial Sequence
  Synthetic
SVEEVVEEAKELLKEVEEELKRSAEEAEKLLRDVARKMEESVERLRRLLKDVERALREKNVDEKVKKKLRDLLKELEDINRKSKRDLDELVEELRRRTEELERRLRELVRRLEEDLDRFRRDKDDDLRRLREKIEEIVRRLRELVRRHNEEVRRIIETLEELVRRNTETVEREVRRLRDEVR

SEQ ID NO: 4635 - protein, 182 aa, Artificial Sequence; identical to SEQ ID NO: 4634
  Synthetic

SEQ ID NO: 4636 - protein, 182 aa, Artificial Sequence
  Synthetic
SVEKVLEDARRLLEEVKDRLKKSIDDAEKLLRELEKRLRESADEARRLLRRVKELLERKNVDDKLRRDLDRLIKELEDRTKKLIDELRRLIEEVREENRRTKEELERLIRELEEKLRRFKRDKDDDLRELKREIEEIVKRAEDLVRENTEKNKRVVDTVEELVRRHNEEVRRVVKELEERVR

SEQ ID NO: 4637 - protein, 182 aa, Artificial Sequence; identical to SEQ ID NO: 4636
  Synthetic

SEQ ID NO: 4638 - protein, 184 aa, Artificial Sequence
  Synthetic
GLDEIIKRLREVLEKIREELRKSSEELERLLKRVDDDLERSNKELEELLERVRKKLEDSRIDRKLLEDVRREIKRVKEESKEIRDTLKTLLDRLRELSKKIEDDLKRKLEKLDEDLRTIRRKPQSEELLRELEKEIKRVDEDLKRLVEEHEELVRDVLRKLEKLVREHKEKVRERVERADDKVR

SEQ ID NO: 4639 - protein, 184 aa, Artificial Sequence; identical to SEQ ID NO: 4638
  Synthetic

SEQ ID NO: 4640 - protein, 182 aa, Artificial Sequence
  Synthetic
SLEEVLKELKKIVEDVTRRLEEMLRESKETSKEVEKELKKLDDEIREIIERAEEDLRRANKPEEELDKARRRLEKILEDNNRKNREITKRSRTENKRLEERLEEIVRRLKTELDKLRKVLEEGKVDEEILKEVAERLKKTAEEVKRELEKFIEDDRKRADEVRRENEETLKRIEDIVRELKR

SEQ ID NO: 4641 - protein, 182 aa, Artificial Sequence; identical to SEQ ID NO: 4640
  Synthetic

SEQ ID NO: 4642 - protein, 183 aa, Artificial Sequence
  Synthetic
SALEKIMKDLEKSIEDVRRKLEDILRKLRKSSEEVKRRIEDIERKVDRAAKEILRSKGTESEEVKKLDKELKDVRDTLRRIMERLEEINRRIEEELRRLLKELEEENDKVKKELKDRIDKDGDDEDVVRRLKRTVEEVHKRNEDVVREAEKLVEKLSRINEEAVRRLADIVRRLEEELRKAEK

SEQ ID NO: 4643 - protein, 183 aa, Artificial Sequence; identical to SEQ ID NO: 4642
  Synthetic

SEQ ID NO: 4644 - protein, 172 aa, Artificial Sequence
  Synthetic
REKEDVLRRIERIVREIERRLRESLKRNREIVKDLERLARRVLKESEDNLRKLKEDRKELEEVLDELRKKNKELEDDIRRLLRELEERTERWEDELRRILRELEKRLEEIERADVSREKLRKRLEEMKEELRKADERAKEIDTRTKRLVDEAVRKLEKLVEEHRRMTDEIRR

SEQ ID NO: 4645 - protein, 172 aa, Artificial Sequence; identical to SEQ ID NO: 4644
  Synthetic

SEQ ID NO: 4646 - protein, 183 aa, Artificial Sequence
  Synthetic
REDETLEKILRRIEEIVRRLVREAEDVVRRDRETIERLVRENEKAVKEIKDIVDELTRLKKDKREEELERMLKKLEEEVKRIIEESERKLEDNRRKVEEIIRRLEDVLRRLEEEIRKMIKDLPDTESVREAAERLKDILRRLEELLRKVAKDLKKSNDELERLSEESVRRLREILKRLEDALR

SEQ ID NO: 4647 - protein, 183 aa, Artificial Sequence; identical to SEQ ID NO: 4646
  Synthetic

SEQ ID NO: 4648 - protein, 181 aa, Artificial Sequence
  Synthetic
SEVEKILEDLDRSAKEAADRIKEIVDRLTELVKDLKKKNEESLEELDRLVKELADLLRRGEVDEEALKRAVETLRRILKRDKEAVDEAVRTLEKIIEDLKRELDEHTRRLEEILKRARDEVEEDKLRDIARRVREVNKRLEDLIRTVARAVRKALKDSEDLVREIAKRVEKALEDVRRAAK

SEQ ID NO: 4649 - protein, 181 aa, Artificial Sequence; identical to SEQ ID NO: 4648
  Synthetic

SEQ ID NO: 4650 - protein, 175 aa, Artificial Sequence
  Synthetic
REVEEVIRKLERILEEAERMSRESERKLREILEKLERAIREIREELERIHKELEEKAGRDEEVREILKRNRDNIRKLEEDARRILEDLKRLIKKLTDENKRILDELRRRIDELRKANVDRDRLDKAVEELRKEIEEMLRRSDELVKRLDEKVKKVLKELREHVKRDKEKVDKDAE

SEQ ID NO: 4651 - protein, 175 aa, Artificial Sequence; identical to SEQ ID NO: 4650
  Synthetic

SEQ ID NO: 4652 - protein, 175 aa, Artificial Sequence
  Synthetic
SSRERVIKKLEESLERLERLARKIKEDLERINRDLERLARKVEEELKRIHEELERRSGDDREVREILRRNRENIRDIKRKIEEIHRENEKNIRKLVEEAKDILRRSEEKIRRLREAQIREDELDKRVKDLHRENEREIRRLEDHVRRDRERLEEALRDLEAHVKRDKDKLDKDAK

SEQ ID NO: 4653 - protein, 175 aa, Artificial Sequence; identical to SEQ ID NO: 4652
  Synthetic

SEQ ID NO: 4654 - protein, 173 aa, Artificial Sequence
  Synthetic
SEIEDVARRLEEINKKSEDMARRIKEELEKVDEESERLVREVAKRLDEVLKRVRDDGVDEKKLKELEDKVKRIKDEARRLLEESKELTRRLVEEVRRLLEDSRRAVEEIERKLKDGTAEELKKRVEDLKRKNEDLIRRLEEKVRRLKKRNRDLIEELKKLVKELKDEAKKTSD

SEQ ID NO: 4655 - protein, 173 aa, Artificial Sequence; identical to SEQ ID NO: 4654
  Synthetic

SEQ ID NO: 4656 - protein, 173 aa, Artificial Sequence
  Synthetic
SEEERIEKRLREIHERHKRMLDEIKKRLDDSLKTLEDLIRDVTRELEKVLKKAEDDGIDEKLLRELKKEVEEIKRRAEKLLDESRRKVEELARRAKEINERLKKMIEDLRRELKDGTAEDLDREVKRLEREIERSIKELEELVRKLHKENEELIRELEELVERLKRKIDETSR

SEQ ID NO: 4657 - protein, 173 aa, Artificial Sequence; identical to SEQ ID NO: 4656
  Synthetic

SEQ ID NO: 4658 - protein, 182 aa, Artificial Sequence
  Synthetic
SEVEDAERVVRELEREVREEVKKLRKHVKETRDRDKDTVRRVEEKVKRLREKVKRVEDARRPKEELRRVLEELKKEIDKLTKELEEIEERNRRNIEDVERKLKKILRDIEEKIKELVRKIGSEDRAVREVLKELERVLRDAKRELDRVREEHERSHKELRDMLDRVKKELEKILEKLERALR

SEQ ID NO: 4659 - protein, 182 aa, Artificial Sequence; identical to SEQ ID NO: 4658
  Synthetic

SEQ ID NO: 4660 - protein, 171 aa, Artificial Sequence
  Synthetic
EDKERVEEKIKRSLEEARREAERVRDKLRKSEEEIDRVMKRVLAEIDRVLKEVKEAGVSEDVDRRLEELLRTLERKVRELRKDSDEVRKTLEDLVRRNEEDNRRILEELRREDRDSKELEDIVRRLEERNRRTVEEVERLVDEHNKRLREAAKELKKLVDDLERKLREDTR

SEQ ID NO: 4661 - protein, 171 aa, Artificial Sequence; identical to SEQ ID NO: 4660
  Synthetic

SEQ ID NO: 4662 - protein, 175 aa, Artificial Sequence
  Synthetic
SEIEEVKKKLEKILRDHNRVVEEVAKEHEKILRDHNRVIREVKEELDRVLKKLRDDGVDEKLVREMEERLRELAERVKKKNKELEDNIRRVRREAEEINKELEKKIRDIEEKARRRRDDAEKLERLVKRIKEEVEESVKRLKDHAKENREDVKRSVEELRDVVRRLEERIKESAD

SEQ ID NO: 4663 - protein, 175 aa, Artificial Sequence; identical to SEQ ID NO: 4662
  Synthetic

SEQ ID NO: 4664 - protein, 175 aa, Artificial Sequence
  Synthetic
SEIEEVARRLDEILERHNDVLRKVKEKHEEILRRHRKRVREVEEELKKILKELREKGLDEKDVRKTEKEVREIKKKAKEDHERLKRNIERMERELEKRNEDLRREVEKIKREARDDREDAKDLKRKVDELRRKAEESMKEVERHVRENAEHVKRSVEELEEDVRRLRKKLEEKER

SEQ ID NO: 4665 - protein, 175 aa, Artificial Sequence; identical to SEQ ID NO: 4664
  Synthetic

SEQ ID NO: 4666 - protein, 175 aa, Artificial Sequence
  Synthetic
DEKEKVKEDLDRILEEHRREVEDVERKHRKILKDHEEVVRRVREEHEKILKRLKDNGVDRRLLEELRRNIERLEKEARDDHRRLKENIERMRREIEKDHEDLKREVDKIARRAREDTDDAKKLEDLVRRLKEHVDRSRERLEKHLRENKRHVEESAKRLEKHVRDNEEDVKRKST

SEQ ID NO: 4667 - protein, 175 aa, Artificial Sequence; identical to SEQ ID NO: 4666
  Synthetic

SEQ ID NO: 4668 - protein, 177 aa, Artificial Sequence
  Synthetic
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 4669 - protein, 177 aa, Artificial Sequence; identical to SEQ ID NO: 4668
  Synthetic

SEQ ID NO: 4670 - protein, 171 aa, Artificial Sequence
  Synthetic
SVEDDVRRKLKEIEDEHRKVVKDARDELEKSHRRLRKVIEDVKRKLDRVLEELERSGVDEKIIRKAKELVERLTKKAEDVLREHKEKLDRIEKKAEDSHRRLREDLERLDRAKIDEKDLEEVIRRIRKKVEDSKRDLERLLEKSKRDVEEVMKDLKRRIEELEKLVRDETT

SEQ ID NO: 4671 - protein, 171 aa, Artificial Sequence; identical to SEQ ID NO: 4670
  Synthetic

SEQ ID NO: 4672 - protein, 185 aa, Artificial Sequence
  Synthetic
SLKDELEKLLKELKEHVDRSEKKARENLKRLEEHVRKSKEELEDRLRRIEEKVKRLTESNLRKEDVKRVLEEVRKELKRILDDVRADHRRLEEHLKRSVKELEDDNEKLERDARRIEEKLRRSNVPEEMVERAIRKLEDIHRRHREVVERVEREHRRIKEEHEKVVREAEETLKRIIEDLRRSAD

SEQ ID NO: 4673 - protein, 185 aa, Artificial Sequence; identical to SEQ ID NO: 4672
  Synthetic

SEQ ID NO: 4674 - protein, 185 aa, Artificial Sequence
  Synthetic
KLEEEARELLRRLEEHVRKSKKEAEDNLRRLEKHVEDSKRRLKELLDRLRKTVEDLKRANLDKKDVKRVLDKLRRDLEKILEELRRDNERLERHLRKSTKRLEDDNKDLRDKLEEIKDRLRRSNVEEDVVRRAADALRRVHEAHKRMVEEVKRRHDEIHKRHEKVVRDAERALREVLKRLEEAAR

SEQ ID NO: 4675 - protein, 185 aa, Artificial Sequence; identical to SEQ ID NO: 4674
  Synthetic

SEQ ID NO: 4676 - protein, 179 aa, Artificial Sequence
  Synthetic
SLRETADKRLRDVNRDLKRVIEELRERLKESNKKLEDLIRELRERAERILDDLRRSGVDESILRELEERIRRIEEELERIHREHEREVREVKKDLDRIHEEHKRRLDEARRELEEGRRPEEDLARRLEEIVKESKEIVDRARRRLEEIVERSEDRVRRVEERIKELVKRLEDIVRREKT

SEQ ID NO: 4677 - protein, 179 aa, Artificial Sequence; identical to SEQ ID NO: 4676
  Synthetic

SEQ ID NO: 4678 - protein, 182 aa, Artificial Sequence
  Synthetic
KEIEEVLRRLEELIRRVREELRKNNEDIEREADKLRKELKRVNDELEKKIKDVKDRARRDGAREEDIDRIRKDLKKSKEDLERLIKEALDRLKKNLDDLKKRVEEVEKRLEDLIRDVERKGLPKEVLDELRRVVEEVTREIREVLETSRELVRRIVETVKEVLRSHDEKIKKVEEELDRDRQ

SEQ ID NO: 4679 - protein, 182 aa, Artificial Sequence; identical to SEQ ID NO: 4678
  Synthetic

SEQ ID NO: 4680 - protein, 175 aa, Artificial Sequence
  Synthetic
DVDEKVRELLRKIEEDLRRSVKELRELAKRIEEDLRRISKKSKDLLKKIKDDVKRAGLPEDILRRLDELAKRLEKKNEDIRRDLERVAREIDKENEDMRKKLKEDVDRLEDLLRRGEVKEEDLKRVIEELKKEVEELHRRNEKIIRELEDKVRRVREDNERVIEELARDVERAER

SEQ ID NO: 4681 - protein, 175 aa, Artificial Sequence; identical to SEQ ID NO: 4680
  Synthetic

SEQ ID NO: 4682 - protein, 185 aa, Artificial Sequence
  Synthetic
SLREEAEKIIRDLEDHVRRDEERVKEMVDRSRKLVKELEKRLRDLIREITRRVDKLRKDNIDEDKLRKIIEDLVRDLKRILDELEKLIRELDKRNKKILEDNERNIRELEERAKRILDKLREDGVDEKVLRKAEELLKRIIAELKKIHEELRRLSKESKERLERILDEARKMLEEVKKRLEDIEK

SEQ ID NO: 4683 - protein, 185 aa, Artificial Sequence; identical to SEQ ID NO: 4682
  Synthetic

SEQ ID NO: 4684 - protein, 185 aa, Artificial Sequence
  Synthetic
SLEEKLEKLLKELRDHVRRDKKEVREALERLKDHVRKDREKLERAIAEIKKAVEKLKRDNIDEERLTRIVKELSDRLREIHRDNRENIKRLEDELRRILKKNKENIEDLARKARELLKRLEEDGVDEKVLRKLEKAAREVAEAVKKVHEELKRALEEIRRELEDINRKLKEAADEVRKKLRDIAE

SEQ ID NO: 4685 - protein, 185 aa, Artificial Sequence; identical to SEQ ID NO: 4684
  Synthetic

SEQ ID NO: 4686 - protein, 185 aa, Artificial Sequence
  Synthetic
SLEEELREVIKRLRDHVRRDKERAKEAIKRAEDHVRRDEEAVEEVIKELKRLVDELRKAKLDREDLERVVRDLDRKIKEIEERNKRNIDELRKELERIHRENEKNIRDLDERLKREREKLARDGVEEDVLRRATKALEDIRRELEKINEELKRAAERIEKRLKEIHDRLKKALDDVRRELEETRR

SEQ ID NO: 4687 - protein, 185 aa, Artificial Sequence; identical to SEQ ID NO: 4686
  Synthetic

SEQ ID NO: 4688 - protein, 185 aa, Artificial Sequence
  Synthetic
SLKEKLEREIERLRKHVEDDERRLREVIRRLEEHVKRDEDRLKKELDRLREEVERLRRANIDKEELKRIVERRTEDMDRIRKENEDNIRKLDEELKKIHEDNRKNIERLKTEAEKILRELAEDGVEEEVLKEAEDLLRDVTRALEEVNRRARKLLKEIKEKLDEIHKRLNKMLEEVKRRLDEIRR

SEQ ID NO: 4689 - protein, 185 aa, Artificial Sequence; identical to SEQ ID NO: 4688
  Synthetic

SEQ ID NO: 4690 - protein, 178 aa, Artificial Sequence
  Synthetic
SRAEEMIKDVRRIVEEVRRENKRVLEEIEEIIKRSKEEWEKILKELRDIIEEVERRNLDDERLREILERLEKKLKDVDDRAKEINEELKDLLRRVHERNREILRRLEEKVKEVKREGIDEELLRRIKEVVDRARDTLRRLDEELKRIVEAVHDTDDKVKKELEKIVREVEEIARRRSK

SEQ ID NO: 4691 - protein, 178 aa, Artificial Sequence; identical to SEQ ID NO: 4690
  Synthetic

SEQ ID NO: 4692 - protein, 179 aa, Artificial Sequence
  Synthetic
SEAERVVRENEENLERIKREVERDLRRNEEVLEDLRRKVKKVLDEIRETLRRLREAKLDSEELRKVLEKLKREIEEIRRRLKKTLDDLRKANEKSEREIRENLKENRKRNEDIIEKLKEVEEAVRKLDDLDRRLEEIVRRASEALKRSLEEIERILRKAEEDLRRLLKRLEEIIREVER

SEQ ID NO: 4693 - protein, 179 aa, Artificial Sequence; identical to SEQ ID NO: 4692
  Synthetic

SEQ ID NO: 4694 - protein, 179 aa, Artificial Sequence
  Synthetic
SVEDTLREMLKRLEEIVRRAEETLKRLNEEIERVVREAARRLDKLNKELRDIVRDIKRRKPDKEKLVRELEKILKEHNDELKKIKDDLRRILKKSREDTEKILRELEDILRRLEKEIRDNDKRKDDLKRRLEEILKELKRIVDEAEERHREIIKRLRDIVREATEKSREVLKRLEDKAK

SEQ ID NO: 4695 - protein, 179 aa, Artificial Sequence; identical to SEQ ID NO: 4694
  Synthetic

SEQ ID NO: 4696 - protein, 185 aa, Artificial Sequence
  Synthetic
KVREKLERALRRSTTSSRDIERRLKELLDTNREIVDRIVKRLKEMLDRLREEIRRIEERRKEAEDRIRELREKLRDLERKVRRVVREMEERTRELEKRLEDILRRNDEENKRVEERLREIEKRPQDDELVKRLEDDLRRWEKESKEIVDRVKEEIDRVNRESKETLKELEKEAKRVLDELERDER

SEQ ID NO: 4697 - protein, 185 aa, Artificial Sequence; identical to SEQ ID NO: 4696
  Synthetic

SEQ ID NO: 4698 - protein, 185 aa, Artificial Sequence
  Synthetic
DVERTLDEMLKRSEDVTDEVREELKRALESNNKLIKEIVDTADKVLKDIEDTVRKIIEKKREDKDLVDDLRRLIEEVRRIVEKIKRDLKKLNDELEDRIRKIEEDLKRKNDEVRKMVETIKKKPESEKLVKEVEDRARKWLKDLRDKIERLREELEKVNRDTERILEKVERDLRRLLEEVRKRDR

SEQ ID NO: 4699 - protein, 185 aa, Artificial Sequence; identical to SEQ ID NO: 4698
  Synthetic

SEQ ID NO: 4700 - protein, 178 aa, Artificial Sequence
  Synthetic
DEVEKVLREIEEIIKELKKEVDKDLEELKRTIERLKKKADEVVKRNEEVIRTLREGNIDEEKLKEILKRLHDENKEILDRIRELLKKLSRDNEKKLDEIREMLERLERRARKILARTKIKEAADKLRELLKRLEEVVRRWKEAIEDINRKLEKVVRDIERLLRDLDRKAREVLERLRK

SEQ ID NO: 4701 - protein, 178 aa, Artificial Sequence; identical to SEQ ID NO: 4700
  Synthetic

SEQ ID NO: 4702 - protein, 178 aa, Artificial Sequence
  Synthetic
SSVEKVLRELDDLIRRNRDLVEEDRKELKRTSDENRERVERIVRKNEKAIRDLRRNNIDEKDLRKKLEELHRENKKFVERNAESSKKLSDDNKELVDRSREKLKRLADKIRDILRKERIKKAADDLKRVLDKLRKSHREWNELIKKANKENTEILREAEERLRELDRRLRKVLEDLRR

SEQ ID NO: 4703 - protein, 178 aa, Artificial Sequence; identical to SEQ ID NO: 4702
  Synthetic

SEQ ID NO: 4704 - protein, 180 aa, Artificial Sequence
  Synthetic
SEVERVLKELKELLDRLRELVEEILRRLEKIIKETKREIEESLRTLEEIIRRLEELAERVDEKKLREILKKLEDHIRRSREKLERSNKKLRELLERAEREMKKLIDTARRIVDEVRKQDLREDADRALRKVLEDIKEIVKKAKEDLERVYKKHKKLVDEVKKAHEDVLKKAREVLEEIRR

SEQ ID NO: 4705 - protein, 180 aa, Artificial Sequence; identical to SEQ ID NO: 4704
  Synthetic

SEQ ID NO: 4706 - protein, 180 aa, Artificial Sequence
  Synthetic
DEVEDVLRKIKEIIKRTEDKVRESLKTLKEIIRRTKEEVKKILKEIKELIERVEREARRVDRRELEKILKDLKKLVDDAVRKLKRSDEELERHIEESERDLERSNRELKRLIDDVKRRDARERAETKLRELYERHRKVIKEVRERHKEVHKRHRDVLEEIRRRLEKLLKDLEDVIREIER

SEQ ID NO: 4707 - protein, 180 aa, Artificial Sequence; identical to SEQ ID NO: 4706
  Synthetic

SEQ ID NO: 4708 - protein, 172 aa, Artificial Sequence
  Synthetic
DEEKDVVRRLKRNVEENTKNVERMVRELERNIRENTENAKEVITRLKKIIDELRRRELDRKLVRKILEDVRKLSEDHLRESERNLRRMEEESKRHIKESKENLEEVEREAERDVRDQEDVKRVRKLARESLERVRRLHREVLEKLKKSHDDVKRLHEEIDERAKRVVEEREK

SEQ ID NO: 4709 - protein, 172 aa, Artificial Sequence; identical to SEQ ID NO: 4708
  Synthetic

SEQ ID NO: 4710 - protein, 176 aa, Artificial Sequence
  Synthetic
DAEELLKEIERELKRSIEEARRLLEEVEKRLRKSKRDVEKLLKEVREKLEKVVREIPKDDRLEKVKEDLERILDTLRRRTEELERRVRELIERLERRNEETERRLKKLVDDVKDVKDRDVVRRLVEEARKLVEENTRENRDMIEKLRRLVKRHSEEVEEIIRRLDKLIDDVRREAE

SEQ ID NO: 4711 - protein, 176 aa, Artificial Sequence; identical to SEQ ID NO: 4710
  Synthetic

SEQ ID NO: 4712 - protein, 179 aa, Artificial Sequence
  Synthetic
SLEELLREVERRLRELNKKLEDMIREVEERLRKVIRETEKLIEDVKRELEKILEKARERVDEDTLRRLRKELEDAIRKVAEDVKRLEEENEKSVRELRKKLREIHERNRDTVRKLAELLETIDEKELEKEVRDDLRRTDEDIRRLLDEARKDVERHKEELKKLLEDAKRLLERVERTIR

SEQ ID NO: 4713 - protein, 179 aa, Artificial Sequence; identical to SEQ ID NO: 4712
  Synthetic

SEQ ID NO: 4714 - protein, 173 aa, Artificial Sequence
  Synthetic
RELEEVVKKVREEVKEHTEKVKRLVEEAEELNRRYEEEVKKLVTTAKRLNDEARKRNSKDETVVRELKRLNEELNRRSRKLVEELKKLNEELARKAEESKEELKRRLEDLARRMIDSKELLDEVAKLVEESLRRLDRLLEEIKRTSDELIEKNERLNRELNKTSDKVVEDMRR

SEQ ID NO: 4715 - protein, 173 aa, Artificial Sequence; identical to SEQ ID NO: 4714
  Synthetic

SEQ ID NO: 4716 - protein, 184 aa, Artificial Sequence
  Synthetic
SLEDLIREVEDRNRKSVEEVERLLEEVRRKLDESRKRLEELLKRVEEKLERVIEEAKRRLKNVKDVEERLKEVRKTLKRLKERLEERTDEVRRRLERLIEELRKRSKEHSERLRDRVEKVRDVKDEKVVEELAREMKKSVEEHTREVRRMVAELEKLVKRHTEEVERAVREAEKLVETLREELR

SEQ ID NO: 4717 - protein, 184 aa, Artificial Sequence; identical to SEQ ID NO: 4716
  Synthetic

SEQ ID NO: 4718 - protein, 184 aa, Artificial Sequence
  Synthetic
SLEDLIREVEKRNKESVDTARRLLDEVRKKLKDSIDRSRKLLEEVRRKLEEVIKDAKRKLKTDKDVEKELKDVTDTLEKLIRKLEEENERSRKRLEDLIKRLRDESRKHSDDLRRKVEDARKVSDERVVEEIMRRLEKSVERHTEEVKRVVREAEELVKDNTRKVEELVRRAEKLVEDLERRTR

SEQ ID NO: 4719 - protein, 184 aa, Artificial Sequence; identical to SEQ ID NO: 4718
  Synthetic

SEQ ID NO: 4720 - protein, 184 aa, Artificial Sequence
  Synthetic
SLEELIREVEERLRKSVDDSRKLLEEVKRKLEDSKREVDRLIEEVKRELERVIEDVTRKLKDVKEVRRRLDEVRRELEERAERVRRENERTDRELDELIKRLEEINRETEERLRELAREIRRVKDEKVVKELADEMRKLVRTNTEIVKDVVKKLDELVERNTRTNRDVVRRARELVEELERRER

SEQ ID NO: 4721 - protein, 184 aa, Artificial Sequence; identical to SEQ ID NO: 4720
  Synthetic

SEQ ID NO: 4722 - protein, 172 aa, Artificial Sequence
  Synthetic
RELERVVEEARRLVEEHTEEIERSADKARKLNEEHSRRVDEIFERLERLIREAEKKNSKDDKVIEDLKRKLEDITEKVKKSIDEMRKLTKDINDENRESIKRLRDEIRKIEKDVRNRELLEEIRKLVEESVERVKRLNEDVNRTSKESVKRLEDLVDEIRKRVEEVVRRLKK

SEQ ID NO: 4723 - protein, 172 aa, Artificial Sequence; identical to SEQ ID NO: 4722
  Synthetic

SEQ ID NO: 4724 - protein, 172 aa, Artificial Sequence
  Synthetic
SELERVAEEAERIVREAEEKIKKSVTELKELVKRHSERVKRIFKELEELLRRLREKNSKDDRVIKRAEEELRRIEEELRRSLEELKRRLEEINKENEKLIKELRDRIRKIEEEVRNEDLLREVRKKVEEVVKKIKRLNEEVNRDVKRSAEELKRLIDDIRRILKKVIDDLKT

SEQ ID NO: 4725 - protein, 172 aa, Artificial Sequence; identical to SEQ ID NO: 4724
  Synthetic

SEQ ID NO: 4726 - protein, 172 aa, Artificial Sequence
  Synthetic
DEMEEVVKRAEEIVKEARERIEESFRRLREENKEALERLKRIAEEMRRLLKEVLERNSKDRRVIKELKDLLDEIRKRVEDEIRELRKRTETINDENRKLIETLKRILEDIKRKLRNEELLRRVEKEVRRVEEEIRRLNKEVNETSDRVEREAEKLVRELEEAVRKVVEDLER

SEQ ID NO: 4727 - protein, 172 aa, Artificial Sequence; identical to SEQ ID NO: 4726
  Synthetic

SEQ ID NO: 4728 - protein, 181 aa, Artificial Sequence
  Synthetic
DLEEVIKEARKRLEDSHRRLEKLIREVEKEHEDSHRKLRELVERVKKKHKEVEEKIKRNGVSEKDLKRIEDNIRKSEKELRDALKRHKENVDRSRKKLEDILRRHRKKLEEVERKLEEMRRKGSPVEELLKDLERMVRELNEEIERALEDAKRNVDRLDDEIRKLEERVDRNVKRLEEDIK

SEQ ID NO: 4729 - protein, 181 aa, Artificial Sequence; identical to SEQ ID NO: 4728
  Synthetic

SEQ ID NO: 4730 - protein, 181 aa, Artificial Sequence
  Synthetic
SLEDVAREAKKRLEDLKKKITDLIREARRKHKESHDRLRELVEKIKEDLKRVLKKLEDDGSSREKLERLKRKVDELARELEEVLKRHKENVDRSDEELKRVLKRIEEEIKRLEDELEEVKKDGSDVREVKEKLRRTVEALDERIDKLRKELDENVRRLDKEIEDMVRKAKKVVDELREEIR

SEQ ID NO: 4731 - protein, 181 aa, Artificial Sequence; identical to SEQ ID NO: 4730
  Synthetic

SEQ ID NO: 4732 - protein, 181 aa, Artificial Sequence
  Synthetic
DLDEVVKEVDRRLEESHERLRRLIKKVDEDHRRSHEDLKRVIDEARRLLEEVLERLRRNGKEEETLERLKRTVEKVEEELKRVLDRHEENVRRSRKELEDVLRRHKEKLDELKKKLEEVRRRGMPVEEVLKEVKKAVEKLNEDIDRLFEKARENVKRLDEDIKRLLEELRRKVKKAEDEIR

SEQ ID NO: 4733 - protein, 181 aa, Artificial Sequence; identical to SEQ ID NO: 4732
  Synthetic

SEQ ID NO: 4734 - protein, 181 aa, Artificial Sequence
  Synthetic
DLERVVEEVKKLLRDSHEEHKKVVKEVKERLDRSHKESKRVSDEVRKKLEEVLKELEDRGVSEDLLRRLEKTVRDIEDENREVNERHERKLREVERELKESNDRHEKMVRDLREELKRIRKDGKDVEKVLRDVRRVVTELNKHIEDLKRKVTEDVERLNTEIKELKKRNDEAVRRAREEIK

SEQ ID NO: 4735 - protein, 181 aa, Artificial Sequence; identical to SEQ ID NO: 4734
  Synthetic

SEQ ID NO: 4736 - protein, 174 aa, Artificial Sequence
  Synthetic
KEDEDLDRDVKRHIEETEKRVKEVEKRHKDEIRKVREDVKDVERRHKEKIDDVRRKLRDGRLSEEVIKDLERDLRRSKDEVRRRVEEARRKLKESDEEIKRTVRENEEKLRELRERGLPEEILRKLRKRTEEIKREAERIHDRTREEIEKIKRDLDEIHKRTREVIKELEERSR

SEQ ID NO: 4737 - protein, 174 aa, Artificial Sequence; identical to SEQ ID NO: 4736
  Synthetic

SEQ ID NO: 4738 - protein, 174 aa, Artificial Sequence
  Synthetic
KKEEDIEREIRDHIRRTREKLEKLAKELRDDIRRLREELKRIEDEIREESKRLEDILRKGRLSEEVIEELKERIKTIERDVERLIKESEDELRRLKREIEETLRENEKKIKELAEEGLPEDILRRLREETEELRKEAERLLREYKRLTEELARELRELVKKLEEEVRDLERRSR

SEQ ID NO: 4739 - protein, 174 aa, Artificial Sequence; identical to SEQ ID NO: 4738
  Synthetic

SEQ ID NO: 4740 - protein, 174 aa, Artificial Sequence
  Synthetic
SEEERIEEDIRRHIKRTRDRLDELRRRLEEDIKRLRERVEDLKRDLERNIRELRDRLRRGRLSEKVVRDSREKLERLREEMEREVKESRDRLREVKEEIEDLIRRNKEKLDRLRERGLPEEILRRMERLTRELAKDADRLLKKYRKLTEDLKRELEKILKTYRDLTEELKERSR

SEQ ID NO: 4741 - protein, 174 aa, Artificial Sequence; identical to SEQ ID NO: 4740
  Synthetic

SEQ ID NO: 4742 - protein, 182 aa, Artificial Sequence
  Synthetic
SELDELRKRIEEAAKELKKRLEDHKRRLEEAEERFERDLERIHRRSREVVRDLKERPLEEEEIKKRVKEVREEYDRVREELKRKIEELRRRNDKTRRELEEDVRRLEEELRDAKRKVNSEDRILREVEDIVRKLKEILKEVRDRLRELSKRLEDRLKEVEDKLDKDVKDVEEELRRILEERK

SEQ ID NO: 4743 - protein, 182 aa, Artificial Sequence; identical to SEQ ID NO: 4742
  Synthetic

SEQ ID NO: 4744 - protein, 182 aa, Artificial Sequence
  Synthetic
SRLEKAEEDIKRYIEEHKRRSEETLKELTDKAREITRRLDESLKTVEDTSREIKKDVEDRGNDKDTMEKVKEDYKRLVRRLEELIEEMIREADKSVKDLERETEESKRKIEEEAEKLREESDDEDLRRVIKRIRELLERLEREDRRIIEEIKKLLDRLKKKVEDIIERIERSLKRLEEELRR

SEQ ID NO: 4745 - protein, 182 aa, Artificial Sequence; identical to SEQ ID NO: 4744
  Synthetic

SEQ ID NO: 4746 - protein, 178 aa, Artificial Sequence
  Synthetic
SEEELLRKLEEISRRVTRALEKLLEDHERLSREVAERLEDLLRRHKKLLEELIKLAEERVSDKDKVRELKERLRKNLDDLREHVRRDKERNEKNIEDLERHIRRDKKENEEALDDVRKTKQPEEELDERIRRLKDKNKKNLDDLREHSKEVLERNKENLDELRKHSKKVLDEARKELK

SEQ ID NO: 4747 - protein, 178 aa, Artificial Sequence; identical to SEQ ID NO: 4746
  Synthetic

SEQ ID NO: 4748 - protein, 174 aa, Artificial Sequence
  Synthetic
DEKERAKEEVKKLRDDAEKTDRDLEKEVEDTARELKETLERLRREVERLEEELERISRRGNKDDETLKRIKEKLEKLKKKAKDDNDRLEERIRRKREELKKHLDDLRKTLDELRRRVRDKDLTEELKRVLDDHERTLRKIEEDLRRILEEHKKETKKITEELERILEKMRKDEE

SEQ ID NO: 4749 - protein, 174 aa, Artificial Sequence; identical to SEQ ID NO: 4748
  Synthetic

SEQ ID NO: 4750 - protein, 171 aa, Artificial Sequence
  Synthetic
STKEELLERAKEIIKRLEELLRRNNRTLREILKDLKKRLEESNREIKRLIDEVTRNGLDRKLVEKLREALEKHDEDVKRLLEELERIIRTHEKKAEELLKRLKDEIEKLAREERDDEDLRRELERLKEEVDRAHKESEEIVKKLEKRIRDAIRRSKKRVDELEKELREAEK

SEQ ID NO: 4751 - protein, 171 aa, Artificial Sequence; identical to SEQ ID NO: 4750
  Synthetic

SEQ ID NO: 4752 - protein, 173 aa, Artificial Sequence
  Synthetic
SEKEEVDETLRRLEEEHERVVRDAKRRLEEDHEKLRRVIRDSDRINDEINKKAEEDRLEEELLKRLRDKSKKLREDLEDLLRRHKEKLDRIDEELKEDHKRLKEEAKRLRERLDELDAEELKRILDETRERIRESMEEIKRKLEESRRESEDIRRKLKEDNDRLKKELDDRAK

SEQ ID NO: 4753 - protein, 173 aa, Artificial Sequence; identical to SEQ ID NO: 4752
  Synthetic

SEQ ID NO: 4754 - protein, 182 aa, Artificial Sequence
  Synthetic
SSEEEIRETVKRLKEIVKKHKKDVDEIAEELRRIVEELRRRNEEEIKKIRKILRELEEKRSGDRRKIKELVDRMKKRLDDHKKTLEEIKRKAKEELEKSKKRTDEIVEELRRRLRELEKKGVDEKLVRELERIVEEIKEELEKSDRELEKIIREIAKRLEEIHEETERAVREVKKRLDEVAK

SEQ ID NO: 4755 - protein, 182 aa, Artificial Sequence; identical to SEQ ID NO: 4754
  Synthetic

SEQ ID NO: 4756 - protein, 175 aa, Artificial Sequence
  Synthetic
SEEEKLLERLERTVERLEREARRLLEKSKEKLKRLEDSSRELLDKLRKEVERLRREERDREELKTELERLKREIEKYVEEMKEELKKHKKESRDFVERLKKELEELKEEIERSNVPEDFLRELEKLLEEIKRKIEEARERLERSNKELEDVIRDSERRLRKLLKEIEEVIRRKAT

SEQ ID NO: 4757 - protein, 175 aa, Artificial Sequence; identical to SEQ ID NO: 4756
  Synthetic

SEQ ID NO: 4758 - protein, 175 aa, Artificial Sequence
  Synthetic
SEIERLLERLKKALEEIKRSSERLIRKLEEVLRDLEREVRKLLEDSRRTLERIRKEDKSDEELKRELDEHKDRTRKAERRLEEKLKTLAEEIKEYTRRLEEDLKRLREEIRRANVPRDAVEELERLLKEIEKTIEESRRRLEELLERIERLIRKVIEELRRSNEELERVIREKSK

SEQ ID NO: 4759 - protein, 175 aa, Artificial Sequence; identical to SEQ ID NO: 4758
  Synthetic

SEQ ID NO: 4760 - protein, 183 aa, Artificial Sequence
  Synthetic
KVEKRLRELVERIRESHERVLREVERLVEEHRETLKRILDRIREILKRIEEDIESIRRRVDERKEKKLRERLKRLEDELRKIEKRIRDSLEEVRKKLEELVRKLRKNLEEIKRRLEELKRTKLDEEVVREELERLERNIKESRDDIRRALKELKDTNEKAKEELERKLEELDRDLKRLREEAR

SEQ ID NO: 4761 - protein, 183 aa, Artificial Sequence; identical to SEQ ID NO: 4760
  Synthetic

SEQ ID NO: 4762 - protein, 179 aa, Artificial Sequence
  Synthetic
SEVEDELRKSRKEIEDLAREAERELEEIKRHIERSERKAKEDIDRIEREIEELDKLRKENSSSEKTLDDDLERLKRKIEKIKREMEKSLRELEKRIREIVEKMRRTLDRHREKLEDLRRRGIDEKALRKSHKELEDLVREVEKKLRELLERYRKRIEEVAKKLDDLLDKLREVVDRAKK

SEQ ID NO: 4763 - protein, 179 aa, Artificial Sequence; identical to SEQ ID NO: 4762
  Synthetic

SEQ ID NO: 4764 - protein, 179 aa, Artificial Sequence
  Synthetic
SEVERELKRIKDEIRELAREAREDLERIKEHIKRSKERVEEELRRSEEEIKEIERLARERRVSEKTLDDRLRDHRRKVKKIVDDLRKSIEDLRKEIEDIVRKLKEDLDRLREEIDRLRKRGISKDDLDRLLEELERVVREVKKRLRKLLEDYKELVDRVRKKLEDSHRRLKELAERTKK

SEQ ID NO: 4765 - protein, 179 aa, Artificial Sequence; identical to SEQ ID NO: 4764
  Synthetic

SEQ ID NO: 4766 - protein, 186 aa, Artificial Sequence
  Synthetic
DVERELDRIHREHEELLRDIEKKLREILREHEELLKRIKEELDEILERLRKLVEDVKREKPDIKDLMKKLDDKLREVEERLRRIKEKLEEHHKEAEKLVEEIKRKLDDHNRRLKEKLKRVKDRGKVDEEEVRDILRRLKEEIDRSRREAEEILRRLKKEIEDTKREVDETKKDLKRTLDEIREEAK

SEQ ID NO: 4767 - protein, 186 aa, Artificial Sequence; identical to SEQ ID NO: 4766
  Synthetic

SEQ ID NO: 4768 - protein, 186 aa, Artificial Sequence
  Synthetic
SEVEEEVERIDRNIDRLRKEVEDNIRRSEEEIKRIKEEVEKNLEDLRREIDRIRELVEANKQSEDDLERVLKRLKDHLEKSKRDLERKLRRHEEHVRRSAEELEKDNRKNKRRVEEILRKLKDSEDMERMKRKLKELLDKHKKLVDDAKKKHDDSNRKLERLIREATKEHKKALEDLKKLIDDSRR

SEQ ID NO: 4769 - protein, 186 aa, Artificial Sequence; identical to SEQ ID NO: 4768
  Synthetic

SEQ ID NO: 4770 - protein, 183 aa, Artificial Sequence
  Synthetic
KDTEEAEERWKAKDKKLEDDVRENLKRLREEITRLEKEVKDNVRRIKELIDKLRRDVEREGTDDETLKEVEKRLRDNIEESRKRLEEMLKKIEDNIRKSKKKLDDYKRELEKELREMERRVKDLEEAKDSLRKLKKHSDDTVRRVKEEHERVLKEAKELLDKVEKEHRRLLEELERLLREARK

SEQ ID NO: 4771 - protein, 183 aa, Artificial Sequence; identical to SEQ ID NO: 4770
  Synthetic

SEQ ID NO: 4772 - protein, 183 aa, Artificial Sequence
  Synthetic
SEEDKERKKWERRDEELRKRVERNEREWERADKELEEEVKREVERIRREIEELRRRVEKDGTDDKELRDLLRRLEEELRKLDERLKEYLRRLEENLKRSDEELKEYLRDLEEKLRRIEEKVKDLDEARKELERLLEHSRKLLEDVRRSHEELVKHSKERADRIRETLKKLLDDLRKLLEDARK

SEQ ID NO: 4773 - protein, 183 aa, Artificial Sequence; identical to SEQ ID NO: 4772
  Synthetic

SEQ ID NO: 4774 - protein, 183 aa, Artificial Sequence
  Synthetic
SDIERRKEEWKREDEKLEKRSRKNVEDWERRDEELKRRSEENVRRIKEMIERLEDRVRRDGKDEDELRRVEEELRKNLEENDKRLKEYLDRLRKNLEKNRRDLEEYLKRLEEELREAEERVKDLEEARKELEKLLRNSKRLVDESERRLRELERHSRELLKRSRRELERLMKELEDLAREIRR

SEQ ID NO: 4775 - protein, 183 aa, Artificial Sequence; identical to SEQ ID NO: 4774
  Synthetic

SEQ ID NO: 4776 - protein, 183 aa, Artificial Sequence
  Synthetic
RESEKIKEDMDRSNEKHNKEVEETLKRLEEELKRLEDEVRDAKRELDELLERLERRARDGDRSEELLDRDLKDVLKKLEEKVRKIEEDLKKFKDDLRKIIEKLVTDSKRHHDELKKEIDRRTRTKELEDLARDVAKKNKESVDRVKKELKRVDEEVKRLLDEVKKDLDKVREDLKRVIDEIRR

SEQ ID NO: 4777 - protein, 183 aa, Artificial Sequence; identical to SEQ ID NO: 4776
  Synthetic

SEQ ID NO: 4778 - protein, 177 aa, Artificial Sequence
  Synthetic
SEVEKVITEVEELVREYRKRLEDKRREAKKRVDEYEERLKRMEDEVRKLLEEIERRIRKDGGASEKTEDEIRRLLEELKRRVEKLIEETKRLNEEIDDESRREMEELRERLEEIADKSISSKDALRRAEEKLKKLIKENKEINDEINERSKELNERSKEVLKKIEEDLRRLIEEVRR

SEQ ID NO: 4779 - protein, 177 aa, Artificial Sequence; identical to SEQ ID NO: 4778
  Synthetic

SEQ ID NO: 4780 - protein, 178 aa, Artificial Sequence
  Synthetic
SREDLVREVRERLKKLLKHSAELIKRVKEELEELLRHSEENVREVKKRLDEIKEEAKKRGKSEDALKKLDEKLRKVTRKSKEYLDDLRRRVEEVERKLKEYLDRLREEVKKVEERLEKSRRPIEDERRAVEETEERWRRKDDTVRKEVEEEKEKWRREDEKHHRDVERALRKLKRDIE

SEQ ID NO: 4781 - protein, 178 aa, Artificial Sequence; identical to SEQ ID NO: 4780
  Synthetic

SEQ ID NO: 4782 - protein, 178 aa, Artificial Sequence
  Synthetic
DEDELVREAKDRLDKLLEHSRKNVEEAEKRLRDLLEHSKKNVEEAERLLEEIEEEARRSGKSKEVLDRLRKKARDLKEESKDYLRKLEEEVRRIVRKSEEYLKRLKDRVDEVKERLDKGRRPLEEVRKEVKKEIDDWRARDEEHHRDVKRREEEWERKDEEHHRKVEEVIERLKRELK

SEQ ID NO: 4783 - protein, 178 aa, Artificial Sequence; identical to SEQ ID NO: 4782
  Synthetic

SEQ ID NO: 4784 - protein, 177 aa, Artificial Sequence
  Synthetic
SVEELIKEVEERLKRLKEHSEDLAREVRERHKKLIEELRRILEEVKKRHKDLTEKLEKDGGSEELLDRIRRNVEKSKRELERVLREAEKNLERSDEELKEYLDRLRKRLERVREELKREPADEEMKKRVEEEEKKWKRDDERLEKRVRENIERLRRLLERLRKRVEDNIKRLDDERR

SEQ ID NO: 4785 - protein, 177 aa, Artificial Sequence; identical to SEQ ID NO: 4784
  Synthetic

SEQ ID NO: 4786 - protein, 177 aa, Artificial Sequence
  Synthetic
REEDLIREVERILEELLKHSKRLIDEARDSHRRLLEHSKRLVEEVERLHKELLDRARENGGSEELLTRIKKNIDESRKELKEYEDDLRRNLRESDERLRRYLDDLRREKKEVEDELRRRKADDRMREEVRKTEERWRDKDRELEKRVRDNERRWEDRDRKLEKRVRDNIKRLRDELE

SEQ ID NO: 4787 - protein, 177 aa, Artificial Sequence; identical to SEQ ID NO: 4786
  Synthetic

SEQ ID NO: 4788 - protein, 177 aa, Artificial Sequence
  Synthetic
KAEELVEKVRRDLEALLEHSKTLAEKVRRDHRKLKEELKELLERVKRRLEELKKRLEDSGGDEKKLRELERRLKEVEKELRKVLEDIDRNLRRSDEELKKYLEDLRERLKRVEDELRREPADDELRKKVDEDRRRWEEDDRRLEKRVRENLRRLEKIIKDLEDRVRREVEKIDKDRK

SEQ ID NO: 4789 - protein, 177 aa, Artificial Sequence; identical to SEQ ID NO: 4788
  Synthetic

SEQ ID NO: 4790 - protein, 177 aa, Artificial Sequence
  Synthetic
DREKLIEEVKDRLRRLLKHSRELLKEAEDRHRELLKHSERLVRESERRLEELLRRARKSGGSEELLKRIEENVRDNKRRLDKYKEELRRNLKASKEELDRYEEELRRRLKEVEDELDKKEADDEVRKEVKKDEDDWRKADDDLRKRVEDNVRRWEERDRELKERSERNLEKLERERK

SEQ ID NO: 4791 - protein, 177 aa, Artificial Sequence; identical to SEQ ID NO: 4790
  Synthetic

SEQ ID NO: 4792 - protein, 177 aa, Artificial Sequence
  Synthetic
SREDLVRRVDKALRDLTRHSEELMRRSDETLKELLKHSRRLAKESEDRLKELLDEARERGGSEELLKRIKENVDKNKEELEKYIRDLERNLKENRERLKKYEDELREELRRVKRRLEEEEADERLEEKVRREEEEWKKKDEELKKRSEKNVDEWRKRDDKLRRDSKRNLDKLREEIR

SEQ ID NO: 4793 - protein, 177 aa, Artificial Sequence; identical to SEQ ID NO: 4792
  Synthetic

SEQ ID NO: 4794 - protein, 180 aa, Artificial Sequence
  Synthetic
SLVDEIRERVRRLDEDVRRLIEEIEKRIREIDKRAEDLIRKIEDDSRRTLEEVAKQPRDEEVLERVERIARDSLRLLEEVIEEVRRIAEKTRRDLTRVIEEVKRTVTDSIRKLEEVIERVKVEELEKVVEENERSLRELVKTLEDVLRKNDKTVKELEKRLREVLDRTRRFMEELIRRAR

SEQ ID NO: 4795 - protein, 180 aa, Artificial Sequence; identical to SEQ ID NO: 4794
  Synthetic

SEQ ID NO: 4796 - protein, 180 aa, Artificial Sequence
  Synthetic
SLKDKIREDSERTLKTVERLLREIEKEIRKLDRDIERLIEEIRRRIEKLDKDIERQPRDDEVLKRVEDIVKKTRELIERVIEEVEEILRETKELLDTVLKEVERIIRESERRLREVIERVKVEELEKVLKDTRDEAERLKEEVRRVLEDNDRTAKELRKTLEEVLKRNEESARELKKRIT

SEQ ID NO: 4797 - protein, 180 aa, Artificial Sequence; identical to SEQ ID NO: 4796
  Synthetic

SEQ ID NO: 4798 - protein, 170 aa, Artificial Sequence
  Synthetic
DEERRVEEELREVDKRLKKLLEESKRKLDEVIRRVREVVKKLKKRLDDVNRLVARDVKSEELERLLRESSEEVKEVIKKLKRLLEKVLREDEKSVDEIRREAEEVLKRVRDAGIDEKILRTVEKLVRDIERELRETNKRVREDVEKIIEDLKRILEENDKRADDWRRADK

SEQ ID NO: 4799 - protein, 170 aa, Artificial Sequence; identical to SEQ ID NO: 4798
  Synthetic

SEQ ID NO: 4800 - protein, 170 aa, Artificial Sequence
  Synthetic
DESEEVARELEKVDRDVDKLVKDSRKELEDSNREVEELLRRSTERLKEVNTLVARDVRGEELEELLERLDRENEETIRRVEELLRRSLKKNEETLERLERLAKELLERLKRAGVDEKLVREVERRVEDIKRKAEKTLDDNRKLIEEWVRRLEKSLEDNRRLAKKWKDEDK

SEQ ID NO: 4801 - protein, 170 aa, Artificial Sequence; identical to SEQ ID NO: 4800
  Synthetic

SEQ ID NO: 4802 - protein, 178 aa, Artificial Sequence
  Synthetic
SELDELKKEVDDVAREVRRHNKKLEEEVEREVRRMRRHNEENVKRVEESAKEARKDVDREELLRRLEKLVEELRKLNEESLRKVEKLAEEIADVLRRSKKAVDEVVREIARLLEEVKRRNEDLREVKKLVEEVTRRLERINKELERLIREVRKRMERVNDELHKRNRDVERKLREVVR

SEQ ID NO: 4803 - protein, 178 aa, Artificial Sequence; identical to SEQ ID NO: 4802
  Synthetic

SEQ ID NO: 4804 - protein, 171 aa, Artificial Sequence
  Synthetic
SELEALEEDVKRVVKEIKDHNEKLIRELEETIRRIDRHNDENIRRTEEEIKRVLDKKPDVKEIEEVLKLAKEVNKRSKEEVKKVAEEVKRVLDESRKRVDRIVEEAKRVLERGLPEEDLRRLLEKLKEDLRKVNEDLERLLREAKRRLERVNEKLHELSRRIREKLEEVDR

SEQ ID NO: 4805 - protein, 171 aa, Artificial Sequence; identical to SEQ ID NO: 4804
  Synthetic

SEQ ID NO: 4806 - protein, 171 aa, Artificial Sequence
  Synthetic
SELEKLVEKIKERVERARRHNERLREDVERVLTESDKENKDLIDDARRAVKEVLDRKPDVREIEKLIREIEEVLKESKRLVKEIADELRKVLDDSKRLVDEIEEKVKRVADRGLPEEELDRLIREIIKELEDVNRTLRKLLEEIKRRSKDVNRDLRRLLEEIKEKLRRKSK

SEQ ID NO: 4807 - protein, 171 aa, Artificial Sequence; identical to SEQ ID NO: 4806
  Synthetic

SEQ ID NO: 4808 - protein, 184 aa, Artificial Sequence
  Synthetic
SEIDELKKDVERRVREVEETNRRLEKEVRERLERSRKHLKELIEDARREVERVEREVKEDEVLRLLRELARELEEMLKRVEDESRRVAKELERVIKESEERIKEVVKELKDVLDEVRRLMKEDDKKKVLDELKKVIKEVEDRLRKIDEELKKVIDEVRKELEKINRDLERVIREVKKRAEEVRR

SEQ ID NO: 4809 - protein, 184 aa, Artificial Sequence; identical to SEQ ID NO: 4808
  Synthetic

SEQ ID NO: 4810 - protein, 184 aa, Artificial Sequence
  Synthetic
REIEELAKTVRKEVDDSRKHLKELREDAKRTLDEVKRETKKLEEDVRREVERVKREVKEDRVLEELEKLVEELKTVLERIKRKDEESARRLEEVLKRIKEESDRVVRELERVLRDVRRLVEEDDKEKVLRELKKVIDEVRKLLEDINRELEEAIRDVKRKNEDTLRELRKVIKEVEKRLKDVTR

SEQ ID NO: 4811 - protein, 184 aa, Artificial Sequence; identical to SEQ ID NO: 4810
  Synthetic

SEQ ID NO: 4812 - protein, 173 aa, Artificial Sequence
  Synthetic
KEVEDVVRELKKSLEENEKRVRDIERELREVVKKIAKRVEETREEVERMLEEIRRRSGEDEIVKEITEVVETVVRLDRESLEELKRVVDRIVELLKKNVEDLKRAIEEVERLLREDDIKKVVDEARKVLKEVHENTERIVDEARKLLKRMEEKNRKTEEDIRRVADEVREKAR

SEQ ID NO: 4813 - protein, 173 aa, Artificial Sequence; identical to SEQ ID NO: 4812
  Synthetic

SEQ ID NO: 4814 - protein, 173 aa, Artificial Sequence
  Synthetic
SKVDKVREEVTRSLEDNKRKVEEIEREARESLERNRKKVEDSIREARKVVEEIERKKGQDRIVEEVRRVVEENERRLRENVRELRKVLEDIRRLLKRNVDELERVVREVRDLLEKEDIDTVTRRIREVMKKVHDNTRRIAEELRRLMKRVHDNTERSHEELKRLLEEVKRKAD

SEQ ID NO: 4815 - protein, 173 aa, Artificial Sequence; identical to SEQ ID NO: 4814
  Synthetic

SEQ ID NO: 4816 - protein, 173 aa, Artificial Sequence
  Synthetic
REVEEVVKELKKSLDDNRDEVRKIIEEVTRLNKRNEEDVKRVTDEAEEVVKRIVEKKGDDEIVRKVREVVREIKERLDRVVEENKKVVDEVVKYLKENVEDLERVVRTVKELLRRDDIRKVVEEARRLLERVHRNTKRVADEIRKLDKRSSELLDKILKDLRKLLEDVEREAR

SEQ ID NO: 4817 - protein, 173 aa, Artificial Sequence; identical to SEQ ID NO: 4816
  Synthetic

SEQ ID NO: 4818 - protein, 181 aa, Artificial Sequence
  Synthetic
DEKDEVRRRVDRELEDVHRETKKSSDDDKRLLEDVHRKLKESEKEVRRIADEVRKKLEDVRRREDLERVARELLRELEEVVKENHKSVRKSLEDIERSARTNRDIVEKTLERIERVLEEIARRIKVREVLEKIKRSLDENKERVEKSKKDSDDSLRENKDRVDKTDEEAKEMIKDLKRKTD

SEQ ID NO: 4819 - protein, 181 aa, Artificial Sequence; identical to SEQ ID NO: 4818
  Synthetic

SEQ ID NO: 4820 - protein, 181 aa, Artificial Sequence
  Synthetic
DEKEKVTREVRRILEEVDKRLEESRERVERIAEEVHRRTEESHRRDEEVVERVKEELKEARRDSRLKDVVRELLRKVEKSARDNKRIVDTTLKLIERVIRENHKSVTKLLRELEDVIRRLKEEINVREVLEELKRELRRLEEDVRRTDRKLEESLKDNERKVRRSKEESDRLLRELEERTR

SEQ ID NO: 4821 - protein, 181 aa, Artificial Sequence; identical to SEQ ID NO: 4820
  Synthetic

SEQ ID NO: 4822 - protein, 181 aa, Artificial Sequence
  Synthetic
KEVEDVRRRVEKILEEVHKKTREVTERVRRILEEVHRKTEESHRRDEEVMRRVRDELEKARRREDLERVVRELTKRVEDSLRENEKIVERTLEEIEKVLDELRKIAEDTLRLIAEVLRRAKEEINVREVIEKVKESLRENERRARKVEKEIRDSLERNRERVEDSKRTSKKLIEDLREAVR

SEQ ID NO: 4823 - protein, 181 aa, Artificial Sequence; identical to SEQ ID NO: 4822
  Synthetic

SEQ ID NO: 4824 - protein, 181 aa, Artificial Sequence
  Synthetic
DEEKELVRELRDILKKVHKETKESSDTDREVLKRVHEDTERSHRDDERVVEEVKKELDKIRDREDLERVVRELLEIVKRSAEENKRIVEETLKEIERSARENERIVRETLDKIRKVIEELRRRVRVREVEDEVRRSLEDNRRRVEESKRRSDESLRRNKRKVERSKEESDRLLKELEDEVR

SEQ ID NO: 4825 - protein, 181 aa, Artificial Sequence; identical to SEQ ID NO: 4824
  Synthetic

SEQ ID NO: 4826 - protein, 175 aa, Artificial Sequence
  Synthetic
REVEEALKRNEAVVEESREAVERALRENETMVRESEKEAKRVKDENRKSIEELKRSNVSDRVERTLRETLKELEKVVEELKDIHRRTSERLKDVARKLKKIHDDTRKELEDFGDVPEEVLERVVRKLKELDDKSREDLEKVKKELRDVDTRSEELLREVEKRLREVDDRLRREEE

SEQ ID NO: 4827 - protein, 175 aa, Artificial Sequence; identical to SEQ ID NO: 4826
  Synthetic

SEQ ID NO: 4828 - protein, 175 aa, Artificial Sequence
  Synthetic
SEVEEVEKENKKMVEESERELEKLERENDKLLKESEDEARKVEEELKRVVEELDRSNVSEEIREELKKAIEKVKRVLDDVLRKHEETKKELKEVVKELREIHKRTSDELRKFGEVPEEVLREVVKDLRRVDKESKERLKRMADKLRDVDRELKEKLKRALEDLRRIVTELRERAR

SEQ ID NO: 4829 - protein, 175 aa, Artificial Sequence; identical to SEQ ID NO: 4828
  Synthetic

SEQ ID NO: 4830 - protein, 180 aa, Artificial Sequence
  Synthetic
DEVETVTRELEDTNRDIEKKVEEVERELRKTDREIREKVKRVEEELTRSDRELAEIVKKKNTEDRIVKEVVRLNEDIVRRLREVVKEVEELNKRAVERLREVVKKVKRLNREIVEELRRVRGEDVKRIVEKARKINEDVRREIEKITEEVRRINEEVDDRIRRIAEEARRINEKVKRRLT

SEQ ID NO: 4831 - protein, 180 aa, Artificial Sequence; identical to SEQ ID NO: 4830
  Synthetic

SEQ ID NO: 4832 - protein, 180 aa, Artificial Sequence
  Synthetic
KEVDDVAEELRRTNKEIKDRVKDVLRELEELLTDIEKTVRDVERELRESDERLEREVRRKNTSDDIVREVKELNKEIVERLKKVVEEVTRRLKKLVDEAEEVVKEVVDLNREILKELRDVRGEEVRRIVEKARKINTEVKKKIEEIEKTVRKILKEVRKIIKDIRDEARRINEEVRKKLE

SEQ ID NO: 4833 - protein, 180 aa, Artificial Sequence; identical to SEQ ID NO: 4832
  Synthetic

SEQ ID NO: 4834 - protein, 180 aa, Artificial Sequence
  Synthetic
KEVEDIVRELEEEVEKIRDHSRRVSEELDKSVKDNKRRVDEVKKTLEKSVRDIRRKVRDDSLREIVERLKEKVDRMVRRLEEITEELEDKVRKVVENSRRIVKEVEDKVREVVRELERIKDGEVLKDVARRAREMLEEVRRKDRENTERARRLLEEVHRRTEEVERRAREVLKKADEDVK

SEQ ID NO: 4835 - protein, 180 aa, Artificial Sequence; identical to SEQ ID NO: 4834
  Synthetic

SEQ ID NO: 4836 - protein, 185 aa, Artificial Sequence
  Synthetic
SELDELRKRVRDLDERLKESDDTLRKLVKELIERVKKSDTELERLVERVIEEIERVLRDRKDSSEEVRRLLDTLRKIIEENIKRSTDLAREVTRIIEENIKTSRRLAEDAERTLEEVIRRLKDKSVKDRLRELEEELRKRMKESDERNRDLRRRLEEMIKDSKRTNDELKKRVEKVAREAEEKLR

SEQ ID NO: 4837 - protein, 185 aa, Artificial Sequence; identical to SEQ ID NO: 4836
  Synthetic

SEQ ID NO: 4838 - protein, 185 aa, Artificial Sequence
  Synthetic
DELERLEEEVEEVRRRLEKSDDDLRKLVDEVERRLRESDKRLHDLSEEVIRRIEDVLRKNRELRERLRTLAEELERISEENMRRVERLLEELERIIEENIKKVEELAERLRRRVEDVVRRLKDKSVKDELRKLKEKIKKVADESRRRNEELRRKVDKVIKDSRETNKRNTEEVRKVAKDVDDTVK

SEQ ID NO: 4839 - protein, 185 aa, Artificial Sequence; identical to SEQ ID NO: 4838
  Synthetic

SEQ ID NO: 4840 - protein, 174 aa, Artificial Sequence
  Synthetic
SEEERIAKEAEDLVRRVKENNARTIKEAREVARKVEAETKKIHDDARKLVEDVKRKVERRGVEELLEELREMVERSKKLSEDNVRESRRVSKEVKERDTESLKRLRDLVREVIKKVDKVRELKERLERVIKEIEETIRRSARELDEVNRRNEKMVKENEDELRKVIEEIERRIR

SEQ ID NO: 4841 - protein, 174 aa, Artificial Sequence; identical to SEQ ID NO: 4840
  Synthetic

SEQ ID NO: 4842 - protein, 174 aa, Artificial Sequence
  Synthetic
DEEEEIKKELRRVAEDVKRETKRIHEEIRRVLKEVKERLKRVHDELRRVAREVKEKLKKRPVERILEELRKVVKDSEDLSRRILEEIRRVVEESRKRSEDNVRESRRVVEKVIRDVDKVRELTEEAKKLIKENEEEIERNEREARKVIEELERVVRTNKEDVKRVEKEIEDATR

SEQ ID NO: 4843 - protein, 174 aa, Artificial Sequence; identical to SEQ ID NO: 4842
  Synthetic

SEQ ID NO: 4844 - protein, 178 aa, Artificial Sequence
  Synthetic
KEVEEIAKEAEDVLRRLDETVKEIADEAREVLRRLNESSKRIEEEARKAIKELRDRAREKEEILREVVEKLKRVIEELKKTDEEVERKLREVIKRLKDTNDEVRKKLKEAIDRLREITDKDELRKILKEVRDVLEEVKRRNEDILRRLRKIAEEVKRRNDKIREELERVLKEAEDRLR

SEQ ID NO: 4845 - protein, 178 aa, Artificial Sequence; identical to SEQ ID NO: 4844
  Synthetic

SEQ ID NO: 4846 - protein, 177 aa, Artificial Sequence
  Synthetic
SRLEKIKDDVKRLDDDSRRTLEEVHRRNKETARRVERLLEEAHRLNKKTVDEARSKPNDEDVARRLREIVKESLKLSKDVLKEIKDILDKSLKDSEDVVRLNEDILRKIERTVDSVERSDEIRKIKTDVKEMVKKNREDVKRNNEDVKRVEDKLRKELKKNDDDVRRVLEELERRLR

SEQ ID NO: 4847 - protein, 177 aa, Artificial Sequence; identical to SEQ ID NO: 4846
  Synthetic

SEQ ID NO: 4848 - protein, 180 aa, Artificial Sequence
  Synthetic
SEIEEVTRRLEELVKTVREVLREAHERTRRLVEKVRKLIEDVIRTNRKIKERVRELLERVRSEELKRLVEEVAEEMKKSDKELRDRVRRVVEELRRVTEEVRRLVEEAAKELRRVVDELKPGDEIRKLRRRVEEVVRELEEELEKDRREVEKVIEELEREVDRSNEETRRVVKRLREEVE

SEQ ID NO: 4849 - protein, 180 aa, Artificial Sequence; identical to SEQ ID NO: 4848
  Synthetic

SEQ ID NO: 4850 - protein, 174 aa, Artificial Sequence
  Synthetic
REKEEVRRKLREAERRVEEIDRRLEKLIRDVKRRVEEADRESEETSDRVRKEVERVDRRGERFEDLLRIVRRVLEENKRRLDETLEDVRRVVEEVERLVEETLRTVEEVIKELERDGVDEEVKERLKKVLEDNRRSIDELRRRIEEVLKENKRTVEEDKKRLEKVLEDVERRAR

SEQ ID NO: 4851 - protein, 174 aa, Artificial Sequence; identical to SEQ ID NO: 4850
  Synthetic

SEQ ID NO: 4852 - protein, 173 aa, Artificial Sequence
  Synthetic
SDTEEVEKLTEEIVREVKRLDEEVKELIKEIRKESRRTLEEVRRLIEEVRDRVEKISDDEKVRRLLKKVIEEVEEIARRSLRLLKEVIDEVRRIVEESKELLRRVIREVEKRVDSKDLERLRRELEEVLKENADSIRKLETELRDVLRRTREEAEKLKEELKDVLRRVEEKAK

SEQ ID NO: 4853 - protein, 173 aa, Artificial Sequence; identical to SEQ ID NO: 4852
  Synthetic

SEQ ID NO: 4854 - protein, 179 aa, Artificial Sequence
  Synthetic
DEERKIREEAKRADDEIRRLLEENKRALDESNKRAEELVKRLADEVREALKRIEDLLRERPRKEMEDLLRDLKRVLEEIKEELKKVLEDNRRVSEESKRRLEKVVRELRELLKEIEDLVKKDDVKKVVERLRRLIKEVKKRLEKIHEDSRRMVEESEKLLKEIVRKLRELIKEVEDKVK

SEQ ID NO: 4855 - protein, 179 aa, Artificial Sequence; identical to SEQ ID NO: 4854
  Synthetic

SEQ ID NO: 4856 - protein, 179 aa, Artificial Sequence
  Synthetic
DEKEDLKRTAEESDREAKKLLDENRKRLEESNKKAEDLVRRNEETLRKVDTDIKDLLRKRDTERAKRLVEELERVVRESLRLLRELLERNRELSKESLKRLEEVVRRNHELLKRIEELIDRDDVKKVLDELRRLVEESKELLKRIHDESEKMVEDSERLLEEVHRRSREVVERVREKIR

SEQ ID NO: 4857 - protein, 179 aa, Artificial Sequence; identical to SEQ ID NO: 4856
  Synthetic

SEQ ID NO: 4858 - protein, 179 aa, Artificial Sequence
  Synthetic
SEKDRLSKRAAESDEELERLVRRNAEELDRSNKEIADLLKESKDTLKRAEDEIRRLLAERDTERAKKIVRELEERLKEVEKHDRRSLEENTDVTRKSKERAERVLRENHRVLREVRKLIDEDDVEKVLKELEDVVKKSKELLERIHKESKEMVERSKRNNEKSLEDVRRLIERVLEKLK

SEQ ID NO: 4859 - protein, 179 aa, Artificial Sequence; identical to SEQ ID NO: 4858
  Synthetic

SEQ ID NO: 4860 - protein, 179 aa, Artificial Sequence
  Synthetic
DEKRRLKEEAKKSDDELRKLVKDSADRLEDATRRIEELLRENAKRLEEAEKRIREELDKRKRERMEKLLEELRKVVTDSKEAARKVVDDLREMLKRVKEHDRRSLEENHRVLREVEKLIDEEDVEEVLRRLKDLVERSKENNKRSLEEVERLIKEVEERLKRIHDESEKVVRTVEERLK

SEQ ID NO: 4861 - protein, 179 aa, Artificial Sequence; identical to SEQ ID NO: 4860
  Synthetic

SEQ ID NO: 4862 - protein, 185 aa, Artificial Sequence
  Synthetic
REAEEIKKRLERVREEVEKELERIHRETDKIAKDVKRELDEIDKESKKVAEEIKKVAEEIKDKEELKRRVDEVTRELERLNEELERIVREVVRRLEALNERLEEIVRRVVETLRRLVEEVVRRTGRGSKVDELKRRVEEVKRDLERKVRENNETIKKVKEDLRREVERNHKTIEDIKRELDERVR

SEQ ID NO: 4863 - protein, 185 aa, Artificial Sequence; identical to SEQ ID NO: 4862
  Synthetic

SEQ ID NO: 4864 - protein, 185 aa, Artificial Sequence
  Synthetic
SEAEELLDRIRRVAEEVKRRLEEIHRTTRDIVRRIEELLKEIHERTREIVERIKRVLEKIKDKDTLREEVKRVVKELEKLNKELEDIVRRVTRELERLNEELERIVREVAEDLKRLLEEVRRRTGDGDKVKRLEEEIRKIKRELEKIVRDNNEDIKRAKERLRKINKRNHDEIKKVKDELDETVR

SEQ ID NO: 4865 - protein, 185 aa, Artificial Sequence; identical to SEQ ID NO: 4864
  Synthetic

SEQ ID NO: 4866 - protein, 185 aa, Artificial Sequence
  Synthetic
SEAEDLRRRIEEVARRVAEKLKKINRDTERIVRDVKKKLEEIHKRTEEVAEEVKEVLRRIKDKDTLRKVVEEVAEELRDLNRKLEEIIRRVADELRKLNEELKRIVDEVVDELRKLIKEVVDRTGPGDEVEELRKTIEDIRRRLEEEVRRNHDEIRKAEEELRELNRRNHERIKEIKEELDREVT

SEQ ID NO: 4867 - protein, 185 aa, Artificial Sequence; identical to SEQ ID NO: 4866
  Synthetic

SEQ ID NO: 4868 - protein, 183 aa, Artificial Sequence
  Synthetic
SEVEKIDKRAKEVEKELEESNRRNRERIKEADERLRDLLRRNKEEIDRARKRLDEIVRRDEKDEVREIVRELDERLKDMNARLKEIVEELRRLLKEINDEDRRIIEELKRLLKKILEDAARLTDKKRLKEVERRMEEIVKTVKKRSEDSHRESDEIVKRVLERLRKVHEETKEIVKRVEDRLR

SEQ ID NO: 4869 - protein, 183 aa, Artificial Sequence; identical to SEQ ID NO: 4868
  Synthetic

SEQ ID NO: 4870 - protein, 174 aa, Artificial Sequence
  Synthetic
EEAERIDKKLEDEVREVERELEDVHRKVKEILEDVKRKHKKVHDELKKVIDEVKRKLEERPDERIVRELKEKLRESNERLNRLTEKVKKELADSNKLLEDIVRRLKERLEEVIREVDKIKELEEKVRRIVRKLERRVEKNKDDTRRAVEEAEKLNEDNKRTSEKVEEDLRRTTT

SEQ ID NO: 4871 - protein, 174 aa, Artificial Sequence; identical to SEQ ID NO: 4870
  Synthetic

SEQ ID NO: 4872 - protein, 174 aa, Artificial Sequence
  Synthetic
SEAEEIVRELRKAVEDVAREHKRIHEEVRKAAEDVKRKLKEILDRLERVVEEVARALEERGNEEIVETLKRKLEEAIKRARDVLDELRRKLEESNKALNRLSETLEKKLEEVIRRVDKIDELREEAKEVVRDVRRLNEENRKATEDILRELKEIVERLERRAREVVKELKERAR

SEQ ID NO: 4873 - protein, 174 aa, Artificial Sequence; identical to SEQ ID NO: 4872
  Synthetic

SEQ ID NO: 4874 - protein, 174 aa, Artificial Sequence
  Synthetic
DEREEIRRRLREDVKRVKRRLEEIHDEVRRLLEEVDRRLRKVHKELKEEVTEVEKRLRERPDKRIVEELRRRLKESIERTRKILETVAKKLRDSNRKLEKVVKDLKKRLDDVIRAVSDVRELKKEIDDVRKELEETVERNKRETERALRKAKEDLDRNREEVKRVVDELEKRTR

SEQ ID NO: 4875 - protein, 174 aa, Artificial Sequence; identical to SEQ ID NO: 4874
  Synthetic

SEQ ID NO: 4876 - protein, 174 aa, Artificial Sequence
  Synthetic
SEKDEIRDELEKILRRVEELNRRIRKKLEEIRKEVERLLREIHEKLEEVVKEVEEKLRERPDSRIVKELKDKLRESIKETADVLRKLEKKLRDVIREIRKTNKEVEEKLRDVIRRVDKIEELKRRVEEVLKRARESLRELEEDVRRVLEEARKELERNRERVERVLRRLEETVR

SEQ ID NO: 4877 - protein, 174 aa, Artificial Sequence; identical to SEQ ID NO: 4876
  Synthetic

SEQ ID NO: 4878 - protein, 179 aa, Artificial Sequence
  Synthetic
DEVEDLERRLKEVVDRSRRLDEELKRRDKKSVEDVRRKLEEVRKKLEDVARKLADLLRQGRDAKRVLDEIERVVRDVERVLEEILRDVKRSIDEVREVAKASLKLTEEVIRRVRKVAKERGVPLEKLERDVARAREENDRTLKEISKHSEKVLREVADMARKLRKEVKRIEDEIRERAR

SEQ ID NO: 4879 - protein, 179 aa, Artificial Sequence; identical to SEQ ID NO: 4878
  Synthetic

SEQ ID NO: 4880 - protein, 184 aa, Artificial Sequence
  Synthetic
KLVEEVKREIEELVRRLEEVLDRVRRENERLAEELKKVVKDVEDNNERIARTVTELLKKVDSKELERLLRKVVEDSRKSVKDLEKLLREFVRRSEESVKRLEDELRKMVETVRRVVEKLERDGVPKEKVDELKRDVDRAEEKVRELIERIKRRSEEVKKRAEELLKKLEDDSRRVKKKLDDDAR

SEQ ID NO: 4881 - protein, 184 aa, Artificial Sequence; identical to SEQ ID NO: 4880
  Synthetic

SEQ ID NO: 4882 - protein, 184 aa, Artificial Sequence
  Synthetic
SEVDEVRKEIKRLADEAREVVKEVRKNNEKIADDSRKLNERSIRESKKVTDTVRELLKRVRSRELDRLVKEVVERSNEIVEESERLVREMNKRSDDSVEKLREVLERIVRELERVVEEAARAGVPEERVKELKERVDEVSKELRDLLKKLRDDSERVVEENEKLLRELKERSDRATKELDDASK

SEQ ID NO: 4883 - protein, 184 aa, Artificial Sequence; identical to SEQ ID NO: 4882
  Synthetic

SEQ ID NO: 4884 - protein, 184 aa, Artificial Sequence
  Synthetic
KKAEKVDKEIEDLAREVREVLKEVEKDSDRLVKEVEDVLRRVKENNEDIRRRVSELDRRVRSEELRRLVKEVVDRSDESVRRLEELLKRAVKRSDDVVKKLEDELREIVKELRRVVEELERAGVPEESVERLRRKVKEIEDELRELLERLRKKSEDAKRKLRELLERIKRDSERAKRELEERDK

SEQ ID NO: 4885 - protein, 184 aa, Artificial Sequence; identical to SEQ ID NO: 4884
  Synthetic

SEQ ID NO: 4886 - protein, 184 aa, Artificial Sequence
  Synthetic
DTAREVKRKVKEIADEVRELIRRVHEETKKTSETVKKLIKEVHDTTEKIVREVRKLADEVDSEELERLVREAVRRLEETNRRLRELVERVVRENEKSSDELRKRVEEVVRRLRKVVKELDDAGVDKKLVEELKREVDRISEELKRLLERNEREVRESKKTLERDLERNHEEIERAKRELDERVR

SEQ ID NO: 4887 - protein, 184 aa, Artificial Sequence; identical to SEQ ID NO: 4886
  Synthetic

SEQ ID NO: 4888 - protein, 184 aa, Artificial Sequence
  Synthetic
REVDEVRKRVEKVAEEVRRLIEKVHRETERTSREVEKRIRDVHRRSDEVAREVDDLSRRVDSKELKELVEDVARRLEEINRRLEKLVKEAVDTNRESSERLRKLVREAVEKLKKIVEELDRRGVDKKMVRTLAERVKEISEELKRRLKRNKDEVEESSRRLRELLKRNHDEIRRIKEKLKEETR

SEQ ID NO: 4889 - protein, 184 aa, Artificial Sequence; identical to SEQ ID NO: 4888
  Synthetic

SEQ ID NO: 4890 - protein, 178 aa, Artificial Sequence
  Synthetic
EEVDRVKRKLEEVEKRVTEISKRTEELVEEVRKEVERISKRTEEDDRRVAKEVRERLKSGKDLKRLVDEVRRLLEETNRDNKRVIDEVVRELEEINERNKRVIDKVEEELKKIVEEVKRAEKAKEIKEKVDEVIERLRRSNRKLHERIREVEKKLRELNERLHRHSREVIKELEERAR

SEQ ID NO: 4891 - protein, 178 aa, Artificial Sequence; identical to SEQ ID NO: 4890
  Synthetic

SEQ ID NO: 4892 - protein, 179 aa, Artificial Sequence
  Synthetic
KEVEDILRDLERLSEESLRRNEEIHRELEELLRRVDEKNREIHKTLEEMVRRALTELRKRPDERILDELRRVLEEVLRLSEESDRELEDVLKKVLELSKESLDRNKKLLDEVRERIRTADEKVVREVDRRVEESRKRLEKLLRENEKRVRDARRRARKLSEENERTVREVEKRAREEVK

SEQ ID NO: 4893 - protein, 179 aa, Artificial Sequence; identical to SEQ ID NO: 4892
  Synthetic

SEQ ID NO: 4894 - protein, 179 aa, Artificial Sequence
  Synthetic
DEVEEIKRKLDKVADESRKLDEDIRDKLRRVADEIRRLHEESRKELEDVVREIERLLRERDIKEVLKRLKEMLDRIIRRDEEILKRLREMLKKVIEEIERSIERSRKLLEDVLREAKDVPEKVIKEVRDTVEKILRENEKSLEEVRKTVKRIEEESRELLETSRDEVRRVLEKAEETEK

SEQ ID NO: 4895 - protein, 179 aa, Artificial Sequence; identical to SEQ ID NO: 4894
  Synthetic

SEQ ID NO: 4896 - protein, 185 aa, Artificial Sequence
  Synthetic
SVADEIRKDLKRVADEVEERLRRLLEHNKKVRDEVKERVDESKKELKEVEEEVTEKLERIKEKERVKKVIDDVTKRMREIVEKNRRVSEEVKRLSEENVRESRRISDKVRKDLKRILDEIRRAGVDEKVVREIEERIRRVIRRLDEVDKTNEKISRDAARELEESDEELRRRVKEVKDRLDEKTK

SEQ ID NO: 4897 - protein, 185 aa, Artificial Sequence; identical to SEQ ID NO: 4896
  Synthetic

SEQ ID NO: 4898 - protein, 185 aa, Artificial Sequence
  Synthetic
DEAEKIKKELDDVAREVERRLKELLDDNRRVAEEVEKRLRDSKRELEEVTRRVRKELERIKNKEDVKRVVDEVVKEAEDILRKNEEVIRRVKDLSRRNVETSKRISEEVKRLLEEILKKAEDDGLDKKLVDKIRDDIRRIARRLDEMNKKNKKLSDELEERLKKSNEEHRRRVEKVKEELEKKVE

SEQ ID NO: 4899 - protein, 185 aa, Artificial Sequence; identical to SEQ ID NO: 4898
  Synthetic

SEQ ID NO: 4900 - protein, 185 aa, Artificial Sequence
  Synthetic
SEAEEIEKELREVAKEVRELMREMLKNNKEVAEEVKRRLERSRERLEEVEETVRDLLEKIKDKKTVRDVIRTVKKLLKEILDRNKKVIDEVKELSRENVKRSEDVSRDVLRRLEEILRKVRAAGVDDKVVKKIEDDIREVEKEARKLNRENRELSKKLAEELDRSNDRHRREVERVERELEKAER

SEQ ID NO: 4901 - protein, 185 aa, Artificial Sequence; identical to SEQ ID NO: 4900
  Synthetic

SEQ ID NO: 4902 - protein, 184 aa, Artificial Sequence
  Synthetic
SLQERVRDKVRKVKKDLEDLNRRHREEIERVVRELDKSNEDHEREVRRVEKELEELIRRNKERDEIREVVEELRKLLEEVLKENSDVIRELRELLKELHEKNRKVVKELDDLLRDVIDKLEKINDKKFVEDVDRALKRIADEVKRRSEESKKELDDIKKEVEERLRESKEKLKRIVDEARERLR

SEQ ID NO: 4903 - protein, 184 aa, Artificial Sequence; identical to SEQ ID NO: 4902
  Synthetic

SEQ ID NO: 4904 - protein, 175 aa, Artificial Sequence
  Synthetic
SELEEVIKRAEDELRDDERENKRVLEKSDRDIKRWEEEVKRVLKKARDELDKLRKEGIDEKVLREVEKIIRDVEEEIKKILEELRRITKKVEDESREILERVRRVIERVRRRANEDKDVVEKLREELEKVLKESRDESKRLKEELDKVNDDARKRLEDLMRKLERVLEEVRRRRK

SEQ ID NO: 4905 - protein, 175 aa, Artificial Sequence; identical to SEQ ID NO: 4904
  Synthetic

SEQ ID NO: 4906 - protein, 175 aa, Artificial Sequence
  Synthetic
SELERVIEEIRRALEEDHERNRDVLREAKEELERDKRRNDKVLTDIRKLVKDLERKGAPEDVLRELEEIIDRVLKRSEKILEEVKRVIDKVKRDSERINKEVEEMIKRVEERANEDEETVRRLTEELRKVLDEVTKRSKELSDRLREVLRRSKELSKELEKELRKVIKEADDRVK

SEQ ID NO: 4907 - protein, 175 aa, Artificial Sequence; identical to SEQ ID NO: 4906
  Synthetic

SEQ ID NO: 4908 - protein, 175 aa, Artificial Sequence
  Synthetic
SEIERVLKEARDELRKDEEKNRDLLRRAKKVIEEDHKRNRDVLRRVKEELDRLREAGVPEEVLKRVRKALEDVRKESERLNEELRDVLRRVAEASRRILEEVRKIIEDVERRANEDKDALDRLRRELEEVLRRSKEESDRLAEELKRVLREIEERSRRLAKELKEVLDTAKRDKD

SEQ ID NO: 4909 - protein, 175 aa, Artificial Sequence; identical to SEQ ID NO: 4908
  Synthetic

SEQ ID NO: 4910 - protein, 174 aa, Artificial Sequence
  Synthetic
SELERVIRENERTIREDMKKNEDVLREWEKLTRDLEDTIRRVLKKNRESLKRLKDKGVPEEVIKELEKVSEEIRRRLEEIIRDDRRVLKEAEKRSRDLLRELKKISEEAVELLRRNVDRRELVKRLRDVDERSDDTSRKLKEELERVIRRTEELIRRVMEDAKRVDDEARKKTD

SEQ ID NO: 4911 - protein, 174 aa, Artificial Sequence; identical to SEQ ID NO: 4910
  Synthetic

SEQ ID NO: 4912 - protein, 174 aa, Artificial Sequence
  Synthetic
SKVEEVLRELERRVKEDEDENRKVVRENERTVKEDEDTNRDALRRNEESIDKLRRDGVPEEVIRKLERLSRKIEDDSRKLLEELRELTRRIKKASEDLLRRLRELLERIVRLLERNVDVDTLKRELDEALKRSEEESRRLKEEVTRIDERSKRESDRLVEEAKRLDKEAKDRSD

SEQ ID NO: 4913 - protein, 174 aa, Artificial Sequence; identical to SEQ ID NO: 4912
  Synthetic

SEQ ID NO: 4914 - protein, 186 aa, Artificial Sequence
  Synthetic
SELEEVLKKAAEVIKEIEKRLRKVLEDSRRLTKEDEKRNKEVLKKLKEKIDEIEKRARDKGLPEKDVERLKRELDRALEDVERISKELKETNEDVDRKTEDIIRRIKKKLKEVLDKARDIVEKLKDVDEVLRRLDRELKEVLDRVEREVERLKEENDRMNKKSKDDSEKLERDLERVAERLERELK

SEQ ID NO: 4915 - protein, 186 aa, Artificial Sequence; identical to SEQ ID NO: 4914
  Synthetic

SEQ ID NO: 4916 - protein, 186 aa, Artificial Sequence
  Synthetic
SEAEKVLKEAREAAKRIEDEARKVLRESRELAKKAEEDDRRALKRAKEAAEKIKRDADRKGLEDKEAKKIEEKLRKALEDLERLSREAKKEAEKVDRKTKKIAEDIKRELEKALRDAEDIAEKLKTADKAIKEAADRLKKVLEDAEKKAREAAEENKRANEEWKKKSKRAAEEAKKVLDEAKKELD

SEQ ID NO: 4917 - protein, 186 aa, Artificial Sequence; identical to SEQ ID NO: 4916
  Synthetic

SEQ ID NO: 4918 - protein, 175 aa, Artificial Sequence
  Synthetic
SDKERIKERVKKVHKESAKHIEDVRRRNEEINKRIKEEIDDVERRNREINEDIRRLVRERRVDEKEIRKRLKDVRDETKRIVERIKRELERVLEETEKALEDNDRKAKKVRDELRELNLPERVIEDLERLIEENKRTLTEVIKRHRELLEDWKRRLDEVLKDHERSAREIDEEAR

SEQ ID NO: 4919 - protein, 175 aa, Artificial Sequence; identical to SEQ ID NO: 4918
  Synthetic

SEQ ID NO: 4920 - protein, 175 aa, Artificial Sequence
  Synthetic
DEKEEVRRTVEERLKRVEDRVRELEKENEDINRELKERLKKVRRENEEINERLKKLLDENRVDEKRLREELKKVKEKTDRMLEKIAEDAERVLKKTRDELEDIRRRAEKVLEDLRRLNLPEEVIRRVEEEIKRIEKRLRDVIKKHEDSVRKIRTDMERVVRDHERLAKKWEDDAR

SEQ ID NO: 4921 - protein, 175 aa, Artificial Sequence; identical to SEQ ID NO: 4920
  Synthetic

SEQ ID NO: 4922 - protein, 175 aa, Artificial Sequence
  Synthetic
DEAKEIEDRVRTEIRDIERKVREARERSKRSDDELKKHSEEVARELEEILRELEEALRRNEVDRRELERRLREALRRAKEVTERNEREVKKNLDELREILKRITDRLKKVLKDLKDLNLDKSVIDEVRKAVEDIARKLKKVLEDNKREIDKDRKRNEEVLRTAREKAEKIKEDAR

SEQ ID NO: 4923 - protein, 175 aa, Artificial Sequence; identical to SEQ ID NO: 4922
  Synthetic

SEQ ID NO: 4924 - protein, 175 aa, Artificial Sequence
  Synthetic
DEKEKIKEDVRRVIRRIEEIVKRVDRESERSDRELEKHSRDVERRLREINDRLRRLLEENRVDRREVRKRVEDSLREARRVTEENKKTVDRNLREVKRVIDEIDDEARKVLEELRRANLDERVIEEVKRLIDRIREELERVLEKNARLAKEDEERNERVLTENRKLIEDWEREAK

SEQ ID NO: 4925 - protein, 175 aa, Artificial Sequence; identical to SEQ ID NO: 4924
  Synthetic

SEQ ID NO: 4926 - protein, 184 aa, Artificial Sequence
  Synthetic
SKLEEVVRRVDKDARDIRRRNEEVKRRNEKSAREIEKKVKKVLEEFRRLVEEIRKRLEEEGIPDSLIRTLERIATEVLKRIKEVLERLKRILDDSRRLLEEVSERNDRSLRDLKRELEEVSNSTDERVLKELEERVRKVLKDNRDTSKELEERVRRIDEELDKTLRKAKEELRKIIRELEERLR

SEQ ID NO: 4927 - protein, 184 aa, Artificial Sequence; identical to SEQ ID NO: 4926
  Synthetic

SEQ ID NO: 4928 - protein, 184 aa, Artificial Sequence
  Synthetic
SELEKVLERVKREAERIEKKNKKVLEENKKSAEEIHRDNERVLREVKDMADKIEDELRKRGIPKSLEKTIRDILERLKDRLKKVNDENRESAERSLKEIKDVSRENRRSIKELLDELREVKRTTDRKVLRDVERRVKKILDDNKRTSDEMKKRLDRLDETNKRTSEKLEEDVRRIIEDLERRVK

SEQ ID NO: 4929 - protein, 184 aa, Artificial Sequence; identical to SEQ ID NO: 4928
  Synthetic

SEQ ID NO: 4930 - protein, 184 aa, Artificial Sequence
  Synthetic
SKLEEVLKKLERLAREIERRLRDVIRRNKESADRIRKRNEEVLRKVEDVAREIEDKVRRGGVPKSIIERLRRIAKEIAREIERASRENEKSAKRSAERAEKALRELAKILRDIAEELRRVSNDKDEEALRTLDKRVEDIIKRLKEEVDRVVRDLEELDKENEKSSREVEERLKEIIRELEETLK

SEQ ID NO: 4931 - protein, 184 aa, Artificial Sequence; identical to SEQ ID NO: 4930
  Synthetic

SEQ ID NO: 4932 - protein, 184 aa, Artificial Sequence
  Synthetic
SKLEEVLKTLRRLIEEIKKRLKKVKDDNKKSLEDIHRKNKRVLEELEKRLRDIDKKLKDKGIPRTRIEELKKIVEEIRRTVRKVNEDNKRSVDESRRELEDALRELDRILKELEALIRRVKNTTDERVLKEVEERVERIIRELRRRVEELKRRVEELDRRNEKTSDDLEEELKRIDKELKDRTD

SEQ ID NO: 4933 - protein, 184 aa, Artificial Sequence; identical to SEQ ID NO: 4932
  Synthetic

SEQ ID NO: 4934 - protein, 184 aa, Artificial Sequence
  Synthetic
SKVEDVVRRVAEVAERIRRRNEEVAEENERSLKEIHDENKEVVERARKMAKRIEDEVRRKGVPKELIKRLEEIVRRVEKRLKEVNEENRKSAEESRELLRRVNKRNDESLKRLLEKLERVKNTTDEEVLKTVADEVREILERNEKTSEELAERVRRLDEENRRTSREVEKRVEEVIEDLKRRLK

SEQ ID NO: 4935 - protein, 184 aa, Artificial Sequence; identical to SEQ ID NO: 4934
  Synthetic

SEQ ID NO: 4936 - protein, 181 aa, Artificial Sequence
  Synthetic
SEVDKLEEDLRRIIKEIRRLVEEVKRKSEEIDRELKRLLEEAERTLEEIDRKLEDELRKKGNDEDVRRELKEIVERSETLVREVLKTLREVARRSEELNKDVHRRLKELVEEVRKRLEDLPEDDKVREVKKDVEKKLKELEEELRDITRRNRESLKRLEERLKEVAKKNRKTVDELRKELD

SEQ ID NO: 4937 - protein, 181 aa, Artificial Sequence; identical to SEQ ID NO: 4936
  Synthetic

SEQ ID NO: 4938 - protein, 181 aa, Artificial Sequence
  Synthetic
DEVDDLKRRLEKIITEDEKLVKEVKDRSEKLDREIAKLLEDARRALEKLDKELEEILRKKGDDEDVRRELKKIADDSRRLAEKVLKELDDILKKSEEENRRVHEDSERSMREVEKLLRALEEDDKVREVVKRVRDEADKSRRKLEEITRRNRDSLERIKRKLERVLEENDRTLRELEERAR

SEQ ID NO: 4939 - protein, 181 aa, Artificial Sequence; identical to SEQ ID NO: 4938
  Synthetic

SEQ ID NO: 4940 - protein, 177 aa, Artificial Sequence
  Synthetic
SELEKVVEDSRRKLDAWDDESRRVAEESRRRLEEWRKRLEEVAKRVEERLRDLKRKAGDREKLREAKKELRRVVERIKKLVDEVEKRSEEILDRNRKLNDKVRKESEKLAEEIKRVDDEELVKKMARELDELNKDLDRLNKESKRELERLNTELAELIKEVERELRELLRKLEEDLR

SEQ ID NO: 4941 - protein, 177 aa, Artificial Sequence; identical to SEQ ID NO: 4940
  Synthetic

SEQ ID NO: 4942 - protein, 177 aa, Artificial Sequence
  Synthetic
DSLEDVVRRVKKKLDDNRKDVERVAKESEELLKRWRDRVKKVVRDVERRAEELRRRRGDDKSLRDVEERLRRIVRDLERLIEEVERRSRKILKDLRKLNKDSVDEAERLVEEIKRVTDEELIKTFERTLEELHKTNKKLNEEVKKRLEELNTRLAKLIEDVRKELEKVLKELEDRAR

SEQ ID NO: 4943 - protein, 177 aa, Artificial Sequence; identical to SEQ ID NO: 4942
  Synthetic

SEQ ID NO: 4944 - protein, 177 aa, Artificial Sequence
  Synthetic
DELDEVVREVKDRLRENKEEVKRVMDESRRLLERWNEESERVAKKVEEAVRKLTKDKGDDDLLREVKKALKRVLDENRRLNEEVEERSRRIVDRLRRLNEESEKRAEELTKEARRVNREDDIRRITKRLRDLHRENEKLNRDVKKELRELNERLAKLNRDSTRELEELLRKLEEDAR

SEQ ID NO: 4945 - protein, 177 aa, Artificial Sequence; identical to SEQ ID NO: 4944
  Synthetic

SEQ ID NO: 4946 - protein, 177 aa, Artificial Sequence
  Synthetic
SELDKVVEESKRLLEEWDRRSKDVAKKVKEMLDRSRKASKEVVKEARDELERLKRETGDVEEVREMEKRIEKIVREDEELNKDSVRRAEEIVRENEELNKEVKKRSKDLVDEARKVTDEKDIREIKERLKRLNETLAELNERSKKRLKRLLDEDKKLNDDSSKELKELLKELEDRTR

SEQ ID NO: 4947 - protein, 177 aa, Artificial Sequence; identical to SEQ ID NO: 4946
  Synthetic

SEQ ID NO: 4948 - protein, 177 aa, Artificial Sequence
  Synthetic
RELEDVARRARKKLEDNKRRVEEVAEEVERRLDESRKESDKVVREVEEVLKRLKEERGDVRSLDRVTERAEEIVRDDKRLNKRSKDELRKVLKRLRELNKRSVETIEKLLEEIKRVKNEELVKRMTEELERVHRENEKLNRDVRRELEDILRKDEELNKRSKKRLKDLLDELRRRLT

SEQ ID NO: 4949 - protein, 177 aa, Artificial Sequence; identical to SEQ ID NO: 4948
  Synthetic

SEQ ID NO: 4950 - protein, 177 aa, Artificial Sequence
  Synthetic
SELEEVVKKVRTDLDRIDEKSKRVAKEVDRVLKESEDRSKKVAREVEEVLRKLKEEAGEVDELKRVMKELKEIVDRDERLNEESSKRLKEVVKDNERLNEEVRRRAEKLVEEIKRVKDEDLVRRAVETLERLIRELEKLNDESKRRLEEILREDKRLNKESTEELRRLLEELRKTLT

SEQ ID NO: 4951 - protein, 177 aa, Artificial Sequence; identical to SEQ ID NO: 4950
  Synthetic

SEQ ID NO: 4952 - protein, 181 aa, Artificial Sequence
  Synthetic
SEVERVAEELKRVLKELEDLDRESEKKLKRLNEELARLIEEVRRRLEEVLRTLEELAKRVKDKETIDRILRRIEEALKKLADEARDILREAKKASEDLARENKKLLDDARETIERLARNLERTREVEEVIRRIDEAIKRIEKHSREVIERSRERVEDWRRKVERVIEEVERRARKLREDTR

SEQ ID NO: 4953 - protein, 181 aa, Artificial Sequence; identical to SEQ ID NO: 4952
  Synthetic

SEQ ID NO: 4954 - protein, 181 aa, Artificial Sequence
  Synthetic
SEVEKVAEEAKRVLDELEKLDRDSAKELKDLNDELRKRDKESEDALRKITRDLDELDKRVKDEKTARDIEREIDKRLEEIARTNEELLKTAKKRSKDLARKNKEILERIARALKELADKLRRDKDVEKVIRDLKRELERLAKHSEEVIRTSEELLKRWEDHSRKVIEEVKERARDIKRRTK

SEQ ID NO: 4955 - protein, 181 aa, Artificial Sequence; identical to SEQ ID NO: 4954
  Synthetic

SEQ ID NO: 4956 - protein, 177 aa, Artificial Sequence
  Synthetic
SELEKVVKEVEEALERNNRENRRVIRRSRELLKRWREEVEEVVRRLRERAKKIADDVDKREVLERLKEMIRRVEEKLERILEKAERDSRRIEEEIRRLNERLKELVERIKRKMDRVTREEEVRKLEEDLRRILEEIDRESDRLVKRIEDLNRRVAELLKRVEEELEDLARKVEEEAK

SEQ ID NO: 4957 - protein, 177 aa, Artificial Sequence; identical to SEQ ID NO: 4956
  Synthetic

SEQ ID NO: 4958 - protein, 184 aa, Artificial Sequence
  Synthetic
SIEEIVEEIERELEKLKRKLDELIKRSEELSRRLAEKTRRSNEEIKREIDKVADDIRKTLSDREKVERIRKKLEEVHERHRKIVKESEDHLKEVNDRLREILRELAERLEEAIKKIRDIVRRTTDEDTIRRVLEEAREEIKKLERDVDKVRKEVEDAHRKNSELNKTVHDEVRKIIDEIRKEVK

SEQ ID NO: 4959 - protein, 184 aa, Artificial Sequence; identical to SEQ ID NO: 4958
  Synthetic

SEQ ID NO: 4960 - protein, 184 aa, Artificial Sequence
  Synthetic
SIEEILREIEELIKDLLRKAEELLKESEKRSKELKDEMKRSNEEIRKLIEDLRRRAKDRVEDKDKVKRLEDDLRRVHEEHKKRLDELAKKLEDANRRAREILDKIRRRLERLLEEAEDIVRKVKDEDVIRDLLRRVREDIDRLRKELEKVVRELRRIHEEVRRDLKRVHEEVRKRIEDLEEELK

SEQ ID NO: 4961 - protein, 184 aa, Artificial Sequence; identical to SEQ ID NO: 4960
  Synthetic

SEQ ID NO: 4962 - protein, 179 aa, Artificial Sequence
  Synthetic
KEVEDVVRRVRKLIEDNERRNKEVHEEVEKRARENVERNRELLEKIRRTVEEIRRELEELRGDERVVKKVEDDLRRLLEEAKEVLKKSEKNLDELLKKHEKVLRDSEEDLKRVLDELRERGLDKDLLDEVRRLLERVKRRTEESNRRVKKIVDDVKRTSEEILREVEELLRRLIDDARK

SEQ ID NO: 4963 - protein, 179 aa, Artificial Sequence; identical to SEQ ID NO: 4962
  Synthetic

SEQ ID NO: 4964 - protein, 179 aa, Artificial Sequence
  Synthetic
DEVEKVFREVKKRIDENREKNRRVHEKVEREARRNSEENRRVHEEVRKTVEDIRRELDEKRGDEKAVREIEKKLKELLEKHKRVVEESRKNLTELLEEHKEVMRDSERDLRRVLKEVEKAGLDEELLRRIEKLAREVRDETRRSNEKVKEIIRRVEKESEDSNREVKRLLDELTRDARR

SEQ ID NO: 4965 - protein, 179 aa, Artificial Sequence; identical to SEQ ID NO: 4964
  Synthetic

SEQ ID NO: 4966 - protein, 179 aa, Artificial Sequence
  Synthetic
SEVEDVVRKAREILKRNEDENRRVLEKVREDLKRLTDENDKVVEDVREMVRRIKEMLDRNRGDERVLEEVERKLREVEDRVREAKRRDEEKLKRLEEELRRVVEESRRDLERLLEELKRAGVREELLREVDERIKDVKRKTDEILREVRERIKRNEERTERLRREIEELARRLLEDAER

SEQ ID NO: 4967 - protein, 179 aa, Artificial Sequence; identical to SEQ ID NO: 4966
  Synthetic

SEQ ID NO: 4968 - protein, 177 aa, Artificial Sequence
  Synthetic
DEEDLLEKIERILEEVKRRLEDVIRRVRKSNEDIERELKKAVDRSRELLRKVEEDLRRNRVDERLLDRLRKIKDENRKLLETLDRELKKISKEDEDRLREVEKRVEKIMRELRERIRREGADRDVFERLERIARRLTEEIEKALRDSDKLNEELKRKVEEVLRRSEESIRTVLEELR

SEQ ID NO: 4969 - protein, 177 aa, Artificial Sequence; identical to SEQ ID NO: 4968
  Synthetic

SEQ ID NO: 4970 - protein, 175 aa, Artificial Sequence
  Synthetic
DEIEKVRKDVDEIIRRLEEELEEVAKRLEDLNREIERILREVKKESDDTIRTIERLRKEGVDRRDIKRISEEDERKLEEVEKTLKRIADKSRELTEDVKRRLKEALDRLEEELKRVNVDESIVKEVRDKLRRLEKRLDDLAKRNEESLRELKRTLEEIIKRSRKENKRIEDEVRK

SEQ ID NO: 4971 - protein, 175 aa, Artificial Sequence; identical to SEQ ID NO: 4970
  Synthetic

SEQ ID NO: 4972 - protein, 184 aa, Artificial Sequence
  Synthetic
SEVEEVEKELRELIREDKERLDRLRKELKESIDTNKEKLDRVKEDLERLIEEIREEARRRNIDKETMDRLDEKLRRLKKELEEVIKDSRKKLEELLDELRKVVEENKRRLDEVEKELKEVKKLKDRERLTKLVEKIREVLERSKEHSERVAKKIRDELDKLHKETERVDRKLKTEARRLKEELR

SEQ ID NO: 4973 - protein, 184 aa, Artificial Sequence; identical to SEQ ID NO: 4972
  Synthetic

SEQ ID NO: 4974 - protein, 184 aa, Artificial Sequence
  Synthetic
DEVERVEEELKESIDRNDEELRRVRKENRESIEKDRRDLKRVEDDLRRLIKKIDEEVRRRNIDEEDVRRLKEKLDRLLKELRDVVKENADRLEATLRELEEVIKRSREKAKRARDELREVKRDSREEALREVVRKLRKLLKELHEETKRVMEKLRKLDRESEEHTKEVDERIKKTIEDLERELK

SEQ ID NO: 4975 - protein, 184 aa, Artificial Sequence; identical to SEQ ID NO: 4974
  Synthetic

SEQ ID NO: 4976 - protein, 184 aa, Artificial Sequence
  Synthetic
SEVDEVRKELRKVIKEDEDTMRKLEEENRKSIEEIRKELEKVEEELERVIRRIEDEIRKRNIDKRIADRLRKELKRLLEELRRVIEDLKRKLDKTREKLKRVADENRREAREVEEELKKVAKEDRREVLETLVRKIREELKRSKEHSKRVADDLRRMDEEIRREVKRVVDKVRELLKRLEDELK

SEQ ID NO: 4977 - protein, 184 aa, Artificial Sequence; identical to SEQ ID NO: 4976
  Synthetic

SEQ ID NO: 4978 - protein, 184 aa, Artificial Sequence
  Synthetic
DEVEDVLRRLKELAEEDKTKLKEVEKENKESIKEDRKRLEDVRRELEKLIEEIRREVTERRIDEKEVRKLEEKLKRLAEELEEVVKENERTAEKTERRIREVIKRNEDKLRRLMDELRKMKRSKDEKVLRDVSRRIKEEVEKSKKHSEEVKKELEDADRESKRHTEEVEKKIRELIERLKRETK

SEQ ID NO: 4979 - protein, 184 aa, Artificial Sequence; identical to SEQ ID NO: 4978
  Synthetic

SEQ ID NO: 4980 - protein, 184 aa, Artificial Sequence
  Synthetic
DEIDRLREELKRLIDKDKTDLDRVRKENEESIRDDERKLREVEKELRDLIEEIRRKAKERNIEEEIMRRLDEKLKKLERDLEEVKKKNETNARENRKELERVIEKNKEDADRLRRELDEVARDEDRRVLEEVARKIRELIRRSEKHSEDVMEKVRRNDERSKRHTEDVTRKIRTEIEKIDRELE

SEQ ID NO: 4981 - protein, 184 aa, Artificial Sequence; identical to SEQ ID NO: 4980
  Synthetic

SEQ ID NO: 4982 - protein, 175 aa, Artificial Sequence
  Synthetic
KEKEDVKKRLDEEAEKNKRTSEEAKRRNRESIRRNKETSKRVKEENRRSFEELDDLLRRGDGRREDLRRLLEANLETNTRVHEENDKSAKDNERTNEKVHRENDESLKEIKKRVREENLDKRVEEELDKLMEEIRRHNRESNEELKRLVEEIRKHNRESNEELKKLLEEIERKTE

SEQ ID NO: 4983 - protein, 175 aa, Artificial Sequence; identical to SEQ ID NO: 4982
  Synthetic

SEQ ID NO: 4984 - protein, 175 aa, Artificial Sequence
  Synthetic
DEDKDVEKKLRDIIKRNKETSRDVARRLEEIIKRNKKTSDEVATEVRKLIKEIEDVLRRGDGSREELEKLLEEVRKRLEDVHRENKESLKKVEDELKEVHRRNDESLKRVRERIEKENLDEKVKEELRRLIEEIKEHNERVLRKLRKLVEEIERTNEDIRRELKELVEDIRRKAK

SEQ ID NO: 4985 - protein, 175 aa, Artificial Sequence; identical to SEQ ID NO: 4984
  Synthetic

SEQ ID NO: 4986 - protein, 175 aa, Artificial Sequence
  Synthetic
SEKEEVRKRLRDKVEDNKRTSKEVADKLRKIIKENKDTSKKVMEDLRRIIEEADELLRRGDGSEETLRKIAEDLERDLDRVHEENRKSVEDLEEELREVHRENKKSADDIRREVDRENLDDDVRRELDELVKRIAEENKRVEDELRRLVKEIEDHNEEVKRELKELVKRIEEKTR

SEQ ID NO: 4987 - protein, 175 aa, Artificial Sequence; identical to SEQ ID NO: 4986
  Synthetic

SEQ ID NO: 4988 - protein, 175 aa, Artificial Sequence
  Synthetic
SEKEEVEREVEERLRDNKRTSDKVVEENRDSVRRNKKTSEDVKRENEESVRRIDEVLKRGDGSEETLDRLAEENRRTNEEVHERNDRSLRKNDETNKRVHEENDRSLREIKKKLDEKNVDEDVKRKAKRMVEEIRERNRKSNEELKKLAEEIRKHNKDSNKKLKELVDEIRRKAK

SEQ ID NO: 4989 - protein, 175 aa, Artificial Sequence; identical to SEQ ID NO: 4988
  Synthetic

SEQ ID NO: 4990 - protein, 175 aa, Artificial Sequence
  Synthetic
DEERRVREKLKKIIKDNEDTSRKVREDVKKELDDNRRTSEKVARDNERSIEEIKKALERGDGSEDDLRRLARENEETNRDVHRRNDESLRKIERRLEEVTKRNKESADRAREEVERANLPEEVRRELDKLVKEIKERNDEVIEEARERVKRIREKNERSNRKLKKEAKKIEEEAR

SEQ ID NO: 4991 - protein, 175 aa, Artificial Sequence; identical to SEQ ID NO: 4990
  Synthetic

SEQ ID NO: 4992 - protein, 175 aa, Artificial Sequence
  Synthetic
DEDREVERDLKKIIKDNKRTSEEVEKKLRDIIRKNEKTSKEVEKELRDIIRRADELLRRGDGSREDLKRILDELRKKLEEVSKRNKDSVDELRKELKEVHDRNKKSLDEVREKLEREKLPEEVKKDLDRLAEEIKKRNEEVRKDLDDLVRKIEKRNEEVKEELDRLAREIEEKAR

SEQ ID NO: 4993 - protein, 175 aa, Artificial Sequence; identical to SEQ ID NO: 4992
  Synthetic

SEQ ID NO: 4994 - protein, 175 aa, Artificial Sequence
  Synthetic
SEEDEVRRRLRRIIEENRRTSEEVRERLRKIVEDLERTSRDVRRKLREIVERIKEVLTRGDGSREDLERILKEIEDRLEEVTRELKRIADEARRTLEKVTEDNRRSLEEVKKEVRKDKLPREVEEELRRLIEEIERRNKEVREELDRLIEKLEDDNRKVHKELRELAKEIKDRAD

SEQ ID NO: 4995 - protein, 175 aa, Artificial Sequence; identical to SEQ ID NO: 4994
  Synthetic

SEQ ID NO: 4996 - protein, 188 aa, Artificial Sequence
  Synthetic
RELEEVVKRIRDILREIHERSEKSAEENRRLIEKAEEDSKRSAKRIREIIREIREEVKRIKDKDTLRKLLEDLERELKKLIDDNRKMVEDLRRESKRSIDDNRRLNEEIHERLRRIIEELRRRLRERDVREKLERVAREVEKSNKDNRDHSKRVEEESRELLKKLRKHSEDVAREVKKLLDELREETR

SEQ ID NO: 4997 - protein, 188 aa, Artificial Sequence; identical to SEQ ID NO: 4996
  Synthetic

SEQ ID NO: 4998 - protein, 188 aa, Artificial Sequence
  Synthetic
SELEKVVEDIRRLLRKIHEDSKRSVRKNEELVEELKRLSEKSEREIEELLRRIKELLKRIKDKESLKRALEELEERLRRIIEKNRELVDRAEERSRKSVKENEDLNRRIHEELKRVIDDARKKLRDERVKRKLDDVEREVRKSNEDNRKHSDEVRRKSEDMLEKLRRESERVADRVRKVLKELEDERR

SEQ ID NO: 4999 - protein, 188 aa, Artificial Sequence; identical to SEQ ID NO: 4998
  Synthetic

SEQ ID NO: 5000 - protein, 188 aa, Artificial Sequence
  Synthetic
SELEKLAKEIEEILREAKERSKESAERIRKLVRDLRELSRESEERIRKIETDVKKKIDDIKDKDTVRRLLEELRKRLEEMIKRNEDLVRELARLLKEMTDRNRRLVEELEREIRKLIEDLRRRLREREVRRKVEDVERRVTKVLKELEDRSREVEEEVERVLRDLKRHSDEVRREVEEVLRRLTERTK

SEQ ID NO: 5001 - protein, 188 aa, Artificial Sequence; identical to SEQ ID NO: 5000
  Synthetic

SEQ ID NO: 5002 - protein, 175 aa, Artificial Sequence
  Synthetic
SEREKIAEDIRKLVDESRRNLEDVVRRARELAERVRRNLKRVMETLERLAEEIRRIIESGDRSDRVLRELKKLLDDIDKYLKENHRRLEELVKEIEKYLEDDHRRLRELIEDIRRKLSDDKDLERELKELLDKHKKDLDDVREEIRRMLETHKEELDRVKKRVEDVLREAAERTR

SEQ ID NO: 5003 - protein, 175 aa, Artificial Sequence; identical to SEQ ID NO: 5002
  Synthetic

SEQ ID NO: 5004 - protein, 175 aa, Artificial Sequence
  Synthetic
DERERIREEVRKLARESKENLKRTEEDLKRRLEEVKRNLERVDEEVERLVRTVAEIVRKGDKDDEVLRRADELLKRIEDYLKKNNDRLRELIERVERYLERDHRELERLIEEIEDRLRDDEELKKEAKKLLKEHRDKVKEIKEDLKRAHEEHRKRLEEVVEKLKRVLRDLAEKVR

SEQ ID NO: 5005 - protein, 175 aa, Artificial Sequence; identical to SEQ ID NO: 5004
  Synthetic

SEQ ID NO: 5006 - protein, 175 aa, Artificial Sequence
  Synthetic
SEREEIVKTLRELVKRVKENLKRVTEEARKLADESRRNLERVAEEIRKIAEEVKRIVERGDRSSRVLEEIERVVREIEKYLKEDHDRLRTLIKRIKDYLEENNRRLEELLKDIKDKLSDDKDLEKELEDVHREHKRRLDEVVREMEDLLRKHEDDLRKVKREAEKMLKELTETTK

SEQ ID NO: 5007 - protein, 175 aa, Artificial Sequence; identical to SEQ ID NO: 5006
  Synthetic

SEQ ID NO: 5008 - protein, 175 aa, Artificial Sequence
  Synthetic
SEREEIAERAERLSREVKKKLEDIRREIEELAKRVLDNLRRVLRDVERLIEEVKDIIRRGRRSSEVLKRLEDELRRIEKYLRENNERLKRLIDTIRDLLRRLHEEHRRLLEDIKRKLSDDKKLKDDLDRADEELERRARKVDEDLKELHERHRRLLEDVRRELERVIKELKEETE

SEQ ID NO: 5009 - protein, 175 aa, Artificial Sequence; identical to SEQ ID NO: 5008
  Synthetic

SEQ ID NO: 5010 - protein, 175 aa, Artificial Sequence
  Synthetic
SDRERIAKRARELSERVKEKLEEILKEVRKISKDMKKRLEDILREAEELSRRIKEIVESGDSSDEVLKEHRDLLREIKEKLERLHEDHRRVLEEIKKRLEELHKDHKRLLDDVDDKLRDDDELRKELEEVDDELRRKIEEIKKELETMDKELRDRAKEIEKRLEDSNREVEERRR

SEQ ID NO: 5011 - protein, 175 aa, Artificial Sequence; identical to SEQ ID NO: 5010
  Synthetic

SEQ ID NO: 5012 - protein, 175 aa, Artificial Sequence
  Synthetic
SEREEIAKTVRKLSREMKETLKKITEEARRLSEEVKRALKKIVDDLRELMKDVKRIVESGDRSDKVLRDARELVKRIVERLEELHERHRKLIEEIKKKLEDLHRTHRRLIEDVERKLKDDKDLKKELEDVDRELADTIRRVEEELKKVNEELRKRVEDVREEAERALRELEERVR

SEQ ID NO: 5013 - protein, 175 aa, Artificial Sequence; identical to SEQ ID NO: 5012
  Synthetic

SEQ ID NO: 5014 - protein, 175 aa, Artificial Sequence
  Synthetic
DERERIAEELKKLTEEIRRRVEDVMREAERLAEEIKRKLEDVLEEVRRLSDRIREIIESGDRSDEVLRRHRKLLERIREELKKILEELRRLVREIKEKLKELHERHKRLLDDVDRKLSDDDDLRREAEKVNRKVREDLKRIEDRMRELLKEVEDLLRKIEEEARKSNKELEDRTR

SEQ ID NO: 5015 - protein, 175 aa, Artificial Sequence; identical to SEQ ID NO: 5014
  Synthetic

SEQ ID NO: 5016 - protein, 178 aa, Artificial Sequence
  Synthetic
SEAEKAREDVERAAKESKDKLDEIRKEVEKAARESREEAKRNEKDIKDAAKKLRELARDKKADEKVARRAEKIVEDNERSAKEAADRSEETAKRARDKLRKAAEDSKRTAEKARRDAEKRGADRDVLEELRKIAEDDKRRVDKVARELRELAKRDKEEAKKVHDENKKSAKEAEDELR

SEQ ID NO: 5017 - protein, 178 aa, Artificial Sequence; identical to SEQ ID NO: 5016
  Synthetic

SEQ ID NO: 5018 - protein, 178 aa, Artificial Sequence
  Synthetic
SSDETLRRELEKAVEESRRLLEENRKTIEDMVRESKRLLDRNREEIKKLVEELKKLLRDNNLPKEVADDVREIVRRNEESVEKLIRDSKETVDRDRKSLEDVARESEETVRKLREDVDRRGVDRDVLREIRELLKRDKERLKEVHKRNRESAKRDKDRVKDVHRKNRDSARRVKERLR

SEQ ID NO: 5019 - protein, 178 aa, Artificial Sequence; identical to SEQ ID NO: 5018
  Synthetic

SEQ ID NO: 5020 - protein, 178 aa, Artificial Sequence
  Synthetic
SSDETARKEIEDMVRESKKLLEEIREELDRVVKRLRRELEENEKDIKRLVKRLRDLLRENNLPDEVERRIEKIVRENEKSVKDVAKEVEDIVRELRRLIEEAERRSEKTVRELREKLRREGVDRDVLREIRELAKRDKDTVKKVMEEIRDRLRKLDERIKEVHERNRRSLKDVEDKVR

SEQ ID NO: 5021 - protein, 178 aa, Artificial Sequence; identical to SEQ ID NO: 5020
  Synthetic

SEQ ID NO: 5022 - protein, 178 aa, Artificial Sequence
  Synthetic
DEDREAKRRLDEAVKESRDRLEEIRKEVEKMVRENEELNRRNEEEIRKAVEELRELLRRQKLPEDVVRKIEKIVEDNRESVKRNVDESRKIVKELRDLLKKLFEESEETVRELEDRLRKRGVDRDVLREIEEELTKDRKRVKEVLEELRRIAKRLKERDEESHERNRRSLDKLKKEVK

SEQ ID NO: 5023 - protein, 178 aa, Artificial Sequence; identical to SEQ ID NO: 5022
  Synthetic

SEQ ID NO: 5024 - protein, 178 aa, Artificial Sequence
  Synthetic
SSEDEARKEVDKMAKESEELLRRNEETIRRLVRENEEKNERNRREIERVVRELDRLLKERKLDRTVERKIREIVTRNKKSVDDNKKRSEDIVREDEESVDELVKDSKRTLDELRKKIKREGVDRDVLRELREIAERDKKKVEDVHRENRDSARRLKEEDDDSHRRNRKSMKEVKEDVE

SEQ ID NO: 5025 - protein, 178 aa, Artificial Sequence; identical to SEQ ID NO: 5024
  Synthetic

SEQ ID NO: 5026 - protein, 186 aa, Artificial Sequence
  Synthetic
REIEEVAKRLRKLVKELKERSKESKDRSRKLMTELKKLSKDSLRELRRLLDELRKILKDRRDSEETVKEVEERLKELLERNKRDSERVAREDKKLNDDNREESKKAAEELKKIVKELEDRNRGKRDVKKKLDEIRREVKKVIEEDKRLNDESEKDSRRLIREDEDENRRIKEEIDRAVEELRRRRK

SEQ ID NO: 5027 - protein, 186 aa, Artificial Sequence; identical to SEQ ID NO: 5026
  Synthetic

SEQ ID NO: 5028 - protein, 186 aa, Artificial Sequence
  Synthetic
SDIERVLEELRRLVERLKRETERFAKELRDLARRVKEMSKRSEEELRELATRLKDTLRRRKESKERVEEVKKRLREIIKRNKETSKRVAEELKRIVKESKDLSEEVARRLEEIIKRLEDRNRGKRDVEEKLRRIKRELREVIKEDEKRNREIEREVDKVIRELEKLNKRIEDEVRKLEEELERRLK

SEQ ID NO: 5029 - protein, 186 aa, Artificial Sequence; identical to SEQ ID NO: 5028
  Synthetic

SEQ ID NO: 5030 - protein, 186 aa, Artificial Sequence
  Synthetic
SDIERMRDRLRKLVEEAREKSDRSREELEKLVRELRRKTEKFLKELRDLARRLKETLKRRKDLADEVRKVIKELKEIIDESKKVSKKVADELKKLLEENREKSREVEETLRKLVKDLEDRNRGKRDVKEKLDRIRKEVEEVARDLKRKNDEIEEEIKKVIRDDERRNEEIEKEVRKMAEELRRTLK

SEQ ID NO: 5031 - protein, 186 aa, Artificial Sequence; identical to SEQ ID NO: 5030
  Synthetic

SEQ ID NO: 5032 - protein, 186 aa, Artificial Sequence
  Synthetic
SDIERVRKELRELLERVARRSEKSMRDDKKSMDDLKKEIREVEEELRRLATEVKKTLKDRRDSEDRVRKAIEDLERIIEELEKRVRRVEERNERTVEENKKESEKVAEDLKRIIDKLEERNRGKRDVKKKLEEIEREIREAIKDLRRKNREIERTNREVIKELREELKRIDTEVKKLVKELRETSK

SEQ ID NO: 5033 - protein, 186 aa, Artificial Sequence; identical to SEQ ID NO: 5032
  Synthetic

SEQ ID NO: 5034 - protein, 185 aa, Artificial Sequence
  Synthetic
SELEELERDLERELEEDKRRNEEVMERNERRLRKLKEDVDRVVKELEDLLRKLEKILREEKDKDTIRKILEEIEDEARKILEKVKRLIETIKRESEESNKRLRDENRESEERLERILRKVREDGAPESELERLDRRLKKLIKESRETVDEIEERSERAIRDLERKLKELEERLRKKIKELRDETR

SEQ ID NO: 5035 - protein, 185 aa, Artificial Sequence; identical to SEQ ID NO: 5034
  Synthetic

SEQ ID NO: 5036 - protein, 175 aa, Artificial Sequence
  Synthetic
DETKKVEDDLRRVDTESKKHLDDVHKESKRVADELRKKLEDVHRRSEEMVRRLRRLLEENRTDKRELERALDEVLRESEKVVEEIRRLLEKVLRDSERAMRENRRLLEKVKKEVEDVKIREEVKKRIDDALRENERRAEENRREIERVLKELEDRVDENRRRIEEVRKELRDRAT

SEQ ID NO: 5037 - protein, 175 aa, Artificial Sequence; identical to SEQ ID NO: 5036
  Synthetic

SEQ ID NO: 5038 - protein, 175 aa, Artificial Sequence
  Synthetic
DETREVDERLKEADRRSKKHLDDVHKTSKKVLDELRRKIEELERRVRKVVKELEELLRENRVEEEELKRRAEEVEREIDRIVKEVKDLLEEVKKRSDEVAKENEERLKKVKKDLDDNNIPEDVRRKVDKIIKENRKMLEDNKRTIEEVLRELKERADEIKERVKKVLKKLEEDRR

SEQ ID NO: 5039 - protein, 175 aa, Artificial Sequence; identical to SEQ ID NO: 5038
  Synthetic

SEQ ID NO: 5040 - protein, 175 aa, Artificial Sequence
  Synthetic
DEEEKVERDVERVDKESKEHLDRVHEETRDINRRSEEHLRRVHRDSEDVARRLRDAVRRRTVDERDVERALREVRKKSEDVVRKNEEELKRALEKSKEVVEKNERELRELLDRLEKLNIDEKVKRRVEEAIKRNRDEARRDEEEVKKAIKRNREEADRNRREIEKVVEELRRRAT

SEQ ID NO: 5041 - protein, 175 aa, Artificial Sequence; identical to SEQ ID NO: 5040
  Synthetic

SEQ ID NO: 5042 - protein, 177 aa, Artificial Sequence
  Synthetic
SEKEEVKRRVDEITKRARKKLEDVHRRSEKIDRDSREHLERVHKRTKEILDELRDELRKRRDEDVARRIEDIATKLRRESEEVAKRNEDLLDELRKESEEVSRDLERLLKELRKELDAFNVDEDLRRRLEKVFRELKETLDRNREEIDRMVKRNRKTLRDNKEEIDRAVREARERLK

SEQ ID NO: 5043 - protein, 177 aa, Artificial Sequence; identical to SEQ ID NO: 5042
  Synthetic

SEQ ID NO: 5044 - protein, 177 aa, Artificial Sequence
  Synthetic
REDEEVLKDLKRIVDELRKKLKELHDRSEEIDKRSKKHLDDARRRVEEIMRRIEKRLREERSDKVRETVERLAREVKKEIDDVKRRNERLLRELKKESEKVSREIEEILRRIEEKLERKNVDDKVRKDLKDVAKEMRDRLEENERRIREAAKRNRTELERIERELKEFKDRLDETAR

SEQ ID NO: 5045 - protein, 177 aa, Artificial Sequence; identical to SEQ ID NO: 5044
  Synthetic

SEQ ID NO: 5046 - protein, 177 aa, Artificial Sequence
  Synthetic
SEVEKVMEEAKRIVTELEEKIRELERKVKKIDEDSRRHLKEVHDRTAEIAKTLRDILRKERSEEVAKEIERLLTELEKESKDVARRNEDLLRRLEEEIRRVVEEIRKLLEELRKRLDDKNVDDKIRREIEEAVERLETEARRLRREVEEAVRRNREMLKRNEKEIKDVAKELRDRLR

SEQ ID NO: 5047 - protein, 177 aa, Artificial Sequence; identical to SEQ ID NO: 5046
  Synthetic

SEQ ID NO: 5048 - protein, 182 aa, Artificial Sequence
  Synthetic
REDDRIRDEIRKLVEDNRRLLREILERLKTLADRLREINKKSNDDNERSADELREVLKKVRSEEVKRLVERVVEENRDSNRKDREISKKVVRELEELIERLREESKRSAEELERLIEDVVRKKGRDLEEVRREVEKAIRDSKEKLDELEERVRRMIEESEKLVEDNHRRIEEVEREMEEALR

SEQ ID NO: 5049 - protein, 182 aa, Artificial Sequence; identical to SEQ ID NO: 5048
  Synthetic

SEQ ID NO: 5050 - protein, 182 aa, Artificial Sequence
  Synthetic
KDEEEIKKAIEELVKRNEDIVEEIKRRSDKLADDLRDINRRSNEDNDRSLKTLEELLRRVDSKDVKELVERVIKRNTDSNREDEERSKEVVRRDEKLNEDLRRISEDSARKLEDLIRKIVERSGRDLKEVRDRVRRAIEKSKEDLDKSEDDSRKVIEESKRLVEENHRRIRKAVRKAEEATR

SEQ ID NO: 5051 - protein, 182 aa, Artificial Sequence; identical to SEQ ID NO: 5050
  Synthetic

SEQ ID NO: 5052 - protein, 176 aa, Artificial Sequence
  Synthetic
SEEEEARKKLKEAADRNRKVNEDAKKKAEDAARKNKKANEELAKKLKDAAEELKRVSRDEREEALREAAKKAKKIAEDAKREAKKVAEETAKIAKEIEDELRKALEESKEIAKRLEDEGAAEEIKERAKEVLERHKRSAEKIKEEAKRVLDEHRKRARDWEEEARRVLKEAEEEAR

SEQ ID NO: 5053 - protein, 176 aa, Artificial Sequence; identical to SEQ ID NO: 5052
  Synthetic

SEQ ID NO: 5054 - protein, 176 aa, Artificial Sequence
  Synthetic
REEEEVRKEVKKLKKENEDVNDKVRRDLEELLERNRKVNKELEDKIRDAKRRADEMLRVEDKDVLRRVLEEIRRLIEELKKELEEVLRRSREIIEKIREDLERVLRESKKKIDELRRRGVTEEIEEELRKVLKEHKELVERWKREAEEVLEESKRLIDKWKEDLERVLEDFRRKAE

SEQ ID NO: 5055 - protein, 176 aa, Artificial Sequence; identical to SEQ ID NO: 5054
  Synthetic

SEQ ID NO: 5056 - protein, 175 aa, Artificial Sequence
  Synthetic
SEAEEIEKRLKEVLDRHDKSAREIKDRLRKVIEEHRKLVEEWEKEARDVVKELKDENSELKDVLRELERILREIVKRLEDVLRKTEKILKEIERRLEEVKRRTKEILDEIKELLRRGEDTRRLRERLRKMEEDNRKINKEIRDEVKELEKENREINKRVEEELKRVRDELKRTAD

SEQ ID NO: 5057 - protein, 175 aa, Artificial Sequence; identical to SEQ ID NO: 5056
  Synthetic

SEQ ID NO: 5058 - protein, 175 aa, Artificial Sequence
  Synthetic
DEVEDIKRELEEVVKEHEKSVEDDERKNEDVVRRHDELVKKWEEDLRRVIEKLKRDNKDAREVLEELKEILDRLKKEADEALERTRRMTERNKKTAEDVRRDTERILREIDELVRRGRDERDLRRRVKDLKRRNKEMNERSKKHSDEVKEENKRINEEVEKKLRDVKEKLDRDIK

SEQ ID NO: 5059 - protein, 175 aa, Artificial Sequence; identical to SEQ ID NO: 5058
  Synthetic

SEQ ID NO: 5060 - protein, 182 aa, Artificial Sequence
  Synthetic
SELEKLIKEVEDLAKEVADKLRKSNKELRELVRKIAKALEETNREIEKVVRRVKRLLESGDRSSKLLKELEEIIRRAAKAHKDILDELEELVKTAARAHERILEELERLAKEIEDKLRERGLDKSKLKKIKEDLKRIADEIRKIVEDSKRDLERVADEARKIVEKSKEDLKRAKEEAEKETK

SEQ ID NO: 5061 - protein, 182 aa, Artificial Sequence; identical to SEQ ID NO: 5060
  Synthetic

SEQ ID NO: 5062 - protein, 182 aa, Artificial Sequence
  Synthetic
DELDELTKRARELVERNRRHIERSNRELKRLVKEVLDRNRENHKTVEELVKTVLKLAKDGDKSDELLRRLEKLIRESEEHLERSHEELDRLIRKADKDHEKNTRDHRRLVEKIDDDLRREGVDRSDVERVRKELKDSTDDIKRLVDKSREDLKRAKEKDEKSVRDNRERLRRVLRRLEEEVR

SEQ ID NO: 5063 - protein, 182 aa, Artificial Sequence; identical to SEQ ID NO: 5062
  Synthetic

SEQ ID NO: 5064 - protein, 182 aa, Artificial Sequence
  Synthetic
SELEKLTKEVRDDVRRVMERLKRSNDDIRRLAEEVIRRNDESRKKLEKLVEEVKDLFRRGDKSDKLLREAERLIEEARKEHEKLLRELRELVKRVTRKHEEILREVEELVERIKRSLEEKGLDDSKVREIERELDEVRKRLEDLVRKSKEDLDRVREELERLVEKSKRDLDKARRDLDEARR

SEQ ID NO: 5065 - protein, 182 aa, Artificial Sequence; identical to SEQ ID NO: 5064
  Synthetic

SEQ ID NO: 5066 - protein, 182 aa, Artificial Sequence
  Synthetic
DELEELEKKVREDVRRVKEKMERSHRETEKLARDVKKRLEDTNREIKKLVKEVEDILRRGDKLDEVLRRLEELIRKVLKDHEDILRELAELVERVERRNEEILREAEKLVRDIERELERNNLDKSKVEKVRRDLDEARKRLEELDRRNRKRLEEVRKEIREIVEKSKEDLKRAKDRARETVR

SEQ ID NO: 5067 - protein, 182 aa, Artificial Sequence; identical to SEQ ID NO: 5066
  Synthetic

SEQ ID NO: 5068 - protein, 182 aa, Artificial Sequence
  Synthetic
SEAEALIEEVKTLVRRNKEHAKRSHEKTEKLVRDVADALRKTNDEARKLVEEVRRILESGDKASRVLKRLEDLARELARAHKEILRTLEELVRRAKRDNERNLDEHRKLIEEIERRLEKDGVDKSKLERLKRELTRSAEELRELDKRNEDELRRAAKRIRDIVRKSEEDLKKVRDDAREKTR

SEQ ID NO: 5069 - protein, 182 aa, Artificial Sequence; identical to SEQ ID NO: 5068
  Synthetic

SEQ ID NO: 5070 - protein, 182 aa, Artificial Sequence
  Synthetic
KDVEEVRKELDEIARRVTEEIKRVHDETARIVDRLRERLEKVTRDNRRSVRELEKELERNKEKAERVKEIVTRNRETTKRVKDEVRKIIRELERKSEELEKRVREIEEKLKELLKRLAERGVPEKKLREAKKRLDELAERLKRLIDRNREEIKRVAREADERIRENEKEVEEVEERLDRKIK

SEQ ID NO: 5071 - protein, 182 aa, Artificial Sequence; identical to SEQ ID NO: 5070
  Synthetic

SEQ ID NO: 5072 - protein, 182 aa, Artificial Sequence
  Synthetic
KDAEKVVEDLERKADAVMRKLEDVSRRHREIAKRIKDRLEKVHRDNEKSVEDLKRILKRNRESEEEVRRIVEENRRSSDELRKEVEKIVKEMEDTSREVAKDVEKIVRELREELKRLRERGVPEEIVRRAEKKVEDFERRLRKLIEDNKREVDKVEKELRDTIRRNEERIREAVEELKRTSD

SEQ ID NO: 5073 - protein, 182 aa, Artificial Sequence; identical to SEQ ID NO: 5072
  Synthetic

SEQ ID NO: 5074 - protein, 182 aa, Artificial Sequence
  Synthetic
EDVRRVVEELRKIAEDAKEKARRVHERDRERVRKVEEDAKKVHEENEESVTRLERLLDRRRESDKDVRKIVEDNERSSKEVERRLEEIVRRSRKHSTDVEEDLKRIVEELERKLRELATRGIPEDDVRRIREEVEKVRKDLKDIVKRNKEANDEVEKRLRDIVRRNRERIEEMRRRLEEKKR

SEQ ID NO: 5075 - protein, 182 aa, Artificial Sequence; identical to SEQ ID NO: 5074
  Synthetic

SEQ ID NO: 5076 - protein, 182 aa, Artificial Sequence
  Synthetic
EDVKRVVKELEDIAEEVRRRLEKVNRENRESMKRLEEELRKVHEENRESIERLKRTLKDRRESKEEVRKIITEDKKTSEELKRRVEEISERNKDTSRRLEEDVKRIIDKAREDLERLARRGIPEEIVKEAKERVDKVKDDLRRLIEENERDIRRMDRKLEDEIRRNDEELRRVVREAEETVR

SEQ ID NO: 5077 - protein, 182 aa, Artificial Sequence; identical to SEQ ID NO: 5076
  Synthetic

SEQ ID NO: 5078 - protein, 182 aa, Artificial Sequence
  Synthetic
SDVERVRRELREIAETVKERLREVNERNRKSVRDVEEIVKKVHEEDKDLARKVEEILERNREADEKVKKIVRESEETSKELERRLREIIKDNERTSKELEEEVRKITRELEKKLEDLARRGIPKERVDDIKREVDKAREDLRRLIEENKRDIKEVVERLEKLIKDNRDDNDRLRRRLEEKSR

SEQ ID NO: 5079 - protein, 182 aa, Artificial Sequence; identical to SEQ ID NO: 5078
  Synthetic

SEQ ID NO: 5080 - protein, 182 aa, Artificial Sequence
  Synthetic
SELEKVEKELKRIVDEVKKELKRVHEDDERLVRELEESLKKVTEDDRRLARELEDTLRKRRESEREVERIIDESRKTSEDLEKEVEDIVRTSEETSKKMEKRVRDIVRKLEETLRRLREAGIPEEDARRAEERVRRVVKELKELIERNKKRNKEAVERLRRLIEENKRENREVEKRARDTAR

SEQ ID NO: 5081 - protein, 182 aa, Artificial Sequence; identical to SEQ ID NO: 5080
  Synthetic

SEQ ID NO: 5082 - protein, 182 aa, Artificial Sequence
  Synthetic
KDAEEVLERLKKIAEEVAKELRDVDEENRRLLKRWAEILEEVTREDERLARELEERLERRREASEEVREIERRSRETSEELERTVRDVLRKDRKSSKELEERVREIIKRAREELKRLAERGVPEEKLRRAKEEVDRAEKELRELIKRNKDNLERAVRELEKLIEENERRNREVEKRLEDRER

SEQ ID NO: 5083 - protein, 182 aa, Artificial Sequence; identical to SEQ ID NO: 5082
  Synthetic

SEQ ID NO: 5084 - protein, 182 aa, Artificial Sequence
  Synthetic
KDVEDVVRRLEEIAKRVKERLKEVDKRNKDKAREWLKEVKEVHERNEKLAEEVRRTLKDNREKSEKVRKITEESKKSSDTVRKRLEDLSRDDKRSSEELRREVEKIVRELRDILRRLRERGIPEEIVREAEKRVREMERELRELIERNKRNVEEMDRRLEELIKENEERNKRVEEDLRRKTK

SEQ ID NO: 5085 - protein, 182 aa, Artificial Sequence; identical to SEQ ID NO: 5084
  Synthetic

SEQ ID NO: 5086 - protein, 181 aa, Artificial Sequence
  Synthetic
DEVEEAKRRLTELVDRLRKTLEKVSREDRELEERVRKITKDSHDTTEEILKRLKRELEKGVDKEEVERVREELEEITKRNEDESRRVIEESEESTKRLEEEVERVEREVRRLLEELRRRGVDEKDLRELEERVRRAVKKLRDDLRRNKKESEEVKKKLEDENKKNRDRVAEAEEELRRRTT

SEQ ID NO: 5087 - protein, 181 aa, Artificial Sequence; identical to SEQ ID NO: 5086
  Synthetic

SEQ ID NO: 5088 - protein, 181 aa, Artificial Sequence
  Synthetic
DEVREMLRTLDEIARRLKKRTKESIDTDRRLVKKLREETDKSIEDDKKLVKEVEELLDGGADEKIVREVIKRSRDLNRENKERSRKVIKESRELNKRNSEETKRVIEELRELLRKLKDDGVEERKLRELEKRIRKAEEELRRDNERSKKETEDVERDLERKNEESERRTREAEKRLKERSD

SEQ ID NO: 5089 - protein, 181 aa, Artificial Sequence; identical to SEQ ID NO: 5088
  Synthetic

SEQ ID NO: 5090 - protein, 181 aa, Artificial Sequence
  Synthetic
SEVEEVLKRLRDIARELEKLIEEVIRRDRKLVEELKRRSERSIETDRRLVKRLKEMLDGGADSKDVKRVIERSRELNDENTRESERVIEESERLNRELEERIKEVTERLRRLLKELRDRGADEEKVRRAEEEIREVERRLRKLLRDSKEETKEVVKELRRLNEESKKETEKVVREAEKRTK

SEQ ID NO: 5091 - protein, 181 aa, Artificial Sequence; identical to SEQ ID NO: 5090
  Synthetic

SEQ ID NO: 5092 - protein, 181 aa, Artificial Sequence
  Synthetic
KDAEEVVRRLTKLVEDLKRKIEEVIREDKELVDRVRDTSRKSDETLEKLVREVKKLLREGATSEILEKVIRELEEILKKNTEDSKDAIRKSRELNERLARDIERVIRELREIVKRLAERGVEEEKLKRLEDRVREAEKELRELLERSEDTTRRAERELEELNRRLEDKIRRVVEELKEESR

SEQ ID NO: 5093 - protein, 181 aa, Artificial Sequence; identical to SEQ ID NO: 5092
  Synthetic

SEQ ID NO: 5094 - protein, 181 aa, Artificial Sequence
  Synthetic
SEVEDVLRRLERLVRELEKETKRSLEENEKLARRLKKKLEDVVRDNKRLVDEVKELLKEGADERTLREIEKRSDDTLEELKRDVDRVIKESKETLEDNSRKTKEMIDRLRELVKRLRERGAEEEKLRRLEKLVRDAARRLKELNDRLRKRSKEVKEELERILRELKERSDRAKEDLRRAAK

SEQ ID NO: 5095 - protein, 181 aa, Artificial Sequence; identical to SEQ ID NO: 5094
  Synthetic

SEQ ID NO: 5096 - protein, 188 aa, Artificial Sequence
  Synthetic
SELEKVEKDLEKLIRDDEEENKRVLEELERLVREDKEKNKRVHDETRKLEDTLRRILEKSKDKDTIRKILKEIEDRLDDLNRKLHEKNRESTERLKRLIDELRRTNKRSVEELERLLKELAERLDKEEAKEKLRRLKERIREAEEKSRKSLRDIEETLKKVKRESEETDRRNRDTLRRAKKRLKDETR

SEQ ID NO: 5097 - protein, 188 aa, Artificial Sequence; identical to SEQ ID NO: 5096
  Synthetic

SEQ ID NO: 5098 - protein, 188 aa, Artificial Sequence
  Synthetic
DEVEEVKKTIRDLLRRNKEISRETLERLKKLVDENRERNKKVHDETKKLTEEIKKILEEIKDKDTLREILREIKERLKELNKRLHETNKRSREELEKILRENHEISKESVRRARKLLEDLRRRLDKEEAEKELRKLEKEVKDAKEESERSDRRLEKEIRDVERDSERSDRENRDEIRRVAEELDERSR

SEQ ID NO: 5099 - protein, 188 aa, Artificial Sequence; identical to SEQ ID NO: 5098
  Synthetic

SEQ ID NO: 5100 - protein, 188 aa, Artificial Sequence
  Synthetic
SEAEKVLRDLEELVRENEEKSERSLRELEKLVRDNEEKNKEVVKRIKDLAERIRRILEEIKDKDTLEKILRKIDDDARRLLERLERINRESDERLRRLNKRNEDLSRESVKRMEELIRDLERKLDDEDAKRKLEEIRKTLEEVKRRSEDSNRELRRRLEEVKRRSEKSLRDLEELVRRIKKELDDRSR

SEQ ID NO: 5101 - protein, 188 aa, Artificial Sequence; identical to SEQ ID NO: 5100
  Synthetic

SEQ ID NO: 5102 - protein, 185 aa, Artificial Sequence
  Synthetic
SEADKLREDLERRVREIEKRSRDSDKRLEELLEEIRRRSKRTLDELERRLREVEEELEREKDKETVDRLLKEVEERLRKILEDNKRLIEDITEKLRKILEENERLIREAVKELERLLEDLERKGVDKKKVDRVRDEVRKVKRKLEEEHKKLERKVREARKELEKSHRDLNREVKKAKERLDRKRD

SEQ ID NO: 5103 - protein, 185 aa, Artificial Sequence; identical to SEQ ID NO: 5102
  Synthetic

SEQ ID NO: 5104 - protein, 185 aa, Artificial Sequence
  Synthetic
DEVEKLRKELEDLAEKIKRESEKTLRELKKLADEIRKLSEDTLRRLKELLDRVEELLRETKDKETVRRLLEKVREELRKISEENRELIERLARRLDEIAKRNKELIERIARRADELLKRLKDKGVEERKVRELEKTVEKIKRELEKSHEDLNREVEKIKRDLERSHKELNELVKRAEERLRRETK

SEQ ID NO: 5105 - protein, 185 aa, Artificial Sequence; identical to SEQ ID NO: 5104
  Synthetic

SEQ ID NO: 5106 - protein, 185 aa, Artificial Sequence
  Synthetic
SRVEELKRRLEELIERIDRESKRTLKELKDLAREIKELSERTLRELERLAKEVKEELDRIKDKDTVRRVLEEAERMLKEISERNKRLIEDIARKADEIHKRNRELIEDIRRKLEEILRRLRTEGVDEEKVKELEERVRRVDEELERSNERLRREVKKIKEELKESHERLNKRVEEIRRELRERSR

SEQ ID NO: 5107 - protein, 185 aa, Artificial Sequence; identical to SEQ ID NO: 5106
  Synthetic

SEQ ID NO: 5108 - protein, 185 aa, Artificial Sequence
  Synthetic
DEAERLEEEIRRLAEEIKRLSKESLERVEKLLEEVRRESKRTLEDLERLVRDVEDKLRKIKDEDTVRELLKRVEDELRRILEENKKVIDDVEKELREINEENRRLIEDAARKLDTLLRDLERKGVDEEKVRRLKKRIDEIKEELKKSNEDLHRRIEEAKRELEELHERLNRDVERVKEKLRRDAK

SEQ ID NO: 5109 - protein, 185 aa, Artificial Sequence; identical to SEQ ID NO: 5108
  Synthetic

SEQ ID NO: 5110 - protein, 185 aa, Artificial Sequence
  Synthetic
RELEELLKTLEELLKKIEEESRRSLEELKRLVDDIRRKSEESLERLERLAERVKEVLDREKDKETVDRLLKEVARRADRINEENRELIDRARKELDRILRENAELIRKIVEELRRLLEKLKKDGAPKEKIDRLEKRVRDAKKRLEDLHRELNKRVEDVKRDLEESNKRLHDTVREIKKELRERTR

SEQ ID NO: 5111 - protein, 185 aa, Artificial Sequence; identical to SEQ ID NO: 5110
  Synthetic

SEQ ID NO: 5112 - protein, 185 aa, Artificial Sequence
  Synthetic
DEVRELEERIDRILKKIEDESRRTLEEIKKIAREVEKRSEDTLRELDDLVRRVEELLERIRDKETVDRLLKKAKKDLEDIHRRNREVIERAARELDRMLEENKRLIDKIIEELKRMLDELRKRGVDEKDVRRLEKKIREAEKRLRESNERLEKTIRDIKKRLEKLNKELKDRVDEVVKRLRDKTE

SEQ ID NO: 5113 - protein, 185 aa, Artificial Sequence; identical to SEQ ID NO: 5112
  Synthetic

SEQ ID NO: 5114 - protein, 185 aa, Artificial Sequence
  Synthetic
SELEELLERLKRRADEIRKESEKTLEELDRDARRIEKESRETLEELKKRLDDVRRALEETKDKETVRRLLEKVAEELKRISDRNERLIREAAKKLDKIHDRDRRLVEKAREELKKLLEELEREGVDKKKIDDLRRKVEEIEKDLKRSNDELRKRVKEIKDRLKELHDKLNEDVKRARKELEERRK

SEQ ID NO: 5115 - protein, 185 aa, Artificial Sequence; identical to SEQ ID NO: 5114
  Synthetic

SEQ ID NO: 5116 - protein, 185 aa, Artificial Sequence
  Synthetic
SEAEELLERLDRRLRRVEETSKRTLDELKRLLEDIERKSRKSLKELEDLVRKVKDMLRREKDRETVRRLLEEAREVLREINERNRKLVEDIRRLLEEIHRRDKELVERVRRELEKLLRDLERKGVDEKKIRDLERRVEEAARRLEKSNRDLAEEVERAERRLDRSNRELRRRVEKVLKELEDTER

SEQ ID NO: 5117 - protein, 185 aa, Artificial Sequence; identical to SEQ ID NO: 5116
  Synthetic

SEQ ID NO: 5118 - protein, 185 aa, Artificial Sequence
  Synthetic
SELEELEKRLEDLAREIKRRSRESLKELEELVKRIEETSKRTLDELKRLLDEVVKELRRIKDKETVRRLVEEVEKRLEEIHKEDEKLVREATERLRRINEENKRIVKEAVDELRRLLKELRKRGVPEEDIRRLEERVEKIREDLERLNRELHETVKRVKKRLEDSNRRLKEEVRKAKRRLDEELK

SEQ ID NO: 5119 - protein, 185 aa, Artificial Sequence; identical to SEQ ID NO: 5118
  Synthetic

SEQ ID NO: 5120 - protein, 185 aa, Artificial Sequence
  Synthetic
SEAEELTERIRKILKEIRELSEKSLRELRELVKTITELSKESVERLKRRVEEVKEELRRIKDKETVRKRLEDVERELERINKENRRLVEEAERRLREINKRNEKLVRDIKRELERMLRDLRRKGVDESKVRELEERIRRAEEELKKRNEDLHREVRKVLKELRDSNKELEKEVKRVKKELRDESR

SEQ ID NO: 5121 - protein, 185 aa, Artificial Sequence; identical to SEQ ID NO: 5120
  Synthetic

SEQ ID NO: 5122 - protein, 185 aa, Artificial Sequence
  Synthetic
SELEKLAEDLERLAEEIKRESDRSLEELRELAERIKRESRKTLEDVKKLLKEVKEVLDREKDKETVERLVRDVEKKLREINKRNRELVEKIARDMRRINEENRRLIEEIRRLAEELLKRLKDEGVDDKKIEDLRRRVEEIIKRLEKSNRDLRKEVEDIKRELEKLNKELHDTIREAKERLDRTTK

SEQ ID NO: 5123 - protein, 185 aa, Artificial Sequence; identical to SEQ ID NO: 5122
  Synthetic

SEQ ID NO: 5124 - protein, 186 aa, Artificial Sequence
  Synthetic
REVEELLKELEKVVRENEKKIEDLHKRNEDVVRKIEKDHRDSEKELKEVADRVRELLERKPNIDELLKRILEELKRIAEEVEKRNEEIIEELKERVRKSREDAKRSLEEHERIIRELERRLEERGVREDDVRRLKKRAEESLKKIEDDLRRDEDRLRRVIEKSKRLVDKLREELERVLREIEKRIR

SEQ ID NO: 5125 - protein, 186 aa, Artificial Sequence; identical to SEQ ID NO: 5124
  Synthetic

SEQ ID NO: 5126 - protein, 186 aa, Artificial Sequence
  Synthetic
SEAEKLKEDLDRVVEKVKEDLKRLHDENRRVAEKNERVIEELHRRNREVTKELEKRLEEKKDDKEELERIIREAEEIVKKSLKRLKESLEEHRKIIEDSKRELRKILERLKKIIEELDDRLRKRGVEEEKVKRLRDAVRKVLKEIEEELERDERAVAKTLRKIEELLKRDKKELDKVRKRLEERLR

SEQ ID NO: 5127 - protein, 186 aa, Artificial Sequence; identical to SEQ ID NO: 5126
  Synthetic

SEQ ID NO: 5128 - protein, 186 aa, Artificial Sequence
  Synthetic
SEAEKIEEELRRAAETAKKRHEDSERELEEAAKTAEERAKRIHDRNERAAEEAKKRAEDDKDADELAKRILEELERIARKSEEDLKRILEELRKIAEDAEKRNREINEELKEIAKRAEDRLRKRGAEEEKATRIKREADEARKESKKLAEKLKKRADEARRKLEEEAKRDKERADRAAKEIEDRAR

SEQ ID NO: 5129 - protein, 186 aa, Artificial Sequence; identical to SEQ ID NO: 5128
  Synthetic

SEQ ID NO: 5130 - protein, 186 aa, Artificial Sequence
  Synthetic
SEVEKLKEDLKRVVERVKRDHERSLKRLEDVAREVEKRIRDLHERSKDVMRRLKDLIDKKKDDTELLERIIRDAARIVKESKDRLREILRDLEKIIEDLKRENEEINRDLRRIVKELKERLDERGVEEDELRKLAEDIKRAEDESRKLVERLKKKAEEVRRKIKKLLEENEEELKRILDRLREAAK

SEQ ID NO: 5131 - protein, 186 aa, Artificial Sequence; identical to SEQ ID NO: 5130
  Synthetic

SEQ ID NO: 5132 - protein, 186 aa, Artificial Sequence
  Synthetic
SEVEELLERLKKVADDIRREIEKLHKRTKEVADEVRKRHEDSRRELEKVADEVRDRIEKDKDADELLERILRELREIIKRLRERNERINRELRRIAEESERELKRILDEARKIVKELRDRAERRGVDSKALKRLSDEIKKIEDEIRKLLEDNRREVEEAEKESRKLVEELERRAKEVEEEIKRARD

SEQ ID NO: 5133 - protein, 186 aa, Artificial Sequence; identical to SEQ ID NO: 5132
  Synthetic

SEQ ID NO: 5134 - protein, 186 aa, Artificial Sequence
  Synthetic
SEVEKILEDLKRVVDEVRKRHKESLDRNKKVADEVRELHERSDKELEDVVREVKDKLEKNKTDKKLLEDIRRELREIVDRVRRDNERINRELKKISDKLDKENEDINRELREIAERVRDKLRKDGIDSKDVKRIEDELRKANEESRRLVEELRKHSEDVNRESRKLVEDLERKLRKAEKDIEDDAR

SEQ ID NO: 5135 - protein, 186 aa, Artificial Sequence; identical to SEQ ID NO: 5134
  Synthetic

SEQ ID NO: 5136 - protein, 186 aa, Artificial Sequence
  Synthetic
SEVEDLLRRLKEVVEEVERLIKKLHKETKEVVDEVRRLHEKSLRELKKAADDARDALRRNKDITELLDTIIRDARRILEELARRNEEINEKLKRIADRSAKRLEEILERLRRIIEELKDELRKRGVEEEKVRRLAEEVKRALDRIKELIKRNRDELKRANEESKRLVERLREEAERILRDLRRKLD

SEQ ID NO: 5137 - protein, 186 aa, Artificial Sequence; identical to SEQ ID NO: 5136
  Synthetic

SEQ ID NO: 5138 - protein, 186 aa, Artificial Sequence
  Synthetic
SEVEKIKKDLEKVADEVRRLHKESLDRLKKVVREVEERLKRLHEESEKVAKDVRRKVEEKKDDKDRLKKILDELREIIERSIRAFKKILDELEEIIKRLREENEEINRRLKEIAEEVEDRLRKRGVDEREVKKIKDDLDRVNEESRRLVEKLERDVTRVRKKIKEELKKNADRLKEVEEDIKRRAK

SEQ ID NO: 5139 - protein, 186 aa, Artificial Sequence; identical to SEQ ID NO: 5138
  Synthetic

SEQ ID NO: 5140 - protein, 186 aa, Artificial Sequence
  Synthetic
SEVEELERELKEVVDRVRKLHRESLERNREVVRKVDEDIKKLHRESEEVAKEVEKLIEEVKDDTDKLRKILERLREIAERSRRTLTEILKRLEKISRELLEENKKINEELKRILEDLIRRLRERGVDERDLKRLEDEARKANKESRDLVREIERHSREAMKRIEEELRRNKERLERVLKKIEDKAR

SEQ ID NO: 5141 - protein, 186 aa, Artificial Sequence; identical to SEQ ID NO: 5140
  Synthetic

SEQ ID NO: 5142 - protein, 186 aa, Artificial Sequence
  Synthetic
SEVEKLLEDLKRVAREVEKLLEDLHRRTDEVMKRNEDDIRRLHEESDRVVKRVKDEIEKKKDDTDRLREILRRLEEIAKKSDEDLRRSLDEHDKIVKKSEEDMERILRELRKIIEDLERRLRERGVDERDLKRLKDEAKRIEDKIRELLERNREKARRTKEKIKKLVERNRRELEKVLDEIRRRIK

SEQ ID NO: 5143 - protein, 186 aa, Artificial Sequence; identical to SEQ ID NO: 5142
  Synthetic

SEQ ID NO: 5144 - protein, 178 aa, Artificial Sequence
  Synthetic
KEVEDVEKRNREVHRRIEKLIEENERRLKEVRDRIRKLVREIEDLNRRVREEVDRRNAPEEVRKELEEVTERSRRMARDIERLLDKATKESRDNVREVKADLKRVTEETRRLAEELKDVEEVLRDLLRRNEEVVKRVEDNLRRDTERLEKVAKDVEKKLREVLKRNKEMVDEVRKKTK

SEQ ID NO: 5145 - protein, 178 aa, Artificial Sequence; identical to SEQ ID NO: 5144
  Synthetic

SEQ ID NO: 5146 - protein, 175 aa, Artificial Sequence
  Synthetic
SEEEDVLRKLEKIVTDLRETLKRMHEDSERIVEESRKHARKVHEDSKKIVRELKKVLDEKRVDRREVERTVRDVIRRSEEVFERNRDLLRRLKEKSEEIARRIEKKLKEVKDRLEEARVPEEVRRRVEEIRREIERELKRNRERLEEVERENRKLLRENKEELDKVEKDLRDTAE

SEQ ID NO: 5147 - protein, 175 aa, Artificial Sequence; identical to SEQ ID NO: 5146
  Synthetic

SEQ ID NO: 5148 - protein, 180 aa, Artificial Sequence
  Synthetic
DDIKRLEDEVRKAAEENKDEVRKNREELKRIKDEIDKLVKDVEETIRRAEDEIRKRVKDKETLERMEKLLREVKKEVDEVVKELDELLRRLEEKSRRVVEENKKLLDTIRKRLKDVSNTEDKRVMEKVLRELKEIVDRSRDHLRRVHEDSKRIADELRRKIEELLKRIKKVVDELREAIR

SEQ ID NO: 5149 - protein, 180 aa, Artificial Sequence; identical to SEQ ID NO: 5148
  Synthetic

SEQ ID NO: 5150 - protein, 184 aa, Artificial Sequence
  Synthetic
DDLRRIEKELKRLADRARKINRESDERIKKLEEEIRRINEDSLRRDRDLARRLREMLKRVRSREVEERLKRITDRSRELNEENERRNRRVEERLEKLLKENEDENEKVIRDLERLVEELIRKEGDTREVKKLKEDLDRVKRELEKLNEEIRDRIRRVKEELKRLNDRSKKHTKEVEEEVERRKK

SEQ ID NO: 5151 - protein, 184 aa, Artificial Sequence; identical to SEQ ID NO: 5150
  Synthetic

SEQ ID NO: 5152 - protein, 184 aa, Artificial Sequence
  Synthetic
SEAEDILRRIKRLADENRRILKEILDRIKELADRVRKINEDSLRTLRKLAEELRRVAEKVRSEEVVRRLERIIRELRRLLEENKRRNEEIIRELRRLLDELRRRSEDTVRKIRKLLEDLIRKKGRSEKAERLEREVRKIEKESREMLKRIEDEIRKVEEDLRRLNEELERDVRRVEEEVKRAAD

SEQ ID NO: 5153 - protein, 184 aa, Artificial Sequence; identical to SEQ ID NO: 5152
  Synthetic

SEQ ID NO: 5154 - protein, 184 aa, Artificial Sequence
  Synthetic
DELDDIRRRLEKLEEEAERINRESEKRDRELARRIREINKRSKEEDRRLAKEVDEILRRVRSEEVKDLLRRITEESKKLNEENSRRNEEVDKESKRLNEENEKTNRDMIRKLRELLKDLIDKKGRTEAVEELRKKIEEVEKKLRRLNEKSKKHTKDVRDELRRLNEDSKRHTDEVKDRLEEATR

SEQ ID NO: 5155 - protein, 184 aa, Artificial Sequence; identical to SEQ ID NO: 5154
  Synthetic

SEQ ID NO: 5156 - protein, 184 aa, Artificial Sequence
  Synthetic
DELRKIREDLKRLATEAREINKRSDEDIKRLTDDVRRINKESLERLKKLADDLRDALRKVRSKDVKRTLEEIIRRARKLVEDDKRTNRKIIEELKELLDRNRRINERIARELERLLEDLIRKKGRTEAVKELEEEIRKVKEELKKLNKEIEDKIRDVERELRETNKRLEDEVRRVEEEVRRATK

SEQ ID NO: 5157 - protein, 184 aa, Artificial Sequence; identical to SEQ ID NO: 5156
  Synthetic

SEQ ID NO: 5158 - protein, 184 aa, Artificial Sequence
  Synthetic
DDAERILDEIRRLTEELREINKESLKKVERLAERIREINKDSLRRDKELADRLRRMLEEVRGEEVKEILRRVDKESEDLNRRNSEINKRVTDEIRKLVEDNSRRNREAEKELKKLMDDLIRKTGRTEKVERIERTIRKVARELEKLNEDIRKRVDEVEEELKKLNKESEDHTRRVREEVRRRTQ

SEQ ID NO: 5159 - protein, 184 aa, Artificial Sequence; identical to SEQ ID NO: 5158
  Synthetic

SEQ ID NO: 5160 - protein, 184 aa, Artificial Sequence
  Synthetic
SELETVEERLKRLEEEIRRLLEKVDRDLDRLADEVRKKNKRSHERNKEIEDRIDKLLKDGKDDETVRRVAEELRRTLRRNEEENRRVAEELERILRELRKVVEDIKKRLEDLLKELKDRVDKEELKKMLRKLEERVKEVTRELEDLLKKAEEKVRRVKDELRRSNKKDEDRLREVEEKLREDSR

SEQ ID NO: 5161 - protein, 184 aa, Artificial Sequence; identical to SEQ ID NO: 5160
  Synthetic

SEQ ID NO: 5162 - protein, 184 aa, Artificial Sequence
  Synthetic
SELEEVRKRAKDIADEDRELNRRVHEENKRLADDVRRKNEKSHRDNERIATELRELLRDGKDDRVVRRVEEELKRTLEKNKRDNDRVVEDLKRTLDRLKELNDRSVEKLERLLKELEDRVDKEELKKLLDELRKRVEDVKEESKRSLDRDRRELERVKKELDDSNDEDRKRIEEVIKEVRDRSK

SEQ ID NO: 5163 - protein, 184 aa, Artificial Sequence; identical to SEQ ID NO: 5162
  Synthetic

SEQ ID NO: 5164 - protein, 178 aa, Artificial Sequence
  Synthetic
DEEREVKERLKELIERLRRLHEESLRELKRIADELRRLHEESHKRNEDIARELERLLAEVKDKKVVEELVKRIIERLEKSLEDDRDLSRRAIEELKRLLDEDRKLSEDAKKRLKDLLDTVPRIDELERRVRKVEEESKKLHEEIRKRIEEIERESRKLHEDDRRRIEEVLKRIKDAVR

SEQ ID NO: 5165 - protein, 178 aa, Artificial Sequence; identical to SEQ ID NO: 5164
  Synthetic

SEQ ID NO: 5166 - protein, 178 aa, Artificial Sequence
  Synthetic
SDEDRLREEAKKVADELRKLHEESHKRNKEIADELRKLHKKSHDDNKRIADEITELLKRTKDKRTLEKLIEEARKKLEESLRRDAEISKKIAEDLERSLREDAKISEDIRRRLKKLLEEVDKIEELRDRLRRVEEESRELHKRDREEVERIRRESEKLHREDREDVKRIEKKLRDDAR

SEQ ID NO: 5167 - protein, 178 aa, Artificial Sequence; identical to SEQ ID NO: 5166
  Synthetic

SEQ ID NO: 5168 - protein, 183 aa, Artificial Sequence
  Synthetic
DEAEKVLEELRRRAEKVLREVKKVLEDHKRLADELRKELKRVSDENRDSLRRLLEEIDRNKELKESVKKILDENRESSERLEDTVRKILKESKDRTKELEDKLETILEDLRRKLEDVERRGVLDEDLLRRLRELLDEIRKELRDLIRKLRELNDRVERDLRRIIRENRELVRRAEKELEDRTR

SEQ ID NO: 5169 - protein, 183 aa, Artificial Sequence; identical to SEQ ID NO: 5168
  Synthetic

SEQ ID NO: 5170 - protein, 183 aa, Artificial Sequence
  Synthetic
DEAEEVLERIKDLARKNEEKNRRVLEEHEKLIRESEERDEKSSRDNKRSVDEIRDIIRRKRESKDELKKILDDNKRSSEENMRRVKRINDESKKRTDELEEESRRVLEKVEKEVEDLARSGLVEEEKIKRIRDELARWAEKIKKTIDELRKLNKEAHDRNRKTIKENEDLVREAKEDLERKTT

SEQ ID NO: 5171 - protein, 183 aa, Artificial Sequence; identical to SEQ ID NO: 5170
  Synthetic

SEQ ID NO: 5172 - protein, 185 aa, Artificial Sequence
  Synthetic
SEAEEVLKEIKKLADELRKKNRESVEKVRESSKRLKDEIRKVLEDIKRLAEKLREILREMKDKDTIRKTIEDITEKLKELLDRLRERIEKAKRDHERLVERNRRENDKIRKDLERLLEELRKRGVDEKLLRELEKLIRDIKRELDRSDEKLEELVRRSAKELDDLLDTLREIIERIKRDLDEKLR

SEQ ID NO: 5173 - protein, 185 aa, Artificial Sequence; identical to SEQ ID NO: 5172
  Synthetic

SEQ ID NO: 5174 - protein, 185 aa, Artificial Sequence
  Synthetic
REAEEVLKRIKELADEIRKRNRESLERIRKSSEDLKRENEDSIRRVRELIDTLRRRLEKEKDKKTIEEIVKEIDKRLKELLDRNRRRNEEAVKEHEELLKENRKENEEILRDAERLLRDLERKGVPKELVDRIRDLIRRIKDELKESDDRIKELIDKSKEDLDKSDEDLKREIDKAREELAKAIK

SEQ ID NO: 5175 - protein, 185 aa, Artificial Sequence; identical to SEQ ID NO: 5174
  Synthetic

SEQ ID NO: 5176 - protein, 182 aa, Artificial Sequence
  Synthetic
DEVEELLKEVEELAREIVERLEKNLRDTKKLIDEIEEYARRNEERTRKLIEEAERLARRGDKSDDLKREVEKLLKESEDNVERLIRELEKLLEESRRNVKRIIDELRKRLDDVRRRLEERRADEELERRLRRLLEELERRLKRLEDEHRRLVEEVRDKLRKIEETHREIVERVRRTLDEEKR

SEQ ID NO: 5177 - protein, 182 aa, Artificial Sequence; identical to SEQ ID NO: 5176
  Synthetic

SEQ ID NO: 5178 - protein, 182 aa, Artificial Sequence
  Synthetic
DDARRLLEEVKELLERSKRHLTKNLEDTRRLIKELLDYARRNLEDTRRLIEEVLDLLKRGRRSDELMRRLERLLRESEENVKRLIKALRDLLKESKENVDRNIKRSEELLRRVEELADRRRLPEEVKETLKRLLDEIRRENEKVARDHKKLVDDVERELEDIERRHKELVDRARKVAEDEKK

SEQ ID NO: 5179 - protein, 182 aa, Artificial Sequence; identical to SEQ ID NO: 5178
  Synthetic

SEQ ID NO: 5180 - protein, 182 aa, Artificial Sequence
  Synthetic
SDAERILDEVRKLVEDSKRHLDENLKRTAELSKRSKEYAEENLDRTRRLAKEAADIARRGDKADEVLTRLEELLERSERNVRRLIEENEELLRESEENVRRNIKESEELLRKVERLIDESRLPEKVKEDLKRLLDEIRKENKRAEDAHRDLARRSREELEKAERKHKELVDRIRKALEEIKK

SEQ ID NO: 5181 - protein, 182 aa, Artificial Sequence; identical to SEQ ID NO: 5180
  Synthetic

SEQ ID NO: 5182 - protein, 182 aa, Artificial Sequence
  Synthetic
DEVRKLLKDVRELAREIERRLEENLRRSEELLKRIEDYLRKNLEDTRRLIEEVKELADRGDKVDKLLEDVERLLRESEENVERLIKELEKLLRDSEESVDRIIRELEDLLRKVEKRADDNNLEEEFKDRLRRLMKRIKERLEDVKRRHKELVKKARKSLEEVKRRHRKLVEDVRRTLEEEKR

SEQ ID NO: 5183 - protein, 182 aa, Artificial Sequence; identical to SEQ ID NO: 5182
  Synthetic

SEQ ID NO: 5184 - protein, 182 aa, Artificial Sequence
  Synthetic
DEARKILEDLKRLAEESIRHLEENLRRSEKLVEDVERYAEENLERTKKLVRDVDEIIRRGDNVDKVAKELRKLLKESEDNVKRLIEELERLLRESEESVDRNITKSEEILRRVEELVDKNRLPEEVKKRLEDLAREIRKANEDVKRRHKKLVDDVRKRLKEIEKKHRDLVRKIEEKLRDARK

SEQ ID NO: 5185 - protein, 182 aa, Artificial Sequence; identical to SEQ ID NO: 5184
  Synthetic

SEQ ID NO: 5186 - protein, 182 aa, Artificial Sequence
  Synthetic
SEAEELLKTVRDLVEKSRKHLKENLKRSEELSRKSKEYADKNLERTKRLVKTVADILDRGDRTDEVIKELRRLLKESLDNVRRLIETNRRLLEESKKSVKRNIDESERLLREAEEKLRRDRVDKKLEDELRRLVEEAKRENDEVRREHKRLVEDSERKLEKIERDHRELVDRVEKEMREKKR

SEQ ID NO: 5187 - protein, 182 aa, Artificial Sequence; identical to SEQ ID NO: 5186
  Synthetic

SEQ ID NO: 5188 - protein, 182 aa, Artificial Sequence
  Synthetic
SDVERILEDLDRVVKESKRHLEENLRRSEKLTREVEEELKRNLKESEELVKRVEDIARNGDRVDEVLERLKELLKRSERTVEKLIDDLRRLLDESRESVDKNIKESEEILRRVEEDLERRNASEDAKRRLRELVEKVKEDNKKVKEEHDDLVRKVERRLEEIRKRHEELVRRIRRRLEEEKR

SEQ ID NO: 5189 - protein, 182 aa, Artificial Sequence; identical to SEQ ID NO: 5188
  Synthetic

SEQ ID NO: 5190 - protein, 182 aa, Artificial Sequence
  Synthetic
SDVEELLRRLEELLKESEKHLTENLRRSEKLVRDSKRHLDENLKRSKDLAREVVRLAEKGDRVDRLKEDVERRLRKSEETVRRNIEESERLLRESEKSVKDNIRESEKLLRDVEKKLDDRNIDRKVKERARELVERIKRRNEKVERDHEELAREVRERNKEVEKRHRDLVEELRRRLDERKR

SEQ ID NO: 5191 - protein, 182 aa, Artificial Sequence; identical to SEQ ID NO: 5190
  Synthetic

SEQ ID NO: 5192 - protein, 182 aa, Artificial Sequence
  Synthetic
SEAEELLERVKKLTDESLRYLEENLDRLRKLVKESEDHLKDNLRKSEKRVREVIDLARRGDTTDELTERVEELLKRSEETVRDNIRKSERLLRESKENVERLIRDNERLLREVDEELKRRNLDKDMEDKLRRLVEESRRALEEVLKRHEDLVEEVRKSNDKVRKEHEELVKRVRDALREIKR

SEQ ID NO: 5193 - protein, 182 aa, Artificial Sequence; identical to SEQ ID NO: 5192
  Synthetic

SEQ ID NO: 5194 - protein, 181 aa, Artificial Sequence
  Synthetic
SVEERLEKLLKEAEERLRESEDRTRKLVEEVRRELEKLKKRSKELADRVREELRKFPKSEDLDRILKELEEVVKRVEDTHEESRRRIEDVVRKVEKKHEESRRELKRVADEVRKRLEEKKTDEEELEKILDTLRRIAEKLVRKNEDILRRLKEIVKKVIRENEEILRRLEEIAKELAKRLE

SEQ ID NO: 5195 - protein, 181 aa, Artificial Sequence; identical to SEQ ID NO: 5194
  Synthetic

SEQ ID NO: 5196 - protein, 181 aa, Artificial Sequence
  Synthetic
SLDEEAKRVVEEVRKRLRESKERSREIVERARRELERLKEESKRLADRIREEVKKFRDDEELERILRELEEVLKDVERKHRESKKEIEDVVERIKEEHEKSERELEEVIKRIDEALERNKDDTELVKRLLDDLRRIIRELEEKNRALNETLRKIVEEAIKKNREILEELREEVDRVRKRLK

SEQ ID NO: 5197 - protein, 181 aa, Artificial Sequence; identical to SEQ ID NO: 5196
  Synthetic

SEQ ID NO: 5198 - protein, 175 aa, Artificial Sequence
  Synthetic
SEVEKVLREAREILKKNKRENEEVHKKSKEIAERNREKNEKVHRDSRKIIEELKELADRGKDARELDEAVKRLADENRRVNEDSERDIKRLAEENRRVNDESRKDIERLVRKLEKDGVDEDEARKLVKEVRETLEDSARRDEKLIEDLKRTLDESKKEDDKLIEELERRLREAER

SEQ ID NO: 5199 - protein, 175 aa, Artificial Sequence; identical to SEQ ID NO: 5198
  Synthetic

SEQ ID NO: 5200 - protein, 175 aa, Artificial Sequence
  Synthetic
SEVEKVLREAEEIAKKNEEDNRRVNDRSEKIIEENERRNRKVHKESEDIVRDLERLAAEGKDARDLERKARELVKRNKEVNDTSRRDLERLVKENRDVNKESREDIERLVKELEKAGVDEEEVRKLVEKLERLLEKSKRDDEESIKKARELLRRSEEADKKLIREAEEAIRTRKK

SEQ ID NO: 5201 - protein, 175 aa, Artificial Sequence; identical to SEQ ID NO: 5200
  Synthetic

SEQ ID NO: 5202 - protein, 186 aa, Artificial Sequence
  Synthetic
SRLEELLKKAKKLVEDVEDTNRKMLEKLRKLADDLRRINKRVLDELERLARELEDIARKIRDKDTLKDILRRMEDELRRLLKKLEEDNRRIIEELRRLLKEIHDTNREVLERLKELLRRVKEEVKEAEEVLRELKKLLDEAKKKLEEIDKRLEDELRKIEDDLRRSNERVRRLLEEVRRRIKEETD

SEQ ID NO: 5203 - protein, 186 aa, Artificial Sequence; identical to SEQ ID NO: 5202
  Synthetic

SEQ ID NO: 5204 - protein, 186 aa, Artificial Sequence
  Synthetic
DELEEMLKRLEKLARDLDRINKEVLRRVEEEVRKLEEENEEVLRTLRRLAEEVERILDEIEDKKTLEKIIRDIEEELRRLLRTIHERNKKALDELRELLERLRRTNEEIKKTLRKLIEDIREEVKEAKEVLDKLEKLLEDIARELEKSNRRLEELLKEVERRLREMDERLRKELEEVKRRLEEKRR

SEQ ID NO: 5205 - protein, 186 aa, Artificial Sequence; identical to SEQ ID NO: 5204
  Synthetic

SEQ ID NO: 5206 - protein, 186 aa, Artificial Sequence
  Synthetic
SRVEKVLEELKELMKELDDSNRRVLEELERLVRENTRRNEEVLRRVRELAERLKDELDKIKDKDTLDKRLKEIEKELRKLVEDLRRLNEETIKTLEKLLREVREENERVIEELKRLLRELKEEVKEAEELLRRAKELLKRIKERLEESDRRLKRLLDEARKRSEDIIRALEKLLRDVKRELEEKLR

SEQ ID NO: 5207 - protein, 186 aa, Artificial Sequence; identical to SEQ ID NO: 5206
  Synthetic

SEQ ID NO: 5208 - protein, 186 aa, Artificial Sequence
  Synthetic
KDAERLFEDLRRLVDENREKNEKVLREIEERVERLERENEKVLRDLEDLIRRVREEIDRTKDKETLRRIIEEILRRLAELVKTLRERNKRVLEELEKLLRKVRELNKETIRRLEELLERMRERVKEAEEMLRELKKLLDRAREESRRIIEELERTLEKVKERLDRTDKEIEELLKRAEEELREKER

SEQ ID NO: 5209 - protein, 186 aa, Artificial Sequence; identical to SEQ ID NO: 5208
  Synthetic

SEQ ID NO: 5210 - protein, 186 aa, Artificial Sequence
  Synthetic
DDLERLLKEVKERIDEVKRRNEEVLKRLRELVKRNKEKNDRVLREAEKLMKKLRDIVRKIKDKDTLRRILEEIKKRLKELLDTVRELNKRTIEELEKLLRDLDRENKRIREELEKLLRDIKEKVKEAEEVLRRLRELLRTAERELEESNRRAEELLKDARRKSEEIIRRLERLLEEVDRDIKRALK

SEQ ID NO: 5211 - protein, 186 aa, Artificial Sequence; identical to SEQ ID NO: 5210
  Synthetic

SEQ ID NO: 5212 - protein, 185 aa, Artificial Sequence
  Synthetic
DDVRELLRTLRKISEDTLRRVEEINRKLERLSRETLKRVEDINRKVKELMEEVLKELDRIKDKKTLKDVIREAKKRLDETLERLERVIRESEKRARDTLRELEKVIEDSRKTVEELKKELERRGVEEDALRELKRLVDDNETKLRRLRDTHRELLERNRTELEKLKRTHKKLVDEAEEELRKKDK

SEQ ID NO: 5213 - protein, 185 aa, Artificial Sequence; identical to SEQ ID NO: 5212
  Synthetic

SEQ ID NO: 5214 - protein, 185 aa, Artificial Sequence
  Synthetic
SDVERLLEKLRDLSRRTVRELERINEEVREIIKTLKKELDRTNKELRDIIEEIKKELDKIKDKRTLEKIVDRLDKELKRSLEEDRKVVEDAKRLLDDTLRKLEEVIRRSKELLERILRELERRGVDEKLLDELRRLLEENEKTLEDVRRTHEELVKRAKRELEKNIEEHERLVRDVKEKLERKIR

SEQ ID NO: 5215 - protein, 185 aa, Artificial Sequence; identical to SEQ ID NO: 5214
  Synthetic

SEQ ID NO: 5216 - protein, 185 aa, Artificial Sequence
  Synthetic
SDAEELLKEAREVSKRTKDTLDEINKDVKRISEETKKRLKKTNEEIKEIADRLRKELERIKDKKTLEDVVREVERRLEDSLRRDRKIVEESRRRLKETLDRLEKVIRDSERRLKEILEELERRGVSEDILRELKKLVDDNRKTLKEVLETHEELLRDNSRKLERNVERHAKLVRDIKEELKETTR

SEQ ID NO: 5217 - protein, 185 aa, Artificial Sequence; identical to SEQ ID NO: 5216
  Synthetic

SEQ ID NO: 5218 - protein, 185 aa, Artificial Sequence
  Synthetic
SDAERLLKEVEEIARRLEKKMRETNKEVDRIVKEIEDDARRLNKELREIAERIKDELDKIKDKDTLRELVRRIKKELDRTLKELEDVIKRLKDLLKETLDRDKELVDRAARRLEKILEDLERRGVDEKVLKELKRRLEEIKKKLDDNLRRHKKKVDDVARELEKIVKTHRDLVEEIRRRLRKKEE

SEQ ID NO: 5219 - protein, 185 aa, Artificial Sequence; identical to SEQ ID NO: 5218
  Synthetic

SEQ ID NO: 5220 - protein, 185 aa, Artificial Sequence
  Synthetic
SDAERLLEELKRISEETKRRLAETNKKVKKIMKELTETLTETNKKLKKIIDDLRDRIDKIKDKETLRRVLDEADKRLRKSLREDEELVRRAEKRLRDTLREDERIVRESEKRLRELLERLERRGVEERVLKELRRLLERNREELRRNKEKHKELVERIKRRLEENKERHKRLVDEARKELKEKEK

SEQ ID NO: 5221 - protein, 185 aa, Artificial Sequence; identical to SEQ ID NO: 5220
  Synthetic

SEQ ID NO: 5222 - protein, 185 aa, Artificial Sequence
  Synthetic
KDAEELLKTLERLSRETKRRLERTNRELKEISKETEKDLERTNRKLKEIIDRLREELDKIKDKRTLEKLMTEAKKTLKKSLEEDRDIVRKSDEKARRTLEEDKRIVEESEKRVKKLLDDLRRRGVSEEMLRELRRLVEENKKRLRENIRRHERLLEENRRKLEKNIRDHERRLEKADKDLEDKRR

SEQ ID NO: 5223 - protein, 185 aa, Artificial Sequence; identical to SEQ ID NO: 5222
  Synthetic

SEQ ID NO: 5224 - protein, 185 aa, Artificial Sequence
  Synthetic
KDAERLLEEARRIVKEADDILRELDEEVRRIVEKIKRDAERTNEEIREIAKRIRDEIERIKDEKALEKLLEDLRRKLEESLRKDERLVKEAARLLKETLEDLERVIKELADLLERILREIEKRGVSEDVLRELRKLVEDVKRRLKEVADHHRELVRRAEEELKKNRDEHERLVREIEKELRKARE

SEQ ID NO: 5225 - protein, 185 aa, Artificial Sequence; identical to SEQ ID NO: 5224
  Synthetic

SEQ ID NO: 5226 - protein, 185 aa, Artificial Sequence
  Synthetic
DEAERLLERVKELMERLTEEARRTNETLREIVERAERRLRELDERVRKIAEEIRRRLEKIRDKDTLRKLVEEIEKLLRDSLRELEKVLKELKDLLDRTLREDERLVREAEETLKELLRELEERGVDEKVLTKLRKLLEDIRRRLEKNLKDHEELVRRVEEKLKRVREHHEELVRRIKEELDKAEK

SEQ ID NO: 5227 - protein, 185 aa, Artificial Sequence; identical to SEQ ID NO: 5226
  Synthetic

SEQ ID NO: 5228 - protein, 187 aa, Artificial Sequence
  Synthetic
RDAEELLRTMEEITRRVKKELEDLLRTDEELSERVKEEARKLDEKLKELARDVTEKARDIKKGPEEKLRRIVEKLRRELEESRRELEKLIRESKKLNEDTKREIDKIIDDLRRLIERIERELDERNVDDEVKKELKRLIEEVRDRLKKVKDTLEKLIKENEDELRKVEEHHEKLLREIEETLERMRK

SEQ ID NO: 5229 - protein, 187 aa, Artificial Sequence; identical to SEQ ID NO: 5228
  Synthetic

SEQ ID NO: 5230 - protein, 187 aa, Artificial Sequence
  Synthetic
EEAERLLKKAEDLSRDTARKAKELLEEDEKLVRDAEKKARELDRELEKLAEEAARAATRAKKDDKRKLDKIAKEAKELADRSLERLRKLAEDLERLNEETLRRLEELIKENKERADRALEELEKDNAPEEARKRAEDLIRESEKRARDAKRRAKELIDRSRKSAKEAKEHHEKLIKEARDELEKAKK

SEQ ID NO: 5231 - protein, 187 aa, Artificial Sequence; identical to SEQ ID NO: 5230
  Synthetic

SEQ ID NO: 5232 - protein, 187 aa, Artificial Sequence
  Synthetic
DEAEKLLRELEKLSRETEKRVREIIKKDRDLSEEVRRRAERLDDELRKLVEDAERELRRIKSDDETKLDEIVRELERLLEESLRRLEELVKELDRLNKETLEELETLVRENRKLAKEVKDRLDEQNVDDKVRKRLEELIRESDERLKELTKELRKLIEDNRRELEKIIRHHKRRVDEVRKRMTELRR

SEQ ID NO: 5233 - protein, 187 aa, Artificial Sequence; identical to SEQ ID NO: 5232
  Synthetic

SEQ ID NO: 5234 - protein, 182 aa, Artificial Sequence
  Synthetic
SEVEDLLRRLEEIVKRNDDELRADEERTRKIIKENKETLDRLLEDLKRILRELEKIVRDKGNDRDVVRELRKIVREAEEKLEEVTRRSRESLKDLHRRNRESIRRSEESVEKIKRDVRRLELSEEAKRRAEEKLKRLEERSREIERRLKKLNEELKRISDEVEKTAREILERIKRRIEEEER

SEQ ID NO: 5235 - protein, 182 aa, Artificial Sequence; identical to SEQ ID NO: 5234
  Synthetic

SEQ ID NO: 5236 - protein, 182 aa, Artificial Sequence
  Synthetic
SRVEKLLDDVRKILEDNERRLRDDMRRTEEIIRKNKRDLERLKERHEEIVKRLDEIIKKEGTDERVVTELRELLRRVHEELKEVIRRSEKSLEELHRTNERSIRKSEKSLEDLRETLERLDLSEDARREAERLLKEVEDTSREAEKRLRELNEELERRSRKVEEELKKSDEELKRRIEEAER

SEQ ID NO: 5237 - protein, 182 aa, Artificial Sequence; identical to SEQ ID NO: 5236
  Synthetic

SEQ ID NO: 5238 - protein, 183 aa, Artificial Sequence
  Synthetic
SIEDRLRKIVRDLEKVLRDLKREHDDVVRELEKRLRDIEERHRELVEELKKRIEEIERERDTEDVRRLKEEAERLLEEARRNLKRLEEEVRRLLKRSAETVKELVERVKKMLDEVKTKLRKIDKEKDLEELLKELEDIIREVRKRAKENLDRTRKLIKDIEDYLKKNLDRVRKLIEDITRALK

SEQ ID NO: 5239 - protein, 183 aa, Artificial Sequence; identical to SEQ ID NO: 5238
  Synthetic

SEQ ID NO: 5240 - protein, 183 aa, Artificial Sequence
  Synthetic
SIEERLREVERRLREDLKRLEKAHRDIVRDIERTLRKVEEDHRRVKEKLKRTIEDVERRRDTEDVRRLVETAKKLLEDSDRTVERLRRELERILDEVRRNVEKLKRDVKKRLDEVRRRLEDIRDEKELEKLLRDLKRIIDEVRKYATRNLEELKRVLKRVKEEAEKNLERTERLIEEIRRRAE

SEQ ID NO: 5241 - protein, 183 aa, Artificial Sequence; identical to SEQ ID NO: 5240
  Synthetic

SEQ ID NO: 5242 - protein, 183 aa, Artificial Sequence
  Synthetic
SIEETLREIVKDLERVLEEIERRHREIKKELEDILRELKKRHEDVVREAEKELRDAKRRRDTEDVRRLIKTLEDLLRESEENVKKLREEVKKTLKESEDNVRRLKDEVRKLLKEVEDKLKDIDKREELKRLLDELKKLIDRVREEAKKNLDRSKKMIEDVERYARENLRRTKELIDDVKEKLR

SEQ ID NO: 5243 - protein, 183 aa, Artificial Sequence; identical to SEQ ID NO: 5242
  Synthetic

SEQ ID NO: 5244 - protein, 183 aa, Artificial Sequence
  Synthetic
KIEEEVDKVRRTLEKELKEIDERHKRIVEKLREELKEAEKRHEELVKRAKEELDDVKRREDSERVRELIKELKKLLDESRENMKKLREDVEELLRRSDKSLEDLRRKVEEDLERVRRRAEEIRDEDLLRKLLEELDRIRKEVRERLKRNLDRLKKLIDEVREYLERNLRRTKKLIDRVREDAR

SEQ ID NO: 5245 - protein, 183 aa, Artificial Sequence; identical to SEQ ID NO: 5244
  Synthetic

SEQ ID NO: 5246 - protein, 183 aa, Artificial Sequence
  Synthetic
DVEEELRELIERLKEVLDRLREESKRVIKELRDTLRELEERSRDIIRKLEETLRDVARKSTDKDKLDEVREKIDRLRRENKEVNDDLRKKIEDIEKRNRDVNRDLERKVRELEKELRDMSRNKDDEFLRRVLERAKKIVRKLEEDARRVLEETEDLIRRLREKAERVHEKTKKIIKEITEELK

SEQ ID NO: 5247 - protein, 183 aa, Artificial Sequence; identical to SEQ ID NO: 5246
  Synthetic

SEQ ID NO: 5248 - protein, 183 aa, Artificial Sequence
  Synthetic
SVEDALRKLIEELKRVLKKLEDDSRRIIEELRKVLKDLEDRSRKVIEEIKDDLRKIAEKSTDEDKLRKLEEKVRRLMRRNERVNRELKKKVEKLEKENEDVNRELKKKVDELVKELREVSRDRREEVAKRLLDKARDIVRTLKEEAERVHERSRRIIEELRREAEEVLEETRDILRRLREEAK

SEQ ID NO: 5249 - protein, 183 aa, Artificial Sequence; identical to SEQ ID NO: 5248
  Synthetic

SEQ ID NO: 5250 - protein, 183 aa, Artificial Sequence
  Synthetic
SELEKVLEKLKDLLRKVREKNERVLREVEERTRRVKRDLERVLKEAKDILRKAKKLADDGKVSERSLREILKKLKERLDRVIKKWEDISRKVSEDLEEVIKDDKRTVDEAKEELKRVLDKVDKKEEIARRIKKVLDDWKRVSEESKRRIEELLKRDKEELEKIKRAAKKVIDELKRLLEEAER

SEQ ID NO: 5251 - protein, 183 aa, Artificial Sequence; identical to SEQ ID NO: 5250
  Synthetic

SEQ ID NO: 5252 - protein, 185 aa, Artificial Sequence
  Synthetic
SRAEEILKRLEELIKRLKEENDRVLEENKRLIEELEKKNRDALRRIEELLKELKDIARRIEDKDTLRKILEDVRRTIEELVKEIEKENERVRRESKKLSEELRKKNKDVNEEAKKLVDDLRRDEGDEDLEEKLRRLLDELRKISEEVEERSERSNKELEDVSEDSKRKLRKILEDLRDLLRRTEK

SEQ ID NO: 5253 - protein, 185 aa, Artificial Sequence; identical to SEQ ID NO: 5252
  Synthetic

SEQ ID NO: 5254 - protein, 185 aa, Artificial Sequence
  Synthetic
SRAERILEEMERLIEEVRKENERVLRENRRLIKELKEENERILRELKRLIKEAKEIVERIRDKDTLRKILREVLKRLKELLDELKETNERVLRESEELSKDLRRKNEEALRRLRKLVKDLRDDEGDEEVDERLERLLKTAEDDSRRSDKRSEDSNRELRKVSEDSRKRLEELLKDAERKLREDEK

SEQ ID NO: 5255 - protein, 185 aa, Artificial Sequence; identical to SEQ ID NO: 5254
  Synthetic

SEQ ID NO: 5256 - protein, 185 aa, Artificial Sequence
  Synthetic
DDVDRILEELKRLVEENRKRNEDIERELEKLIKEVEDSNRTMLERMEDLIRELRDIVRRIKDKDTLDEILRRIREELRRLLEELKKENERALEELKRLLDELKRTNKRSLEELKKLLDDLRRREGDEDAERRLKELLEDAKRVSDEVLRRLTELLKKAKDVSDESRERLRRLLEDLERDLKRERT

SEQ ID NO: 5257 - protein, 185 aa, Artificial Sequence; identical to SEQ ID NO: 5256
  Synthetic

SEQ ID NO: 5258 - protein, 185 aa, Artificial Sequence
  Synthetic
SDAERLLRELERLVEENRRRNKKVLDDNERLVEKLEKSNRRALEELKELVDRLEDIARRIKDKDTLREILKRIEDELEKLLRRLEEENKEVRRESEELSKRLDDINRRSLEELDRIVKDLERREGGERVREELERLLEEAKRDSDEVRERSKKSNKKLEDVSRKSKKDLRDLLKKARDILKETER

SEQ ID NO: 5259 - protein, 185 aa, Artificial Sequence; identical to SEQ ID NO: 5258
  Synthetic

SEQ ID NO: 5260 - protein, 185 aa, Artificial Sequence
  Synthetic
SDAEEVLKELERLIREVEERNKDILRKAKELVRDNERKNREVMERLKKLIEDLKKIAKEIEDKDTLRKILEEILRRLKKLLEDAERTNEESLKELRRLLEELRKRNKTILDELRRLLRELKEREGGEEVEKRLKDLLREAEEVSRRSEERLRELLKELEDVSREVKRRLERILEELKRILDEVEK

SEQ ID NO: 5261 - protein, 185 aa, Artificial Sequence; identical to SEQ ID NO: 5260
  Synthetic

SEQ ID NO: 5262 - protein, 176 aa, Artificial Sequence
  Synthetic
DEVEELTERLKRVLEDNRRTAEEVKERTRRVIDKVRRDYEELEKRLKKILKEIEDLSRENRTDSRELEKTVREVEKELRREDKRLKDEIDRVREENEDMNKKSRDHVEEVARELEKRGIDEDTVRRLIKEAKDDNDRMEEENRRLIRELEEVSKRAHKRLRELIRRIEELLRREET

SEQ ID NO: 5263 - protein, 176 aa, Artificial Sequence; identical to SEQ ID NO: 5262
  Synthetic

SEQ ID NO: 5264 - protein, 181 aa, Artificial Sequence
  Synthetic
SAEEEVRKIKREIEKVLRESEREIERVEKEIRDVLRKSEREIERVKREVDKVLEEVRRAGIEEEKLRELEREAREVIKRLRRIVEESAKHLEKVVRELKEALKRSAEHLKKVIDDLKKALDDNGRLEDLLREVKKAIEKNEKDNRDVLREVEEKIRRDEKRNKEVLEDAKRKIEELKKRAD

SEQ ID NO: 5265 - protein, 181 aa, Artificial Sequence; identical to SEQ ID NO: 5264
  Synthetic

SEQ ID NO: 5266 - protein, 181 aa, Artificial Sequence
  Synthetic
SAEDAIREVERKAREVLKRSKEEIDKVVKKAEEILKRSKDEVKKVADEIRRILEEVRRAGADEKKLRDLARELEEAIRKLDEIVRRSEKHLRDVVRKLEEVLKKSAEDIKRVVRELREAAKRKRRLEDVLRRIEKIIRDNAEENKRVLEEAEEVLKKDEKDNRDVLEELKKILEELKRKAD

SEQ ID NO: 5267 - protein, 181 aa, Artificial Sequence; identical to SEQ ID NO: 5266
  Synthetic

SEQ ID NO: 5268 - protein, 181 aa, Artificial Sequence
  Synthetic
SVEEAVKRLADEIRKVLERSKEELERVAKEAEDVLRRSREELKKVADEVRKVLDDVRRAGLDEKKVRELAEELKELIERLKKIVEESAENIKKVIKDLRDIVKRSAEKLEKVIRELEKALRDKKPLEDALRRLKEIIDENKRENEEVLKRAREIIEENKKRNKEVLDEAKEIIDRVREKAR

SEQ ID NO: 5269 - protein, 181 aa, Artificial Sequence; identical to SEQ ID NO: 5268
  Synthetic

SEQ ID NO: 5270 - protein, 181 aa, Artificial Sequence
  Synthetic
SAEDAIRKIAEDAKKLLEDSRRELRRVVEKVKRLLEKSKEDLDRVAEEVKKVLEEADRAGLDKEKLKRLKEEIEEVIKRLKEIVERSEKKLRDVIKKLEDIVRESAKNLKEVIDKLKKLADDKKRLEDAVREVREVLKKNKEDNDRVLREAEEVLKRNEEENRKVLEEAKRIIDELKKRID

SEQ ID NO: 5271 - protein, 181 aa, Artificial Sequence; identical to SEQ ID NO: 5270
  Synthetic

SEQ ID NO: 5272 - protein, 186 aa, Artificial Sequence
  Synthetic
SVREELTRVKKRARDVLERSREEAERVAKRAEEVNRESEREIERVLEEVERILEDIREKVKEERAEEILRTLAKEVEDLKRELREVLRRSKEETEKLIKKLEEVLKRSEDDIRRLARELDEADRAKDEEAVRDVLRKVREIIRRNRKENEEVLRDVERLIRELEERNRRVLKKAKEILKRIRDKAE

SEQ ID NO: 5273 - protein, 186 aa, Artificial Sequence; identical to SEQ ID NO: 5272
  Synthetic

SEQ ID NO: 5274 - protein, 186 aa, Artificial Sequence
  Synthetic
SVEEELEKVKRKAEKLLEDSDREIKRVTKKAEKVLEDSRKAVEEVEKEVKEVLDEIRANVREEDLKRILEELTEKIKRLTDRLREVLKDSERNVRELKKELERMLEESKKDIEELVRELEEVSRVSDEKKAREVLKKVEDRIEENRRRNEEVLEKAEKIIEDNRRKNKTELDKVKEIIRRIREEAR

SEQ ID NO: 5275 - protein, 186 aa, Artificial Sequence; identical to SEQ ID NO: 5274
  Synthetic

SEQ ID NO: 5276 - protein, 184 aa, Artificial Sequence
  Synthetic
SAEDALRKLKEDSKRVNDESRREAERLKREIEKINEDSDREVEKVKKKIEELLEKVERDGVDKKDVDRLRERVEEIKRRLEEVRRDSKRLVEEMRKTLEEVLERSRKISEDIARRLDRVKDEVKDERELKRVLEEVERLIEKVKTDNKRVLDEIRKILEEIERKNRKVLKEVEDLLKTMEDEAR

SEQ ID NO: 5277 - protein, 184 aa, Artificial Sequence; identical to SEQ ID NO: 5276
  Synthetic

SEQ ID NO: 5278 - protein, 184 aa, Artificial Sequence
  Synthetic
SLEEAVREVERKAKKVNDDSREEVKKVKKESKDVNKKSEDDARRVVEEIKKILKRIAEKGVDEEILKRLEDTVRKIEKELRDVLKESRDKTKEIEERLDKVLKESEEMVDEIRKRLEEVTRRVKDERLAKKVLDEVEKIIEDIKRRNEEVLRRVREDIKRVEEENKKVLKRVKERVEEMRRRAD

SEQ ID NO: 5279 - protein, 184 aa, Artificial Sequence; identical to SEQ ID NO: 5278
  Synthetic

SEQ ID NO: 5280 - protein, 184 aa, Artificial Sequence
  Synthetic
EMEDEARKVIKKIKEVNRRSREESEKLSRKSERVNRESKRASEELREEIRRVLEEIRRKGVDEKILTDLERIIEEAERENKRVNEKSEEITRRIRERNERVNRRSEKEVEDIKRRLEEVKRRVKDRRKMKTVLDEVEKEIRRIEEENKKVLKESEDLIREVEKENREVLERTKRIIDEARKRAD

SEQ ID NO: 5281 - protein, 184 aa, Artificial Sequence; identical to SEQ ID NO: 5280
  Synthetic

SEQ ID NO: 5282 - protein, 184 aa, Artificial Sequence
  Synthetic
SVDEAVKEVEDRLRKVNEESTRESKKVVDKARDVNRKSEEASRELEDRIEKVLTDIRRKGVDEKKLKKLRDIVREAKKRNDEVNKESRDIVRELTDKNRRVNEESKRESDDLKRRLEEVSRKVKDERLAKRVLDEAKRILDEVKEKNRRVLEDSERIIKEVEDRNRRVLEETRRIIEELRKEAD

SEQ ID NO: 5283 - protein, 184 aa, Artificial Sequence; identical to SEQ ID NO: 5282
  Synthetic

SEQ ID NO: 5284 - protein, 184 aa, Artificial Sequence
  Synthetic
SVEEMVKELIRKLREVNKRSADELDRVRKRMKKLNDDSRKAVKEVREKIERLLDAARRRGVREEDLKRLKEEVDKAEEELRRVLRKSEEIVKELEKRARKVLEDSKEDSRRIEEELKEVERRVRDERLAEEVLRRVEKKIEDIRRRNEKVLRELEKILREVSEENERVLRDLERKLRKLAEDDR

SEQ ID NO: 5285 - protein, 184 aa, Artificial Sequence; identical to SEQ ID NO: 5284
  Synthetic

SEQ ID NO: 5286 - protein, 184 aa, Artificial Sequence
  Synthetic
SVEDEIRKVKDELRRVNEKSTRDSKRVRDRMETVNRESEKRARDVKKRIKEVLDKIRERGVDEEKLERLREIVERIEEELDRVLEESKKLVKDVEETNRRVNRDSERESERIMTELDKVKDDVKDKRLADDVLRKVRDEIRKIEEDNREVLRRSEDILRKIKERNKKVLDDVRRKIDKARRDAE

SEQ ID NO: 5287 - protein, 184 aa, Artificial Sequence; identical to SEQ ID NO: 5286
  Synthetic

SEQ ID NO: 5288 - protein, 177 aa, Artificial Sequence
  Synthetic
KAEEAAERIKKKLEDILKRAKEESEKILDKLREVLERSKRKHEELIRRAEEVLKDIARKGVSEEILERLRKIVEELKKKSEEDIKRVEDILRRNAELHEEVLRRVEDIVKELEDRIRKDGVDRDVLTELEKIIKELEKRAKEVLDTSRKSIEDLERRNEESLKRLTDDLKRAKEEAD

SEQ ID NO: 5289 - protein, 177 aa, Artificial Sequence; identical to SEQ ID NO: 5288
  Synthetic

SEQ ID NO: 5290 - protein, 181 aa, Artificial Sequence
  Synthetic
SEVEEVLKRLEELLRDSERKVEEMERRLKEIIDRLREEAKRVLDESKESSKRLDELAKKGIDRKDLRENHERNKDLVRRLEKLLEKVLKELEDLARKLREMLKRSNEELKRLVDRLRERRDREEADRALRDLERKHEKRVREVDDRLKKIEDELKRVVEEIRKRLEDLKEENRRIVDRTAT

SEQ ID NO: 5291 - protein, 181 aa, Artificial Sequence; identical to SEQ ID NO: 5290
  Synthetic

SEQ ID NO: 5292 - protein, 181 aa, Artificial Sequence
  Synthetic
SDVDEVLKRSEDSTRRLRERAERMLEELERLIRESKRTADEVLKRSRESSKRLDEEVRAGVDRESLKRNHEENRELAEELRRRLKESNDRLRELVRRVEEELRENHRRNEELVKELLRRRDEEEVRKELERLRRENEKVVREAKKRLEDIIRKHEKIVKEIKEALDKLLEDNKRIVDRTSK

SEQ ID NO: 5293 - protein, 181 aa, Artificial Sequence; identical to SEQ ID NO: 5292
  Synthetic

SEQ ID NO: 5294 - protein, 183 aa, Artificial Sequence
  Synthetic
DELEDVLRKAKELIKRDRDEVRRVLEELKRSTEDLRRKVRDVERRLKELIDELDDIARKIKDKETLRRLLREIEERLKRLAEELRRLLKKALEEHEKLVRDLDKKNKDSLRKLEELLRDIVRRAGRRLKELEKIKKELEDVIRETRERLKKVLDETREDIKDVDRRLRKLEEEIRRKVEEDER

SEQ ID NO: 5295 - protein, 183 aa, Artificial Sequence; identical to SEQ ID NO: 5294
  Synthetic

SEQ ID NO: 5296 - protein, 183 aa, Artificial Sequence
  Synthetic
SELEEIIERIKRLIEEDRETVKEVLERLRRLSDEDRKEVKRVLREIKELIKELEDLRRRIKDEETLRRLLEDIRRRLEELVRRLEEKNRRSHEEHKKLAEELRKKNDDSMRKIERLVEKAVEDAGRPLEELERLKEEAKRVIKRTRDELEKILRENRELIDRSRKELRDLEKELRDVVRESER

SEQ ID NO: 5297 - protein, 183 aa, Artificial Sequence; identical to SEQ ID NO: 5296
  Synthetic

SEQ ID NO: 5298 - protein, 187 aa, Artificial Sequence
  Synthetic
SVREELEKLVRELRRLLEKSKRDTDRLSEEMEELNRRAEELIRTIERRLRELLRKIRENVDKEELKRILEELEETVRRVIEKAKKVLEESKRHSDEVRRRLEEINRRIEKKIRDLERELEKVERELKTEKLVEELKRRAKKVIRELEELSRRATEEVKRVLKENEDLVREVEKDLEEILKRIKDRAD

SEQ ID NO: 5299 - protein, 187 aa, Artificial Sequence; identical to SEQ ID NO: 5298
  Synthetic

SEQ ID NO: 5300 - protein, 187 aa, Artificial Sequence
  Synthetic
SLEEELKKLEEEVRRLLEKSKEDTDRLKKEIEDLNKKAEDDVREIRKELEKLLRDIARNVDEERMRKKLEELRERVRELEEKVREVLKTSKENSKRLIEDLKRINDELEKIVRDVTRELDEVAKRLTTEELAKRLSDKFRRILEKLEEDSKRALDKAREILKRNEELLRELLEELRRILEEIERRAR

SEQ ID NO: 5301 - protein, 187 aa, Artificial Sequence; identical to SEQ ID NO: 5300
  Synthetic

SEQ ID NO: 5302 - protein, 187 aa, Artificial Sequence
  Synthetic
KAKEELDRLRKEARDLLEDSKTKTKRLVEEMDKVNEDSKRESKKLLDELEKLLRDIEKRVREEELRKTLKELEDTVRRLEEELRKIDKESEENSRRLDERLKKINKELEDEIRKLDERLKRVEDKLKDDKLVEKLREEVERILERVKELSKKAIDEVKEVIKRNRDLSKRVIERAKEILRRIEEKAR

SEQ ID NO: 5303 - protein, 187 aa, Artificial Sequence; identical to SEQ ID NO: 5302
  Synthetic

SEQ ID NO: 5304 - protein, 182 aa, Artificial Sequence
  Synthetic
SVEDELRRIEEEMKRLNEKVERDSRRVLKEVEDLNREIKKRSDDLEREIRRLLEEVKRRKSKDEEKLRRIKELVERLKEENRKMNEDSKRSTDRLREENKKVNEDSKRSSEEIKRRADDVRKRNGDIRELLKELRKILDDNRETARKVLEDSKRIIERNKREAEKLERRSRKILKDIEDEAR

SEQ ID NO: 5305 - protein, 182 aa, Artificial Sequence; identical to SEQ ID NO: 5304
  Synthetic

SEQ ID NO: 5306 - protein, 182 aa, Artificial Sequence
  Synthetic
SVEEELRRLEKRIEELVREIERRLRELKKEVEELNERIKRASDEILDRIRRLLEEVRRRKREAEKVLREIEELIRRLKRENEEVNRDSKRSTEKLERDLRRVLEELKRTVEELKKRLREVERRNGDVRDVLREVERIIRELEERARDLLRRIREIIRRNEEKLERLLRRSKEILKEIEERAK

SEQ ID NO: 5307 - protein, 182 aa, Artificial Sequence; identical to SEQ ID NO: 5306
  Synthetic

SEQ ID NO: 5308 - protein, 179 aa, Artificial Sequence
  Synthetic
STERKLEELEKEAEKDLKEVEDRLKELNDHHDKRVKEVEDRLRRANKHHRDRLEDIRRRNISEELDKKLKDTLRELKRTTDRLRRILEKSKRDLERTTERLKRILDKIRRELKELSDKVKDRDTDEVLKRLKDLIKELRDEVRKVLTEHREIDKRVEEEVKRVLDEHREIDKRLDEETK

SEQ ID NO: 5309 - protein, 179 aa, Artificial Sequence; identical to SEQ ID NO: 5308
  Synthetic

SEQ ID NO: 5310 - protein, 179 aa, Artificial Sequence
  Synthetic
SSKEKIERLREKLEDLVRRVRKRLRELNEHHKELVKRIEDTLRELLRHHDELLKEAERRNIDKKLLDRLRETKERLKRLAEELRKILKESLDELRRTTEELERILEEILRRLEDLIRKMDERDTEDVLRRIEELIERLKREVDRVEREHERIDEEVRKRAEDIERRARDIDREVKETTR

SEQ ID NO: 5311 - protein, 179 aa, Artificial Sequence; identical to SEQ ID NO: 5310
  Synthetic

SEQ ID NO: 5312 - protein, 179 aa, Artificial Sequence
  Synthetic
SVRETLERMLRHHAELVERVRRELRKLNKHHRDEVKRVEERLDELRKHHEELLRRAEKDNVSEDLLREAERTKRELEKLVRDLREILKRSLETLEETTRRLEKRLDESLEELKKLIKDVDERDAKKVVEDLRRINERVKDEVRRALREHERIDKEVREIVEEIERRAEKIDEELKRTID

SEQ ID NO: 5313 - protein, 179 aa, Artificial Sequence; identical to SEQ ID NO: 5312
  Synthetic

SEQ ID NO: 5314 - protein, 179 aa, Artificial Sequence
  Synthetic
SVEEALTEIKKRLDKKVEDIERELKKLLDHHKELVDDVRRKLEELNRHHDRLLDEIRKDNSSEELEEKLKKTKDDLRRTTEELERRLEKSLDRLRKLVETLRRILERIKKELKELIDRVKDRDKDEVLKRLEDLIRELDRRVKEIEKRAEEIDRELEDRVRKVLDEHRKIDERAARETD

SEQ ID NO: 5315 - protein, 179 aa, Artificial Sequence; identical to SEQ ID NO: 5314
  Synthetic

SEQ ID NO: 5316 - protein, 179 aa, Artificial Sequence
  Synthetic
ETKERLDEILKHHEEEVKKVRKRLDELLRHHEELVKEVDKRLKEMNDHHRRLLDEADKDNIDKKLKDKLDETRDELRRTTERVKKRLKESLETLRKLVEDLRRELDKSREELKRLIDEVKDRDKDDVLRRLEDINRRLEERVRKAERRLEEIDEKAERITEKVKREHEDIDRRVEDIKR

SEQ ID NO: 5317 - protein, 179 aa, Artificial Sequence; identical to SEQ ID NO: 5316
  Synthetic

SEQ ID NO: 5318 - protein, 179 aa, Artificial Sequence
  Synthetic
SVKERLDEVRRHHEDEVRRVDEKLKEILRHHEEEVRRVDKELKELLDHHKELLDDAERRNISEELRKRLEDTEERLRELAKELREILKRSLEELKKLLDELRRILEESLRELEKLIRDVKDKDAEEVKKRLDDINKRVEEIVREIEERLRRIDEKLKEIVRKAAEDIRRIDKEVEDEIR

SEQ ID NO: 5319 - protein, 179 aa, Artificial Sequence; identical to SEQ ID NO: 5318
  Synthetic

SEQ ID NO: 5320 - protein, 184 aa, Artificial Sequence
  Synthetic
SLEELLKKIEERLRDLSRKVAEELKRILDELRELSERAKDLNRRVNETLRKLVEDITRRDKDTEELKEILREVEDRARKISERDKELNEEVNKEVTEIVRRLEKLNEESKRKVEKLREELKRVDSEEDVKKVLDELEKLLKDNEELNRRVRKELKDLLETLRKLNERSKEELDKLIKELEDRAR

SEQ ID NO: 5321 - protein, 184 aa, Artificial Sequence; identical to SEQ ID NO: 5320
  Synthetic

SEQ ID NO: 5322 - protein, 185 aa, Artificial Sequence
  Synthetic
REVEEILRKLKEITDRTRDLSRRNEEELRRIIRELEEMSKRNKREVEEIIKEAKELAKRTKDKKELEDIVREIKKKVDDSKEKDKELVKRIRERIEESRKRDKRIADESRRLVEEVAEELERKGVDEKAREDLDRLRRENEELIERSERINKKIKEELERVIKRSEDLNKKLEEDLEKLIRDETR

SEQ ID NO: 5323 - protein, 185 aa, Artificial Sequence; identical to SEQ ID NO: 5322
  Synthetic

SEQ ID NO: 5324 - protein, 185 aa, Artificial Sequence
  Synthetic
EEVERILTKAERVTRETERLSRENEKELKKITDETRRLSEKNIEDIERIIEEMERLARTTKDERELEEIARRIEEEIRKSIERDKEIARESRELLKESKKKDKKIMDDSRRLVEELRRELEEKGVDEDARRELKRLEEENRRLLEESEERNRRIEERNEELIEESERRNRELEKRLRDLIKETRD

SEQ ID NO: 5325 - protein, 185 aa, Artificial Sequence; identical to SEQ ID NO: 5324
  Synthetic

SEQ ID NO: 5326 - protein, 182 aa, Artificial Sequence
  Synthetic
SAEDSIRRAEEEARRLIKRAEEEAEKSARRHKELNERARKRAKESAEEAEKLIREAARSGRVDKKELDKAAEEAKRAIEDSERDLERAAKEDRESIEESKKDLERAAKELREVIEDLKRAAKEGADARDLEEKAKKALEKAERIARKNAEDNERNLEKSKRIAERNAKKNEEALREIAKKAN

SEQ ID NO: 5327 - protein, 182 aa, Artificial Sequence; identical to SEQ ID NO: 5326
  Synthetic

SEQ ID NO: 5328 - protein, 182 aa, Artificial Sequence
  Synthetic
SAREDIERLVKELKELVERAREAIKRSAEEHKKLNKELKDRIKEVVERLKKLIDDARRDGRVDEKRLRDVVREVARVLRDAEERVKELHKRDRDSIDRSRRDLDRLVKELKDVIDDLRDLLRRGVPAEELLKKAKRVIEKAEKILRENKEENERNLATSEKIARDIEDKLRKVLKRIADEIR

SEQ ID NO: 5329 - protein, 182 aa, Artificial Sequence; identical to SEQ ID NO: 5328
  Synthetic

SEQ ID NO: 5330 - protein, 181 aa, Artificial Sequence
  Synthetic
SAEDKLREVEKHHEKLVRDIRRKLEKNLRDHAEKVDRVRKKLEEAERRLKELVDRVRKDNVSEELLETIERLLEELKRLLRELERLLKKTLDEDREILERAERELKRTLDELRKIVEDVRRRGRDDERVDRDLERLDREVEEIARRLTRLMEESNKRLEDIVRTIEERIKEILERLKRTAK

SEQ ID NO: 5331 - protein, 181 aa, Artificial Sequence; identical to SEQ ID NO: 5330
  Synthetic

SEQ ID NO: 5332 - protein, 179 aa, Artificial Sequence
  Synthetic
SDVEKIIKDLEKVIDDNRRTNEKAIRDAEDIIRRSEEHSRKVIEKLKKIIKEVKEEAERLKGDERVVKELEDELRKVKKEWEDVSKENRDTNRRVLEELKKILEDSKRHLDKALKKVRDDGVDEEEVRRVEEEIKKLLEDSRRLLRRIEEESRRLDEEDERLMKEIDDEIRELLERIRR

SEQ ID NO: 5333 - protein, 179 aa, Artificial Sequence; identical to SEQ ID NO: 5332
  Synthetic

SEQ ID NO: 5334 - protein, 179 aa, Artificial Sequence
  Synthetic
KEVEDIVDEARKRIDTVRKESKRVVEEVERRIEENKRRNEEVIKRVREDIDRVRKEADKLKGDDKVVKKLEDDLRKVLEDLKRIVDESAKHLKDLTRKWEEISKRLKDRLEEVIRELERRGVDREELERLRREVEKLEEDDRRLLEELEKRARELLERSKKLLDEIRREMEELLKRIRT

SEQ ID NO: 5335 - protein, 179 aa, Artificial Sequence; identical to SEQ ID NO: 5334
  Synthetic

SEQ ID NO: 5336 - protein, 179 aa, Artificial Sequence
  Synthetic
KEVEDIIREVEKRIRDSERHSKEVLDRAEEVIDDNRRKNEEVIKEAEEIIDRIRREADRLKGDEKVVRELEERLRRALEKLRRILKESTKHLKKLIEDWKRRSEEDERRNRDVLRELERRGVDKDLLKEVEERSRRVIEKDRELLKRLEDKVRKLVEDSRRMVKRIEEEIRKLLEDIRR

SEQ ID NO: 5337 - protein, 179 aa, Artificial Sequence; identical to SEQ ID NO: 5336
  Synthetic

SEQ ID NO: 5338 - protein, 183 aa, Artificial Sequence
  Synthetic
SELEKIIEDIKRLIDELRKLVEDVERRNRKLSEDDKRLVEEVLKRLDELIRRLREIAKKIKDKDTLRKILRDILEELKKLLETLRRLNEDSLEKSKRSVEELRRLLRRIKEELKRLLEEAATRAGRKVERLDELRERLKRLEDEVRRRLEELERENRKIIEETEEALRRIEEKARKELEEVDR

SEQ ID NO: 5339 - protein, 183 aa, Artificial Sequence; identical to SEQ ID NO: 5338
  Synthetic

SEQ ID NO: 5340 - protein, 183 aa, Artificial Sequence
  Synthetic
SELDDIIRKIEELIRDDERKVRKAVRENEDLSRRDEERVRKVIDEARKLLKRLEEIAREIKDKDTLREILEEIKKRLEELVKTLKDTNRKSKRDSERSVEEVRKTNEKSRRDLERLAKELADREGRKSEKLDELRKRLEDLIRETEKELRRLERENDEIEKRTEDLLRRLREELRRIVEEVER

SEQ ID NO: 5341 - protein, 183 aa, Artificial Sequence; identical to SEQ ID NO: 5340
  Synthetic

SEQ ID NO: 5342 - protein, 183 aa, Artificial Sequence
  Synthetic
DDLERIIEEIERLIRTLEELVRDALRKSKRLLEENKKLNEEVLRRIKDLIRRLEEIARRIEDKKTLEDILKEIEDRIKELAERARRINEKSLRDNKELVKDVRRKVEEIKRRIEELVEEIVRRAGRKLEELDKLREELKRLVDRVEEMLRKSEEDTERIIRKSEEDLERLERDLKRLVEEVRR

SEQ ID NO: 5343 - protein, 183 aa, Artificial Sequence; identical to SEQ ID NO: 5342
  Synthetic

SEQ ID NO: 5344 - protein, 183 aa, Artificial Sequence
  Synthetic
KELEDIIREAEKLIEENSRKNKEMLDRSKELIERNERKNRDVIRRLEELIEDLRRIAEEIKDKDTLRKILREILEELKELAKRLRDTNRESEKRNRDLVKRIREENEKSKRDLKRLIDDAVRRAGRKSEELDRLRKKLEDNIRESEKELRRSEEETKKLIDDSERELERIERRARELLERVRR

SEQ ID NO: 5345 - protein, 183 aa, Artificial Sequence; identical to SEQ ID NO: 5344
  Synthetic

SEQ ID NO: 5346 - protein, 186 aa, Artificial Sequence
  Synthetic
SDVEDLLRKIKKILREIAEESKRTVRENEELTDRVKKKIREIVERIRRIIKELEERLRRIKDKRDLERVLRDAERRIRELIETAERLLEEVKERSKRSVERNEELLDKIRKEIEDLVRTLRERAKNVKDVEDKLRELERELKKIEDDSRRLLKRLEEENRTLVKEVRERLKRLEDDVRKLKEDVTT

SEQ ID NO: 5347 - protein, 186 aa, Artificial Sequence; identical to SEQ ID NO: 5346
  Synthetic

SEQ ID NO: 5348 - protein, 186 aa, Artificial Sequence
  Synthetic
DEVDKLVEEIKKIIEDVRRESDKTVRDNEELTKKLAEDSKRSLDEIKKLIEELRKEIERIKDKETLDRVLREATKRLKDLVDENERLLRDAKRKSDESVKRNEEVLRRVRKEIDDLVRELRERAKTSEEVERKLKKLKEELERLVEESRRKLEELKKRNEELVRRSREELDKLRREVKETLERVKR

SEQ ID NO: 5349 - protein, 186 aa, Artificial Sequence; identical to SEQ ID NO: 5348
  Synthetic

SEQ ID NO: 5350 - protein, 186 aa, Artificial Sequence
  Synthetic
SDAEEILKEIERLIREVEKTSRRTVEEDERVTEEVRKKSEKSVRDIEELLKEIKRELEEIKDKDTLDKLLRDIRETLRKIVEDNRKLLEDVKRESEKTVRDNKEILRRVKEELRKLVEKLRRRADKSERVERKLEELKRRLEELEKESERELDRLRKENEDLVRRSEEELRRLRRELEEIVREARE

SEQ ID NO: 5351 - protein, 186 aa, Artificial Sequence; identical to SEQ ID NO: 5350
  Synthetic

SEQ ID NO: 5352 - protein, 172 aa, Artificial Sequence
  Synthetic
SEAEKVLKEVEDIIREVEEENRRLIREIEEEIRRVKEEVERLLRKSEKDIKEVEESPKSKDLERRLEEVDEELKREIERIERELDKVLRELEERSRESVERLRRVLKEVRERNGMDEKLLREIERRMRELEKTSRKLLKEIKKKAKELKEKAEEVLRRSRKRTEELVDRLRK

SEQ ID NO: 5353 - protein, 172 aa, Artificial Sequence; identical to SEQ ID NO: 5352
  Synthetic

SEQ ID NO: 5354 - protein, 183 aa, Artificial Sequence
  Synthetic
DVEDLIRELRKRLDELRKESEELLRRSKRKHEKLLTDSRKLLRDIEREARKLLEDVKRKGASESTVEKIKRDLDRLIKELEKVHRDSRRKSKEDLDRLKRVHDESKKKIDELRKELDEMSRVKDREMIETLIRKAKEIIDRLREENRRAVRRSDETLRRLKEENDKVITDVKRKIKELRDEVK

SEQ ID NO: 5355 - protein, 183 aa, Artificial Sequence; identical to SEQ ID NO: 5354
  Synthetic

SEQ ID NO: 5356 - protein, 183 aa, Artificial Sequence
  Synthetic
SIDEEITRLEEESRRDEEESKRLLEKSRDDHRRLLERSEKLLRELEKRARDLLEDVKRKGASKSTVEKLREDIERVLDKLRKVHERSRRKSEEDIRRLEEVHERSKRKHEKLRRELEDVRRVSDEEMVRRVIEKYERAVERSTEENRDAFRRSEETIRELAKENEDAIREVKEIIDKLREDVR

SEQ ID NO: 5357 - protein, 183 aa, Artificial Sequence; identical to SEQ ID NO: 5356
  Synthetic

SEQ ID NO: 5358 - protein, 183 aa, Artificial Sequence
  Synthetic
DVEELIKELERRLRKLLEDSRRLLEESRREHKKLIDDSRRLLDELRRRLERLLEKVRRRGASESKVERIERRLRDLLRRLREVHERSKENSKRDIERLERVHDESRKEIKELLDELREMSKMSRREVIEAVIRKAEDIIRRLRRKNEKAVEESRENIKEIKRENKRVIDEAREIIKRLEEELE

SEQ ID NO: 5359 - protein, 183 aa, Artificial Sequence; identical to SEQ ID NO: 5358
  Synthetic

SEQ ID NO: 5360 - protein, 183 aa, Artificial Sequence
  Synthetic
SVEDLLRRLEEESRKDLDDSRRLLDESRKRHEDLLRKSEELLRELEERLRRLLEKVKKKGLDDSDVKRLEKKARDLLKELREAHKRSRDNSERDIRDLERVHRESEKRHRDLRKKLEDVRRSRREDVIRKLIEDYERLVKESTDRNRRAVEKSRENLKRLDKENRDVIEKARRIIEELEKEVK

SEQ ID NO: 5361 - protein, 183 aa, Artificial Sequence; identical to SEQ ID NO: 5360
  Synthetic

SEQ ID NO: 5362 - protein, 183 aa, Artificial Sequence
  Synthetic
SVDELIEELRRRLEKLLREAEELLKESRKRHEELKKRSKELLDELEREVERVLEELRRKGVSDDKVKRVEDRLTELIRDLRRAHKESEKNSRDDIRRLEEVLKKLEKKIRDLERELEEMRRSKDEEVIERVIRKADEIIKRLKKELREVVERSKENIKKLEEENRRVIKKAREELRKIEEEIR

SEQ ID NO: 5363 - protein, 183 aa, Artificial Sequence; identical to SEQ ID NO: 5362
  Synthetic

SEQ ID NO: 5364 - protein, 179 aa, Artificial Sequence
  Synthetic
SEVDEVLKTLKELIERLRERVKEVLKRLEKLLKELEDLSRETVRELRETNDDLRRKAEKTRDKDTLRELVKRVLDENKKIITRNRDTVRRAMERIEDLIRELERTVEKIRRDIERIIRELIRKREAAEKVRRDVDRLRKEVEEMLERVKRKLDELRKDSDRLAREVEDSTRKIERDVEK

SEQ ID NO: 5365 - protein, 179 aa, Artificial Sequence; identical to SEQ ID NO: 5364
  Synthetic

SEQ ID NO: 5366 - protein, 180 aa, Artificial Sequence
  Synthetic
SELEEMVKKVKEIIDRARERIRELIERHKELDRESRKRIEDIIREARELNKDVKRVIKEIKKEEEEKLKKILEDLKRLSDEVKRRLERILEENRKLVRESEKRLEDVLKELKELLRDVERKARVDEALEELKRRVKRLEEKLREDIKRLRENNERIREDVERLAEELDRHTRKLMEEVKK

SEQ ID NO: 5367 - protein, 180 aa, Artificial Sequence; identical to SEQ ID NO: 5366
  Synthetic

SEQ ID NO: 5368 - protein, 180 aa, Artificial Sequence
  Synthetic
SELEDIVEKAKKIIEDVRRRIEKLIRDDKRLNDESKKTIEELIRKARKLNEEAERIIRKIKEDDEKKLREILKRLRELSEEIIKRLREVLDRDRRLNKKTVDDARRILRELKELLKEVEKRIRVRELLEKLRRDVEELEREVRELLERLKENSKRIEDEVRELMKELKRHTEELEREAER

SEQ ID NO: 5369 - protein, 180 aa, Artificial Sequence; identical to SEQ ID NO: 5368
  Synthetic

SEQ ID NO: 5370 - protein, 180 aa, Artificial Sequence
  Synthetic
RELEEIVERAKEIIRRVAEKIKKLIEEAERLDRDSKRKIDELIEKVKKLNEDVRRTIEEIKEDDRKTLREILETLKDLSRRAIEEARRILEENKKLSKEIEDRVREVLRELKKLVDDIRREMKVEEMLRRLTELLKELADEVKKLLDRLKENNEKIREDVERLLRELEEHTKKLEEDVTR

SEQ ID NO: 5371 - protein, 180 aa, Artificial Sequence; identical to SEQ ID NO: 5370
  Synthetic

SEQ ID NO: 5372 - protein, 179 aa, Artificial Sequence
  Synthetic
SEEERVLKELEDVLREHKRKADESSRKLEEVHRRHRKRMEESKRELEEVHKEAKDRITKNRDDTKLLEDIIRTLRKINKDVARRNEESIRELKEINKRVLDENKKSREELEEILRRVIERVGETEELEDVERKARELEERNKKLLKDSEEATEELRRENEEMLEESKRRTEKLEREVRT

SEQ ID NO: 5373 - protein, 179 aa, Artificial Sequence; identical to SEQ ID NO: 5372
  Synthetic

SEQ ID NO: 5374 - protein, 175 aa, Artificial Sequence
  Synthetic
DKVREVLRESEKLLEDWDRELKEVLKDFKRTLDELEERLRDVLRKNKKSLEDLKRRGLDDRVVRKVEEEHRRVAEEIKRLVREAEKLLEDVKRELERLKREAEEENKRVRDKVRKDGDADDRIMRELRELNRRLDESVKEIRDRLRRILDKLRKMIEKLKKELEDTDRELEERVR

SEQ ID NO: 5375 - protein, 175 aa, Artificial Sequence; identical to SEQ ID NO: 5374
  Synthetic

SEQ ID NO: 5376 - protein, 175 aa, Artificial Sequence
  Synthetic
SKAEEVLKTSEKLLEEWRRRVKEVEDRNEETIKRLKEELDRALKENEESLRELEKRGLDEEVKRRVEERHRKIEEEIEELRKKLREKHKKVKRDIERLVKKMKDDNEEVKKRVDKRGDLDDRISEELKKLNEELERELRKLSEELKEVDREAKEEIRRLVEELREIDKRLEEETK

SEQ ID NO: 5377 - protein, 175 aa, Artificial Sequence; identical to SEQ ID NO: 5376
  Synthetic

SEQ ID NO: 5378 - protein, 175 aa, Artificial Sequence
  Synthetic
SEAEKVLTDFRDALEKDRERNERVLRENEETIRRDKEENERVLRENDKSLKELRKRGLDERVADKVRKDHEKVKRDTERLVRELRRVHEKVRKETERLIREMRKALEDVRDDVRRRGSADDRIKKTLERLLRESKKASEKLKDDLRKLDKRSKEESRRLTERLREIDEELRRRVD

SEQ ID NO: 5379 - protein, 175 aa, Artificial Sequence; identical to SEQ ID NO: 5378
  Synthetic

SEQ ID NO: 5380 - protein, 175 aa, Artificial Sequence
  Synthetic
SEAEDVLRRFEEELRRDDEKNERVLRRNEETNRRDDETNRDVLRRNKESLDKLRKRGLDEEVVKRLREVHERVREETKKLNREHKKAHEDVKRDTEDLKRRMEDELRRVEDEVRKRGSADKRIKDELRKLLKRSEERSEELRRRLEDLDRRSKETSDKLREELERLDRDVERKVN

SEQ ID NO: 5381 - protein, 175 aa, Artificial Sequence; identical to SEQ ID NO: 5380
  Synthetic

SEQ ID NO: 5382 - protein, 175 aa, Artificial Sequence
  Synthetic
SEAEKVEDDVRRVLETDEKKNRDVLDTNRRTIEEDRKRNEEVLRKARKMLEDLKRRGLDKDVVKRVEEVLERVKRETERLTRELRKFHEEVRKETEDLKREIEKLLRDLRRDVERRGSADERLRETLEELLRRSDERSRRIMEDLKRLDTDSKRVSEELKRRLEELLKDLERKVR

SEQ ID NO: 5383 - protein, 175 aa, Artificial Sequence; identical to SEQ ID NO: 5382
  Synthetic

SEQ ID NO: 5384 - protein, 185 aa, Artificial Sequence
  Synthetic
SEVDEITKELEESLKDLDRVVRELREKIKKIDKELAETVDKLTEEAKEILKTLRDIIRRGNNTEEVSREAEELLKELKKRLEELEREVERLHEELRKEIEELEREAEKRNKDVKEKIDRGNLDKKLKEKVDRVHKRHKDRLDEIKRKLKKVLEDNRETLERIKRKLRKVLEDLKRMLDELERELR

SEQ ID NO: 5385 - protein, 185 aa, Artificial Sequence; identical to SEQ ID NO: 5384
  Synthetic

SEQ ID NO: 5386 - protein, 176 aa, Artificial Sequence
  Synthetic
KETEDLVRRLRKVLKELEERVRTLMRDNERVNKEIADKIRRLREKLREEDERVDEVVKRREVDEKDLKRRADESREELKKVLKDLEDTVKRLEEKNDKVRRELKKIVDELRRELEREVKEAREVLREMDERVKELEERLERVLRKSKTDADRWRRELKRVLEEHDKTVKEIREKTR

SEQ ID NO: 5387 - protein, 176 aa, Artificial Sequence; identical to SEQ ID NO: 5386
  Synthetic

SEQ ID NO: 5388 - protein, 178 aa, Artificial Sequence
  Synthetic
KEKDEVVKRYEDRIKEIRERLKEVVTEHEDRLRKWRKDLEEVVERNRRSIKKIDEEVKRRGVPEKVKRELREIEKRSEEIIKKVREELEDLARKSRERIKRVEEEHDKNTDKARKDITKEGVDEDVVRKLDEDLKRNEDHLEEVRKELERLNEEIEKLIRDLLEILRRIDKELRDKLE

SEQ ID NO: 5389 - protein, 178 aa, Artificial Sequence; identical to SEQ ID NO: 5388
  Synthetic

SEQ ID NO: 5390 - protein, 178 aa, Artificial Sequence
  Synthetic
DEEKDVTRRVREVIKRLEEELEEVVRRHRESLKRLKERLEEVVRRNRKSIREIEKEVKDAGLPDEVKRRLDEIKKESEKRIDDARRREEEVEKDSERRIKEVEDRLKRKAERIEKAREERGVDEDVDRELARMLEELRDLLRRLAEELKRIDEELEKELRDVARELEKIDRDMREELR

SEQ ID NO: 5391 - protein, 178 aa, Artificial Sequence; identical to SEQ ID NO: 5390
  Synthetic

SEQ ID NO: 5392 - protein, 178 aa, Artificial Sequence
  Synthetic
DERKEVEERYRREIERIKTKLKEVVKRHEDSLKKIEDDLEEVRRDNERSIKEIREEVRKKGAPEKVEEDLRRIEEKSRRDIKRMEEDLKRMTEESRREIEDVERRHRENEERVEREIEKRGIDEDVDRELKEDLERNERHLEEVTRRLRKIDKDLKEKLKRLEEELKKIDREARERLR

SEQ ID NO: 5393 - protein, 178 aa, Artificial Sequence; identical to SEQ ID NO: 5392
  Synthetic

SEQ ID NO: 5394 - protein, 181 aa, Artificial Sequence
  Synthetic
KEIEDVKRRLEELDRRIKELVDRVRRKLEEVDTRAEKELRDVRRRLEELLERLEELIRRGTSEETLRRLAKEIRKIADEARKKLKKIKDDLKKEHDRVREKLEELARRSRKVLKEVRDRTGEVKELRDVIKENEDTLRRLKEEVEKVTKENEETLRRIERELDKVERDVERRIRELEEERR

SEQ ID NO: 5395 - protein, 181 aa, Artificial Sequence; identical to SEQ ID NO: 5394
  Synthetic

SEQ ID NO: 5396 - protein, 177 aa, Artificial Sequence
  Synthetic
SEVEKVLEDNKRSIDRLEEELRKVTRTSRELLKEWAKRLEDVLRDVKRAVDELETRGVDEKTLRELRKRLTDIEREIRKKLEEAEKKLRESERDVEDTLRRLREKSRRITEEARKGGDSDEIRKLKEELKRLDEEAARILETIMRRNKDLNDRLREIIETLKKRLKDLLKEVEDRAR

SEQ ID NO: 5397 - protein, 177 aa, Artificial Sequence; identical to SEQ ID NO: 5396
  Synthetic

SEQ ID NO: 5398 - protein, 178 aa, Artificial Sequence
  Synthetic
DAEKLREDVERTLRRLRKELKDSIKRNREELERLERKLRKSIKETEDEVRKLEEKLERRLKDDEEVRRRAEELAKRLKELNEDVKRKADRLKEESERLDEELEKRLRDLEREVKKLEKDQDVDDDVRRLVEKIEREVRKLIEDHKKKSEDIVRTVEKLIEDHKRRVDRISEEVEEELR

SEQ ID NO: 5399 - protein, 178 aa, Artificial Sequence; identical to SEQ ID NO: 5398
  Synthetic

SEQ ID NO: 5400 - protein, 178 aa, Artificial Sequence
  Synthetic
SKEDLKRKVKKILEDVERELRRSIEDTERLLREVEKRLEDSVRENRRKLREVEEKLRRRLKDKREVMEKLRKIVTESEELDKDVKRKVEELERRARELNRELKEKLEELKKEAEELDRREDVDRRVDELVKEIEERARKLIKEHRDRVRELLRELEELIERHKELSERILKELEELLK

SEQ ID NO: 5401 - protein, 178 aa, Artificial Sequence; identical to SEQ ID NO: 5400
  Synthetic

SEQ ID NO: 5402 - protein, 174 aa, Artificial Sequence
  Synthetic
SEKEEIARRLEKVHREHREELKRLEDRLREVLKRNRETIEDIRRKLEEVLRRLRERLVDDEEVLRELTEEAEELERRVRRRHEELERLVEELKRKADKINKDLERLIRELKERLDDGDEEKLRRDVERIVKEAEDTLRELERVVRELEKEVRETDKRLDERVKELEEKVRRAAK

SEQ ID NO: 5403 - protein, 174 aa, Artificial Sequence; identical to SEQ ID NO: 5402
  Synthetic

SEQ ID NO: 5404 - protein, 178 aa, Artificial Sequence
  Synthetic
SEEEDARRLLEEVERALREIKKRLKELLERHRRAVEELKKRAEDLLDEHRRAIERIADERGDRDTIADKVRKEIERSHTELKKLEEEIERISRDADRRVKEIAREAEELLRELEERLERKRVSEEIKRRLKELAKDLRRAIKEVKERLKESHDELKRAIEDVKRKLEELDEKLKRDED

SEQ ID NO: 5405 - protein, 178 aa, Artificial Sequence; identical to SEQ ID NO: 5404
  Synthetic

SEQ ID NO: 5406 - protein, 172 aa, Artificial Sequence
  Synthetic
SERERVERSVEELIRRYREVLEESERRNRKLLKRYEDALKKSREDNKRLLDELRRANRGPEEFLERMERESRRIIRELEKNLERLKRESEDILRKLDKNMKDIERELKKLRDDDLPREDAERLLERIERHLRRSEKTSEELNRRLEDHARRSIEESKKLNEELERKLRELER

SEQ ID NO: 5407 - protein, 172 aa, Artificial Sequence; identical to SEQ ID NO: 5406
  Synthetic

SEQ ID NO: 5408 - protein, 182 aa, Artificial Sequence
  Synthetic
SSEETLRDINRKISKAIEEIEREAREIDRELRKAVEDLKREAEEIDERVREVIERIGTRDEDLKRLEEEIERLHRELEKKARDLARKARELHRRLEEKIRELADRLRRLSEEAEKRDGRDTEVKKVLDKNEELLKRWEDRLREVLERNRKTLREIERELEEVLRKNRESIKKLKRELEEASR

SEQ ID NO: 5409 - protein, 182 aa, Artificial Sequence; identical to SEQ ID NO: 5408
  Synthetic

SEQ ID NO: 5410 - protein, 182 aa, Artificial Sequence
  Synthetic
SSEEDLKRIDDELDKMVKDIERKIRRIDTELERVVKELKEDIERSLERLREVVERIGTREEDLTRLDKEAKDINKRLEEEARRLVDEAKKLHKRIEEEIRELEKRMEDLHKRVRDEVGDDRDVRRVLDENRKTLEDLKRKLKEVLDRNRETLKRIEKELREVHEKHNRALDELRKELEDRRR

SEQ ID NO: 5411 - protein, 182 aa, Artificial Sequence; identical to SEQ ID NO: 5410
  Synthetic

SEQ ID NO: 5412 - protein, 182 aa, Artificial Sequence
  Synthetic
SVEEEAEDILRRLDKTVRDLEREAEKIDEDLERVVRKLEEELRRSLEELRKVVEEIGSTEKDLKRLTEEAERKNKELRDRAEELADRARKLHEELRKKLEELLKRARELLKDLERRSGRDRDVTRVLRKAERVLKEIEEKLRDVLRRNRETLKRIEDELERVHRDHNRKLKRLKEELDERRR

SEQ ID NO: 5413 - protein, 182 aa, Artificial Sequence; identical to SEQ ID NO: 5412
  Synthetic

SEQ ID NO: 5414 - protein, 175 aa, Artificial Sequence
  Synthetic
DEDRDVEEKIKKIIKAAEDVNKESEERITELKKRLREIHERSERLIRRIEEEAKKKNRSRDVKRELERLERELRRLNEESERRLDELTKELRKENDEMLRRLKELTKRLRDVLRRGELDKKKLDEIIERLRKLLEDLEERNRRVIKELEDLIKENEELNRKVIRDLEKLVEDAER

SEQ ID NO: 5415 - protein, 175 aa, Artificial Sequence; identical to SEQ ID NO: 5414
  Synthetic

SEQ ID NO: 5416 - protein, 185 aa, Artificial Sequence
  Synthetic
DEEDEVRKRVEESERESRKLLTDVKREADRLKEHDKRLLDEVKKLLDKIREDLKKLPSEDEEKRKRLKELLDRIEKELRDLAKEVKERNERLDEELERLADEARKLHEEVKRRLDDLRRKSKDVDREELKRELDRIIEELKELNKRLEERLRELIRDWERVSRELAERLKRIIDKARRLLEEVAR

SEQ ID NO: 5417 - protein, 185 aa, Artificial Sequence; identical to SEQ ID NO: 5416
  Synthetic

SEQ ID NO: 5418 - protein, 176 aa, Artificial Sequence
  Synthetic
DEVEELLKELKDLSRESVRELRRLDEELKDLSRRSLKRLTDLDEELRREVEERRKENSKDDRVEEEVEEALKKSEEDLDRIIKEHRDAVRDSRRRLRRVLERHEEELDRLRREVEREGVGDERLKKLADDSRKRLRDVERHHEKLVEDSERRLKTIKDHHKKAVEDIRRDLRETKR

SEQ ID NO: 5419 - protein, 176 aa, Artificial Sequence; identical to SEQ ID NO: 5418
  Synthetic

SEQ ID NO: 5420 - protein, 175 aa, Artificial Sequence
  Synthetic
SEIDEVLKEIKRIIDELRERNRKHNEEVKDRIRRLEEELRKDLKDLKEIVERLAKSNVDREELDRILEELRKRVKEVEERLEEIRRDLERSHEELDRENRRVHKELKERLDRTNVRGEAADRARELEKELKDISDTSRKSNEELRKRLEEIKDRVRKEIEKLLRELEEIVKEKRR

SEQ ID NO: 5421 - protein, 175 aa, Artificial Sequence; identical to SEQ ID NO: 5420
  Synthetic

SEQ ID NO: 5422 - protein, 179 aa, Artificial Sequence
  Synthetic
DEEKETIKRHRESVREAERRLRDTLRRNRELVERLKRTLEDILRKHEKLVEELEEMAKRGEVDEDTLREVEKRSKDLEERLREILEKVREESERLTEELKKESEKHERDSRRLTEDLRRRSSDPEELKESHKDLKKIHEDAERRVRESHTDLRRIIEKVKEDLERSHRKLKRIADETRK

SEQ ID NO: 5423 - protein, 179 aa, Artificial Sequence; identical to SEQ ID NO: 5422
  Synthetic

SEQ ID NO: 5424 - protein, 179 aa, Artificial Sequence
  Synthetic
SEMEEVLERDERKVRELEREIEKNLRDHKDEVRRLREDLERVLREDEKLVRELRKKNSKDDRLAKEARERNKKLNDEVRKKLEDVRRKSERNKEEHKRRLDEVRRDNKRLNDDLKDRNISEELEDRMRRSSKRLEEVLRESEERLKRSDEDLRRVIDEIRRRLEESTRRLEETIKELKD

SEQ ID NO: 5425 - protein, 179 aa, Artificial Sequence; identical to SEQ ID NO: 5424
  Synthetic

SEQ ID NO: 5426 - protein, 182 aa, Artificial Sequence
  Synthetic
SEREEVLKDIRRLLDEVRRRIEDLLEKLRRLNEEVKEKVKESEKRLRDLMRKAKELMKRGLDEDTLRKVLKEVEDRLRENHKELKRVEEESRRALEDIRRKLKKVTDDLRKRLREIAEELERRGIRDEDIKRLIEELEKLLKEAKEKAEDLTREHDDTLKKIRERHKEIIKDIEDKLDTDRQ

SEQ ID NO: 5427 - protein, 182 aa, Artificial Sequence; identical to SEQ ID NO: 5426
  Synthetic

SEQ ID NO: 5428 - protein, 182 aa, Artificial Sequence
  Synthetic
DEEEELKKKLKAILEDLKREMREHEEKLRRSLERVARTAERHKETIKRIIDRLRKEAEDVPKDRRAEERLEEIRRELKKKDEDTERRSRKNEKELKDLNDETDKRLKDIEEEVKRTIKRLKDESDTSEEVKRIAEDIKRVLEEIRKRSREILEEVKRLHKKIKDDSRKLLKDLEKLVREIRK

SEQ ID NO: 5429 - protein, 182 aa, Artificial Sequence; identical to SEQ ID NO: 5428
  Synthetic

SEQ ID NO: 5430 - protein, 172 aa, Artificial Sequence
  Synthetic
SVEDEARRLEEKLRELTKRAREALEESNRRHRKSVEEVRRSLKKNHEKLEELARRVSRIDERRVREIKRRHEELLERLKDELDKSEEEHERLIEELERLLEEARREVERLRREREVDERLLKELEDLIEEVERELRRVLTESKRLNEELRKRVKEIEERSEELIERLDREVR

SEQ ID NO: 5431 - protein, 172 aa, Artificial Sequence; identical to SEQ ID NO: 5430
  Synthetic

SEQ ID NO: 5432 - protein, 172 aa, Artificial Sequence
  Synthetic
SMDESMETLTRELEDLLRKVEKKLRDSNEHHRELLEEVKRRVEENHKELDELLRRASRVPEEVLKKIRRDHDELRKELDKLLRDSERRHRELLEELKRRLEEVKRRLDKLRKDEDVTEELLTKIRKLIRDVEETVREAERESRALDERLERTVRDVEEKSKRLIEELRRRAD

SEQ ID NO: 5433 - protein, 172 aa, Artificial Sequence; identical to SEQ ID NO: 5432
  Synthetic

SEQ ID NO: 5434 - protein, 178 aa, Artificial Sequence
  Synthetic
DAEEEIRRIDKHHEENVRKAEEDIRRLIEHHKENVERVDRELRKIIREVEEVIRRVKELDERKVREVEDRLRRIKEEADRLSKESTDRLREIKKELERISEESKKELDKLRRKAREVRDERLVRELIRRLERTDEEHHKKVRRILEELKRIDEEHHRLVRRILKALKDIIKRLREEVK

SEQ ID NO: 5435 - protein, 178 aa, Artificial Sequence; identical to SEQ ID NO: 5434
  Synthetic

SEQ ID NO: 5436 - protein, 178 aa, Artificial Sequence
  Synthetic
SLEEEIEKIERHHRKLVEEARRELKRLEDKLEKLNRDSRKRLKELAERLKKLIDEIKKLDEELVKEVKRRLEELSKDLERKHRKVKKEVKELIDDAERILRESERELERLTEKLKEVRDERVARRVLDELRRLNEKLRRMVEELVKEIERLIKKVKDDSEDVMRKLKELLKRLEDRAR

SEQ ID NO: 5437 - protein, 178 aa, Artificial Sequence; identical to SEQ ID NO: 5436
  Synthetic

SEQ ID NO: 5438 - protein, 179 aa, Artificial Sequence
  Synthetic
REKEELLERLKKVLERTERVIRDLERRLREVLERSRKLAEDLVERLERSLKTLEKLAREGRVEERLLKRNHDELRKLLEDAKDKLRRINEELEKLLRDVKRELDRINEELKRLIDDATRRTGEREELREIYKRHEDLLRTAEERLRKVYDDHRDLLRKIDEDLKRLKERHEELLREIRR

SEQ ID NO: 5439 - protein, 179 aa, Artificial Sequence; identical to SEQ ID NO: 5438
  Synthetic

SEQ ID NO: 5440 - protein, 180 aa, Artificial Sequence
  Synthetic
EEKDRLKKRLEELNREHEELVRRISERVRRLLEKAEREIRTLKKRLDELNKELEEIIRRDNARDEVIKRVERIHEELEKELKELLDRLRDEMRRLEEELKRLNDEMRERHDRLRKEVKDVDEKVKKELEDVERHSRDSSRRVKEELERLKEELDRRLRKVKEDLERVKRHSKKLVDDAKR

SEQ ID NO: 5441 - protein, 180 aa, Artificial Sequence; identical to SEQ ID NO: 5440
  Synthetic

SEQ ID NO: 5442 - protein, 180 aa, Artificial Sequence
  Synthetic
SEREDLRRELEELLREHEEVVKEVKRRLEELLREHEEIVRELTERLKTINEDLKRVIKRDKASDETARELEKRHKKLEDEVRRSNERMRRTLEKLRKDLEDKNRDLERKLRRLEKDAKDISEEAEKELRDVAKRLRESSREVRETVRDVADKLRESSKKLEEELRRVKKHSKKLLDEAKK

SEQ ID NO: 5443 - protein, 180 aa, Artificial Sequence; identical to SEQ ID NO: 5442
  Synthetic

SEQ ID NO: 5444 - protein, 185 aa, Artificial Sequence
  Synthetic
SLEDLLRKVEEDAKRSIEKLEKDLKRVEDKHRELVERVKRRLDDVRRKLEEIIRDAERKGTSDEVREFLKEVERRVEKIADELRRKLERNHEELRRLADELRKKSEEVTRRLRDIMRKLREENTTDERVVREVLDELRKLLDDHNKKVKTVLDELKRSLDKLREEVKKVEDKLEEILKTLKETVR

SEQ ID NO: 5445 - protein, 185 aa, Artificial Sequence; identical to SEQ ID NO: 5444
  Synthetic

SEQ ID NO: 5446 - protein, 181 aa, Artificial Sequence
  Synthetic
SLEELIREIEKELDDLLREHEDLLRKIKEEIERLIREARELIKRLEEENEELRRNLRTDKETLERLEKRSEELKDENRKNLRKVEETLKRLEEKLRKHNEDLRREIEKLKKELRDAAREGMSEEEVKREIDRVRRVIEELRESVERLREEVRETLRRLKEHVKKDVEDHKETVKEVERRTR

SEQ ID NO: 5447 - protein, 181 aa, Artificial Sequence; identical to SEQ ID NO: 5446
  Synthetic

SEQ ID NO: 5448 - protein, 177 aa, Artificial Sequence
  Synthetic
DTEDLIREIRRRLEESVRENKELLDRLRERLEESIKRNEDLLKRHRENSKRIADRVRSDEELERVKKEAERLHKESRDKDRDLRKKVEDLARRSEELDKELRKRLKDLERELREAKKTRELVKEMIDRLRDLLRRHKEESKRLVEEVKKLLDRHREESERLVRELDKMNKDLEDRAR

SEQ ID NO: 5449 - protein, 177 aa, Artificial Sequence; identical to SEQ ID NO: 5448
  Synthetic

SEQ ID NO: 5450 - protein, 173 aa, Artificial Sequence
  Synthetic
DTKELLDELRKRLEDSARRVEELEKRVKDELERLKKRSEELLDEIRKRMKDVRDRGLVSEEVLRRLEELLRRVTEKVKRLNEELERKTREIRKKLRESVEELRRRLEDAERLKERLDKDELVRRLDETLKDHDRKLKELVDEAKELLRRYEEESKRLKRELDEILRRVREEAK

SEQ ID NO: 5451 - protein, 173 aa, Artificial Sequence; identical to SEQ ID NO: 5450
  Synthetic

SEQ ID NO: 5452 - protein, 178 aa, Artificial Sequence
  Synthetic
REIEEVRKKVEKILRDYDKVVKDIVEKVRRILEEYRRKSEKLTREIEEILRRLREVIKRDLRKEELDELKERVRELLDRLRDKLRKLNEELRKLLRDLEDEIRRLDEKLKELIRDLERKARDEDSLREIRKEARRLHEKSKKLLDEIRKRAEDLERETKKLLDDIKRELEDVVRELEK

SEQ ID NO: 5453 - protein, 178 aa, Artificial Sequence; identical to SEQ ID NO: 5452
  Synthetic

SEQ ID NO: 5454 - protein, 172 aa, Artificial Sequence
  Synthetic
RELEELLKRAEEVIKELKKSIDTMKEENDRLITELAKRVEDLKKRNDDVLERLKKDNIDEKTLEKIIRKLRRENEEAMKTLKKLVDDIRKRNDEHNKELKKLARDLREDLKRKVKSEEVLKEIDKRLKELEKEHEKVNRESEKRLEELLRRVEKVNRDSERELERLREERET

SEQ ID NO: 5455 - protein, 172 aa, Artificial Sequence; identical to SEQ ID NO: 5454
  Synthetic

SEQ ID NO: 5456 - protein, 174 aa, Artificial Sequence
  Synthetic
SEIEEVLERAERLLRRVAEALRRTTKELEDLNREVADLLRRTTEKAERLIRRVKSKIDKEEVKTRIDRLLDRSKDLTKKIKKRSDDSVKRSRELTDEIRRDLERLLRTLKKLADDGVPVEELKRVADEVVKKADDLVDEDRKLAKDSVDELRRLVEKDEKLAKDVVEEVEKLAE

SEQ ID NO: 5457 - protein, 174 aa, Artificial Sequence; identical to SEQ ID NO: 5456
  Synthetic

SEQ ID NO: 5458 - protein, 177 aa, Artificial Sequence
  Synthetic
SLEDAVRKARELIKRAEDILRRAVEEAKKLHKRSKEILEKAVEDAKRLYEEAKDAARKAGADERVIKELEENAKRVEEEAKKVKDDNDRLAREIKRRAEEVEKRARDLARKLDEEAKRNADAKTILDKAREVAERVARLARKLLEDSRKVARESAELAKRLLEYAKKSAEDAKRKAK

SEQ ID NO: 5459 - protein, 177 aa, Artificial Sequence; identical to SEQ ID NO: 5458
  Synthetic

SEQ ID NO: 5460 - protein, 185 aa, Artificial Sequence
  Synthetic
SIDEVLKELEDVARKSKEKNKRVHDDDERVVREVHKENRRVLRELEEMAERVRRELEKRGVPEEVLKRLEELIEELKRDLERSDDELRRSVEESEKRNRETNKRLDDHVKEVRRTVEKIKRDNQEEEKVVRRVKDIARHNLELADRSVEESRKSVKENKDLVDRSVKKVEDLVRELKRLVDEIKR

SEQ ID NO: 5461 - protein, 185 aa, Artificial Sequence; identical to SEQ ID NO: 5460
  Synthetic

SEQ ID NO: 5462 - protein, 185 aa, Artificial Sequence
  Synthetic
SIDEALTRLERAVEESHKRNEDVHRRDEEAVREVHKRNREVVKKLEDEVRKVIERLRRRGVDERVLRRLEEEIDKVRDELRRSDEELKKSVDDSKRRNKESDDELKKHVDELRRTIKTMKDSRVREEEVVRRIDELVEHNKDLVRRSVDESDKSVETNKDLVEKSVRRVDKLVKDLRRLVDEIER

SEQ ID NO: 5463 - protein, 185 aa, Artificial Sequence; identical to SEQ ID NO: 5462
  Synthetic

SEQ ID NO: 5464 - protein, 185 aa, Artificial Sequence
  Synthetic
KIDEALKRLREVVKRSHEENEEVHKEDEKVVRELDKENKDVLKELDEAVKRVEKKLRDRGTPEKVLKELKDLIDKVEKDARKTNEELKESVKRSAEENKKSNEELRDHARKLDKTVRDMKENRVREDEVVKRIDELVTHNKRLVEESVERSKESVDRNRRLAEKSVEDVRRLVEELKKLVDDITR

SEQ ID NO: 5465 - protein, 185 aa, Artificial Sequence; identical to SEQ ID NO: 5464
  Synthetic

SEQ ID NO: 5466 - protein, 177 aa, Artificial Sequence
  Synthetic
SLEEVLRRLEKVVRDSDKRLEEVLTRLAKVVRESNKRDEDVHKELRDVVRRVEELLERSNVPGEALKELRRLLEEVEKRNRDSKRESEKSEEEIRRRAKKVLDDSRKSLEEIRRLVENGVSEETVDKLVEDNERLVREIVKEVDELVKRNEDRARESVDESRKLVRRIEERVREETR

SEQ ID NO: 5467 - protein, 177 aa, Artificial Sequence; identical to SEQ ID NO: 5466
  Synthetic

SEQ ID NO: 5468 - protein, 173 aa, Artificial Sequence
  Synthetic
SVEDVLREAKRVLDEVRERLREVNTETNKVIKDVKKESDDVNRETNELIERVAREVPRTRELEEIEKEVRELDERNRKTSKELVDTVRKLDDENRKRIEEVEKEVEDRLRELRKRRLTEEVERLVDEVRKLVKRLVEHVKKLAKEIKELLERNVRHVEEVAERIKRLIKETKD

SEQ ID NO: 5469 - protein, 173 aa, Artificial Sequence; identical to SEQ ID NO: 5468
  Synthetic

SEQ ID NO: 5470 - protein, 177 aa, Artificial Sequence
  Synthetic
ELREDVERVVDEIRRLVEENVRRIDEVAKDIKRLADDNVRRVKELVRKIEEDIRRLKEEGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 5471 - protein, 177 aa, Artificial Sequence; identical to SEQ ID NO: 5470
  Synthetic

SEQ ID NO: 5472 - protein, 181 aa, Artificial Sequence
  Synthetic
SAREKVEKVVKEVEELVKRDVEEVERIVEEVKKLVTEDLKISEEIVERVDRLIRELKKEPKSDEFRKKVEEVRERVRRLLEENRRHTEELERRVEELLKELEKHTRKVKDDIKKLLDRLREDGVDERVLKKLEDVVRRVEKESEDALRRLKEVIKKVKRESEEANRKLEEVIRRVVERVRR

SEQ ID NO: 5473 - protein, 181 aa, Artificial Sequence; identical to SEQ ID NO: 5472
  Synthetic

SEQ ID NO: 5474 - protein, 174 aa, Artificial Sequence
  Synthetic
SRSEKLVDEARKMVERSKEIVDKSEREVEDVVRRARRNVEKVLKDAKKVVDEVDELTKRGTDKETLKERLREILERIERYIEESKKDLDRILEELERKHRENKERLRRILEKIRRDGVGEDVLREVEELVRRVEEENDRVLKRAKELVEDVKRKHDRVLETVRKLVEDVTRRLK

SEQ ID NO: 5475 - protein, 174 aa, Artificial Sequence; identical to SEQ ID NO: 5474
  Synthetic

SEQ ID NO: 5476 - protein, 174 aa, Artificial Sequence
  Synthetic
DEVDKVKEELERVIKEVDERNKRSSERLEEVNRKIRKEIKEVVERLKELIERVLRKVEGRREVKRLTDEVRKRVEDLRRKVEDVSRKSKEDNERSNRRSKELVKRVRELLKSARRREGVDEIRRLVEEVLRRARKLVEEDKELIKKSLKDLKTIVDELRKLLEDVIREAERTAR

SEQ ID NO: 5477 - protein, 174 aa, Artificial Sequence; identical to SEQ ID NO: 5476
  Synthetic

SEQ ID NO: 5478 - protein, 170 aa, Artificial Sequence
  Synthetic
EEVERILEDVRRMIEDHRRKVEEIVKRSEDMARRLIEEVKRIVEESKKLADELKKEDGSEELRRKIDKRHKESEELLKDIERKLEEVHRDSERRLKENKERIDRTREEVEKRGVDEDVRRELKRLVDEVKKRNDEVRERDKEVVDRVKEVLDRVRETDRRLVEEVRRRAN

SEQ ID NO: 5479 - protein, 170 aa, Artificial Sequence; identical to SEQ ID NO: 5478
  Synthetic

SEQ ID NO: 5480 - protein, 170 aa, Artificial Sequence
  Synthetic
SRVEKILEDVKEEIKKHKEEVDRIVKRSREMAKRHIERVDEILERSRRMIEELKKREGSEDLERELERVHRESEKLLRENEKRIKETHEKSKRDLDENRKAIARTEEEVRKAGVKEDVERELRRLVEEVEKRNEDVEREDRRLVEEVKKRNDEVRKEDRRLVEEVKERAR

SEQ ID NO: 5481 - protein, 170 aa, Artificial Sequence; identical to SEQ ID NO: 5480
  Synthetic

SEQ ID NO: 5482 - protein, 183 aa, Artificial Sequence
  Synthetic
DELEKVEKDVRRLLEKVRKRIDEVRKEVERLSRESEEVTRRVLETVEKLLKDVERVIRETLKDDDEKLRDLERLIREIREKVRRAVETDEERNKRLNDKLKKLLEDLEDKIRKLEEELRKAKETGKPVEEVLETVKRLIERIEEEIEKVVKDVERLVRESIKHSRDVLKEVDDLIKRIRERVK

SEQ ID NO: 5483 - protein, 183 aa, Artificial Sequence; identical to SEQ ID NO: 5482
  Synthetic

SEQ ID NO: 5484 - protein, 174 aa, Artificial Sequence
  Synthetic
DDDKRIREILRRVHEKSEKVLRKVRKRLEEVRRESEEVVRRVKKDLDRVLEEVRRKGVSEELLKELEKIIEDIERHLKKNRDDVERKVREIEKKLRKLLEDDRRVVKEIEEKLRSGDGREDVAREVEEIAKRTIDRVEAIVREVERIARESIDNVRRVVEEVKRAVTELIKRVE

SEQ ID NO: 5485 - protein, 174 aa, Artificial Sequence; identical to SEQ ID NO: 5484
  Synthetic

SEQ ID NO: 5486 - protein, 174 aa, Artificial Sequence
  Synthetic
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 5487 - protein, 174 aa, Artificial Sequence; identical to SEQ ID NO: 5486
  Synthetic

SEQ ID NO: 5488 - protein, 174 aa, Artificial Sequence
  Synthetic
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 5489 - protein, 174 aa, Artificial Sequence; identical to SEQ ID NO: 5488
  Synthetic

SEQ ID NO: 5490 - protein, 170 aa, Artificial Sequence
  Synthetic
DRLEKIVEEVRRLADELIRHVERNVREVEKAVRESIEHVRDVAEKVERAVRELEKREGSEDLDRELDRVRREIEELLKRNKDRITRVVDKSRRSSEENKRELKKVEDEVERRGISEEVRKELKRVIREVEKVNKESNDVTRKVKEESEKVLKEVEKRLREVIRRVKEKIR

SEQ ID NO: 5491 - protein, 170 aa, Artificial Sequence; identical to SEQ ID NO: 5490
  Synthetic

SEQ ID NO: 5492 - protein, 170 aa, Artificial Sequence
  Synthetic
SEVEDVVRKVEKLVRDLIKHVEENVRRVEEVVRKLIEEIKRIAEEITRIAEELAKEPGSEDLLRKLEKVLKEIDDKLKELEDRLRDMVRRSRESSEENERRLKRVEDEVRRNGISEEVEKVLREVVKEVEKVNRESREVTRRVLEEAKEMLERVKKIVKEVIEKVRRVVK

SEQ ID NO: 5493 - protein, 170 aa, Artificial Sequence; identical to SEQ ID NO: 5492
  Synthetic

SEQ ID NO: 5494 - protein, 184 aa, Artificial Sequence
  Synthetic
SADREVEERLREVIERVKEALKRSKDVTDEVTRRVEKLDKESNDTSREVIRRVEDMLSRVSDEDKVRRIKEELERVRRESEETSKKNKRELDEVRKDSRRTLEDIRRKLEEVERRIREELREVRDDELVKRIVEKVDKAVKDLEKLVRENVERVRRAVERSRKTVEDNVKRSRDVVRELRERVR

SEQ ID NO: 5495 - protein, 184 aa, Artificial Sequence; identical to SEQ ID NO: 5494
  Synthetic

SEQ ID NO: 5496 - protein, 184 aa, Artificial Sequence
  Synthetic
SSIDEVREEIRRVIEEVRKLLEESKKDTDRVRREAEDMDRKANETVEEVERRVREVLRSVSDERKVREIEKKLEDMLRELKKRSDDNKRRLEDLVRRSDKTLDEIREELERALREIEEVLEKVDKEEVVRRILKRIEEVLKKLRKAIKDNVDRVRDAVRRSRRTVEDIVRRVREVLERLEREIK

SEQ ID NO: 5497 - protein, 184 aa, Artificial Sequence; identical to SEQ ID NO: 5496
  Synthetic

SEQ ID NO: 5498 - protein, 175 aa, Artificial Sequence
  Synthetic
SLAEEVERRLEESHKRARKLVKEVKEALEESHKESDRLVREVEKELKRVAEEVRKEGIDEKRLKEIKELVDTIRKEIKEVLDEDRRTVKEIKEEVEKIVEDLERLHREIRKEIEKVKEAVEKVRDLVRKTTEKVEEVVRRLRELVKENLDEAKRVVEDLKRKVKEIEEKVKEDSK

SEQ ID NO: 5499 - protein, 175 aa, Artificial Sequence; identical to SEQ ID NO: 5498
  Synthetic

SEQ ID NO: 5500 - protein, 178 aa, Artificial Sequence
  Synthetic
SMAEKVDEVSKRSKEELKRVVKEVHEVSTRVEKVVKDVLREVEKVSKESTDVVDRVGVDSETLKDLKRRDKELLDRIRDKLRRMLEDLRRLNKEAEDLIRRLETEDEKLLRDIRRKVRGREVVDKVVRDLEKTVKDVKEVVDRAVTASKELVDRIRRLAEEVVRALERTVDKVRRDAK

SEQ ID NO: 5501 - protein, 178 aa, Artificial Sequence; identical to SEQ ID NO: 5500
  Synthetic

SEQ ID NO: 5502 - protein, 178 aa, Artificial Sequence
  Synthetic
DAREEVDEVSRESKEELKRVLDEVDDVSEKSRKTVRDMLRKNKEVVDEVEKTLEDVGVDSRKVDELRKRIKTLSRKSEEDVRKLLKRDEDLLRRIREEVKRLLDEDEKLLKDIRDKVRGKEVVKDVVRKLRETVKRVREVAEEVVRELEKTVDEVRKRADDSVKKHRDLVKEVKEAAD

SEQ ID NO: 5503 - protein, 178 aa, Artificial Sequence; identical to SEQ ID NO: 5502
  Synthetic

SEQ ID NO: 5504 - protein, 178 aa, Artificial Sequence
  Synthetic
SAEEDVERVVREVEREVREALRRVREVSERSREDVRRVVDENRKVAEEVEKRVRDVEVDSEDLRKLLEDIRRVSEESERLARELLKEDEDLLRRIEDTVRRLLERLKDLLEDIRNKVRGEEVVREVVKKLREIVKDIRRLAEEVVRRLEDTVRKVREIAKRSVDAHRELVRRVEERAR

SEQ ID NO: 5505 - protein, 178 aa, Artificial Sequence; identical to SEQ ID NO: 5504
  Synthetic

SEQ ID NO: 5506 - protein, 174 aa, Artificial Sequence
  Synthetic
SSAEEVERVLRRVEEEDRRLVAEVRRVLKESRRTLEELVRRVKEVLEEVRKEVERIEVSEEVLREIEELLERLDRELDEVLKESEDTLRAIEKKLEEVHRRTKKLLDELREVLERGKDAKELIKRVEEIVEESRKLIDEAIREVEENVDRSRKKIKELIDRVREILKRARDRAR

SEQ ID NO: 5507 - protein, 174 aa, Artificial Sequence; identical to SEQ ID NO: 5506
  Synthetic

SEQ ID NO: 5508 - protein, 174 aa, Artificial Sequence
  Synthetic
DSEEEVKKVLDEVRRRDEKLVEEVRKVNEDSLDTLRKLAEEVKRKLDEVRERVERLEVSEDVLRRIEELLKDLKRRLEEVLRKSEETLRRNKEEIEKTHKDTRDELKELEELIKAGKDAEELIREVERIVKKSEDMIREHIRKVEENVEESKKEIEELIRRVDDILREAKEAAD

SEQ ID NO: 5509 - protein, 174 aa, Artificial Sequence; identical to SEQ ID NO: 5508
  Synthetic

SEQ ID NO: 5510 - protein, 174 aa, Artificial Sequence
  Synthetic
SGEEDLERVLDEVRRRDKKLVEEVRKRNEDSLRRLERLAEEVERVNEDVLKKVEELRVSEEVLKEIEEELRRNKEAIKRTLKRSKETLDKNERDIERTHERTKKKLDEIRELIKAGKDASEVRKLVEEIVTDSRRRITEHIRRVEENAKDSERVIREHKERVKEILEKVRRAAE

SEQ ID NO: 5511 - protein, 174 aa, Artificial Sequence; identical to SEQ ID NO: 5510
  Synthetic

SEQ ID NO: 5512 - protein, 181 aa, Artificial Sequence
  Synthetic
SEVEKLVEDVKKAVKEVLEEAKENVRKVEDVVRRVLERAEDNVEEVKKVVATLVDLVRRGDRRERLEERAKRINDESRKHLDKLERDVERMSKESEKHLRELEKKVEEILKEVEDRLSRVDGEELMREVRRVIKEVRDRVRDVLDEVRRVNEEVNRRVRKVLEDVRRVNERTKEDLDRESK

SEQ ID NO: 5513 - protein, 181 aa, Artificial Sequence; identical to SEQ ID NO: 5512
  Synthetic

SEQ ID NO: 5514 - protein, 181 aa, Artificial Sequence
  Synthetic
SEVDKLVREVDELVKKSKDNIDKLVKRVREMVEESKRKADRNVEEVERVVREIKDLARRGDRDERLRREVRRRNEESRRHLEKNKKESDDMLKEVKDHLDRNLKESEEELKRVEDKLKDVRGDELVKKVRDRLEEVERRTRKALEDVKRVLEDVKRLTDTALREVERVNRKTEEEVDREIR

SEQ ID NO: 5515 - protein, 181 aa, Artificial Sequence; identical to SEQ ID NO: 5514
  Synthetic

SEQ ID NO: 5516 - protein, 181 aa, Artificial Sequence
  Synthetic
DKVDRVVKEIEEAVKENLDRVREIVKEVRDLVRENLEEVRKSVEDVKRLVKEILELVRAGVPEEDLKRTLDEVVKRSEESLKRLKEHTERVEERLDRLLRELKKHTDDVKRRVEELRKDSTDEDAVRKVEEVLREVEKRSTEALKELRDVLREVRRESEEALDENRRVTEEVKKKVEDERK

SEQ ID NO: 5517 - protein, 181 aa, Artificial Sequence; identical to SEQ ID NO: 5516
  Synthetic

SEQ ID NO: 5518 - protein, 181 aa, Artificial Sequence
  Synthetic
SEVEEIVREIRDLVRKNEERVKKIVEDVRRAVEEILELAERSVEKVKRLVDDLRRLAENGVPREKLREDLRKIVEESKESLRRLERKLEEVKDTLRRLLEELKEHTDRVARRLEELRRRTTDEEAVRKVDRVLEEVEKRSRDALKELEEVLKEVERLAREVLEKNERVTEAVEDLVTKAAK

SEQ ID NO: 5519 - protein, 181 aa, Artificial Sequence; identical to SEQ ID NO: 5518
  Synthetic

SEQ ID NO: 5520 - protein, 178 aa, Artificial Sequence
  Synthetic
DEEERVREELERVNEEVKELKKEVETVNKRVHETLEKVIREVKKVNDDVHRTVEDLRRRGLLTEEVIRDLERASRESEDELRKVREKLRRASEESRDKLREVEERHEKLSRDIEEELRAGGDVEEIVKKIKEVVDRTRKLAKELVKESRDLAEDVKRLIKRLVEDSRRLVEEIKERAR

SEQ ID NO: 5521 - protein, 178 aa, Artificial Sequence; identical to SEQ ID NO: 5520
  Synthetic

SEQ ID NO: 5522 - protein, 178 aa, Artificial Sequence
  Synthetic
SEEERVEKRLREVNKDVKRLVKKVRDVNRKVHEDTKRLVEEVRRVNRDVHRRVKELREAGKLDEEVIKDLEKASEDSKRELEKVVRESEDSSRRSEEKLRRVEERHKRLSEEIRRKLESGGDVDKIVEEIDKVVTETRELAERLVKESEDNVERSRDLARKLVEKSERLVKEIDDRAR

SEQ ID NO: 5523 - protein, 178 aa, Artificial Sequence; identical to SEQ ID NO: 5522
  Synthetic

SEQ ID NO: 5524 - protein, 178 aa, Artificial Sequence
  Synthetic
SAAEKVREELERVNRRVEELLKKVKKVNEEVRDIVRKVVREVERVNKEVEEEVKRLVDQGRATEEVKKTVDKLSEDSRRKLKEAIEELEKRSRESEKELEDVKREHDRLSEEIERELESGGDVEEIVKKIKDVVKRTDELAERLVETSERLARTIKKVAEDLVRDSKRIVDEVRTRIT

SEQ ID NO: 5525 - protein, 178 aa, Artificial Sequence; identical to SEQ ID NO: 5524
  Synthetic

SEQ ID NO: 5526 - protein, 178 aa, Artificial Sequence
  Synthetic
SDEDRVRRRLEEVNREVEELLRDVERVNEEVKRRVKKVIREVEEVNKRVEEEVKRLRDEGRLDDKDIKRLKEASDKSREDLKRVEEKVEKLSRDNKKKLDDVKRRHDELSKRIDEELKSGGDVEDIVRKIDDVVRETRELAKELVKHVRDVVEDVRRLVKELVDLSEKLVKEIRDKVE

SEQ ID NO: 5527 - protein, 178 aa, Artificial Sequence; identical to SEQ ID NO: 5526
  Synthetic

SEQ ID NO: 5528 - protein, 182 aa, Artificial Sequence
  Synthetic
SEVEKVVKEMEDLARENERLAREIVKDVERLVREIEDTVRRSVETTRRLVEEIRELAERGVDERELERFLKEIEERNRKSREDLDRLLEKIERKVRKVDRDSDRSLERIRRRIDDVRRKINSDERVLELLERVLRELEKVVEDSKRRIKEVLDELRKAVDKVKKEDKKVHDELRKVVEEVRT

SEQ ID NO: 5529 - protein, 182 aa, Artificial Sequence; identical to SEQ ID NO: 5528
  Synthetic

SEQ ID NO: 5530 - protein, 185 aa, Artificial Sequence
  Synthetic
RVEELLRKVITELDRVLEEVRRRNEASIEELDRVLKEVERLNKEVDEELKKVLEKVRKDVSDEKKVRELEREVREISRRNEKLLRELREEVKRIKERNKRLLEELERTARRIKKRLEDLLRKLKDVEEVVRRIVEEIKKVIDELREESRRTVREVEKLVKEILDRSRKTVEEVKRLAEEIERKAK

SEQ ID NO: 5531 - protein, 185 aa, Artificial Sequence; identical to SEQ ID NO: 5530
  Synthetic

SEQ ID NO: 5532 - protein, 178 aa, Artificial Sequence
  Synthetic
RVKELVDEVKRKVEESMRESTERNRTATEKVEKSLRDSEKLNRDATRKLKKVVDDVRREGRVPEEVERRVKEILDKNNEDMKKVLEETRRILKDNNEELKRVLKETRDLLKELDDEVRETKIDEEVVKKVEDVVERNKDLVRKSVEHIDKVVKENRELVKRSVEHIDRVVKEARERAR

SEQ ID NO: 5533 - protein, 178 aa, Artificial Sequence; identical to SEQ ID NO: 5532
  Synthetic

SEQ ID NO: 5534 - protein, 178 aa, Artificial Sequence
  Synthetic
SAEELVKRVLDDVRRSAEESERLNREATEEVKRSLEKSRKDAERVLRDLERVVRKVKTEGAVSDEVVKEIEDIVRELRKEAEKVHRETEKLLKDNNDDARRVHEETKELLERLRREVRETRIDERVVRKVEAVVERNRKLVEDSVRHIREVVKRNEDLVRRLVEEVKRVVKKAEDKAR

SEQ ID NO: 5535 - protein, 178 aa, Artificial Sequence; identical to SEQ ID NO: 5534
  Synthetic

SEQ ID NO: 5536 - protein, 178 aa, Artificial Sequence
  Synthetic
DVEELVKKVEDMVRKVIEEVKKRNTDVTRRVEESLRKSTELVREAEERLRRTLEELRRRGLAPEELVERLRRLLERVKREVERVHEETKRLLKRNNEDMKRVVEELKKLLDRLREEVRDTRISEEVVRKAEEVVKRAKELVARSVKHVDEVVRRNEELVTRLVRELDELVKEVRETAR

SEQ ID NO: 5537 - protein, 178 aa, Artificial Sequence; identical to SEQ ID NO: 5536
  Synthetic

SEQ ID NO: 5538 - protein, 178 aa, Artificial Sequence
  Synthetic
RAERLVREVARRLEEVLKEVEKLNKDATDKVKKSLEDSRKKNEDVTREVRRVIEELRTRGDISKDVVKRIEDILRENNRRIAEVHRETKELLKRNNDEARKVKKKAKEDLERLTREVRDTKIDEDVVRRAEELVERLRKIAEDSVRHLEEVVRKNERLVKESVDHVRTAVEELKETAR

SEQ ID NO: 5539 - protein, 178 aa, Artificial Sequence; identical to SEQ ID NO: 5538
  Synthetic

SEQ ID NO: 5540 - protein, 178 aa, Artificial Sequence
  Synthetic
DAEEKVKEVEREVEKVIEEVKRDNTRVTEENKRVLDTVRERNKRVTDELRKVLEDVRREGSVPEEVVRRAEEILKRNNDEVREVLRESERRLRENNERMKRVEDDIRKLTKELREEVRDTKIDEEVVKRIADVVKTVKRRVDESVKDIKRSVKETEDRVDRSVRHVEEVLKELRKASE

SEQ ID NO: 5541 - protein, 178 aa, Artificial Sequence; identical to SEQ ID NO: 5540
  Synthetic

SEQ ID NO: 5542 - protein, 178 aa, Artificial Sequence
  Synthetic
SAEDKVRKVKKEVEKVIKDVKEENRRVTRENEEVLDRVKKDNERATRKLRKVVEDVRREGRVPEEVVRKVTEELRENNKRMKEVLDKSRKKLEENNKRVDEVVEELRKLLEDLDREVRDTKIDERVVERIKRVVERVDELVRRSVKDVKDSVRETRKLVDDSVKDIDRVVKEARDRAK

SEQ ID NO: 5543 - protein, 178 aa, Artificial Sequence; identical to SEQ ID NO: 5542
  Synthetic

SEQ ID NO: 5544 - protein, 178 aa, Artificial Sequence
  Synthetic
DAKDKVRKVLEEVKKVIEEVERRNRTVTRENERVLKEVKDRNTEVTKELKKVVEDVKRRGDVPEEVEDDIRRKVEKNNRDVEKVLDDSRRLLEENNKKAEDVKRKLEDELRKLEEEVRRTKIDEEVVDRVRRVVEEVTELVRRSVEEIKESVKTTRDLVRKSVKNIRDLVEEAKRRAD

SEQ ID NO: 5545 - protein, 178 aa, Artificial Sequence; identical to SEQ ID NO: 5544
  Synthetic

SEQ ID NO: 5546 - protein, 174 aa, Artificial Sequence
  Synthetic
DEVETVVRDVKRLVRENERKVREIVKTVDKLVKENEDLVKRSVEELKKLAKEIKDLADEGVDKRELDEVLKRIRERSERSKRESDRTLEKITRDIERVKRESRKSLEDVRKRLEDFPESEDLRRVKKEAEDVVRDSERLIEEVKRRVKKVVDDSRRKDEEALRDVERVIEEVRR

SEQ ID NO: 5547 - protein, 174 aa, Artificial Sequence; identical to SEQ ID NO: 5546
  Synthetic

SEQ ID NO: 5548 - protein, 174 aa, Artificial Sequence
  Synthetic
SEVDDVVRRVKKLVKEDRDLVRDSVRKLDELVRDDKRLVDEVVERLERIVKEIEDLMREGVDERTLREVLKKAEEVVRESKERHDTTLERVKDVVRRSREEHKRTLDEAKKEIDRVPRSEKLEEVLKMLEKVSDEVKKENDRALKKVEDVSREVKELNKEVLKRARDVVERVRT

SEQ ID NO: 5549 - protein, 174 aa, Artificial Sequence; identical to SEQ ID NO: 5548
  Synthetic

SEQ ID NO: 5550 - protein, 178 aa, Artificial Sequence
  Synthetic
SSKEKVKKVLDKVKEVLDRVRELVKRVDRESEKVVEDVRRKNKRASEKVKTVIRDVEEKKQVPEKVVKEVEELLKRNNDTMKRVVDESKKTLDKLREEVKRVREDIKRLLRELEDVVDRGKDVDDVLRKVEEIVRKVKDMVRKILEKAERNVEETERVVTESKENADRIVKEVEDRAR

SEQ ID NO: 5551 - protein, 178 aa, Artificial Sequence; identical to SEQ ID NO: 5550
  Synthetic

SEQ ID NO: 5552 - protein, 178 aa, Artificial Sequence
  Synthetic
SAREAVTEVLRKVREVLKRVEDENRKVSKELRDLLEEVERRNRDLTEKVKRLIDELKERGRIDDKAVRDLEKLLEDNNRDVKRLLEEIDKLIKDNNKKVEKVLREIRRLLERLEDVVDRGVDVERILEEAERIVKELEEVLEESLRNVKEILKKLEDALRKSEEDVRRILERVEEEAR

SEQ ID NO: 5553 - protein, 178 aa, Artificial Sequence; identical to SEQ ID NO: 5552
  Synthetic

SEQ ID NO: 5554 - protein, 178 aa, Artificial Sequence
  Synthetic
REVEEVLRRIKEMVKRIEELVRRSEDRAKKLVDTNRDLVRRSEERFRELVKEIEDVAREGVDEKELDKIRKKVKKESDKSKRTLEESLERVEEDSKRVEDELERILREIKEEVDRMREEGVDVEELERVLREVEKVVRDVRRRNEKATRDVRRSVEESRRLDKRALDEVRKRIEEVRT

SEQ ID NO: 5555 - protein, 178 aa, Artificial Sequence; identical to SEQ ID NO: 5554
  Synthetic

SEQ ID NO: 5556 - protein, 174 aa, Artificial Sequence
  Synthetic
RVEEVLKRVLDKLRESNKDSERLVREALKEHEEVNKEVEDRIREVLRRVEEVLKKVEKDKGRDKELEKIRKVLKDLADEVRELLKRLNDVLDRIRKEVKKLSDESNELIKELERANLPAEDIKRLVDEIVDTDRKLVEEVKREAKESVKESEELVERVKRKADRIVEEVEKTVK

SEQ ID NO: 5557 - protein, 174 aa, Artificial Sequence; identical to SEQ ID NO: 5556
  Synthetic

SEQ ID NO: 5558 - protein, 174 aa, Artificial Sequence
  Synthetic
DEVEEVRKTIERLVDRIEDVVRRVLELSRDTVRKNEDLVRRIEEELTKLVEDIKDVSRKREPEEVIETLAREAERILEEVKRLDEESKRESEKKLEEIKRELEELAEELKRISDSVERAELLEEVERLLEEVLRKAEKVIEDARKLDEDVNRKSNKVIEDVARRLEKVLKEVKD

SEQ ID NO: 5559 - protein, 174 aa, Artificial Sequence; identical to SEQ ID NO: 5558
  Synthetic

SEQ ID NO: 5560 - protein, 177 aa, Artificial Sequence
  Synthetic
SVEDVIRRVKEKSEEVLKRLKEVIDEVKKRSEDVLKEVEDAIDEVRRRSEEALDRVRRAGLDKKDLERLRRHSEELVKRVRKLLEDLRDHSRKLVEEVRKLLEDLRDHSRKLVERARRERKSEEARDLADRDVEDVERVVTDIRRLVEKNVRDVRRVVREIEDAVRRNVKEIDRRVK

SEQ ID NO: 5561 - protein, 177 aa, Artificial Sequence; identical to SEQ ID NO: 5560
  Synthetic

SEQ ID NO: 5562 - protein, 177 aa, Artificial Sequence
  Synthetic
SVEELIERVKRRSEKVLRDAEKTIRDLKKDSKRVNDELEKVIRDVMEKSKTALDEVRRRGVPKEVLERLERSSRKIKRDVEKLSEDNRRHSEELERRVEELLRKLKKHSEELEEEARRKRVSEEARRLVERDVEDVKRLVEEIKKLVTDNVRTVEDLVRRIKREAEENVKEIKEEVR

SEQ ID NO: 5563 - protein, 177 aa, Artificial Sequence; identical to SEQ ID NO: 5562
  Synthetic

SEQ ID NO: 5564 - protein, 178 aa, Artificial Sequence
  Synthetic
SDVDRAVETNDKVVTEIVERVKEVVERNREIVERISTTVDEMVRRNRDIVRRVAERVSDKEKVDRVVKHVEDTVRTIRDLVRRIREHVRRTVERIRKLAEEITERSKRLSDEIRKVGSDKDVRDLVREVLERSDELVKRVEEEVKRLLERNKKLLDDVTEAAARLLKRNKEVVEELDK

SEQ ID NO: 5565 - protein, 178 aa, Artificial Sequence; identical to SEQ ID NO: 5564
  Synthetic

SEQ ID NO: 5566 - protein, 178 aa, Artificial Sequence
  Synthetic
SEVDRVVEENDRVVRKVEEVVREAVERNETVAERVKDTVDRMVRENEKIVDKVRKDVKDKDKVDTVKKHVEKLVREVKELVERIVETSRDLSRKIKDLVDKVKERSKRLSEEIRRVGDEKDVEKLVRDVLRESEKLVDDVRRAVKKLLEDSEELVREVKEAAEESLRRNKKIVEDLTR

SEQ ID NO: 5567 - protein, 178 aa, Artificial Sequence; identical to SEQ ID NO: 5566
  Synthetic

SEQ ID NO: 5568 - protein, 170 aa, Artificial Sequence
  Synthetic
DELETVLREVERVVTEVKKLNERTVRDDKEVVERVLREIDKLLKEIREKVKEVKKKLRTEEVAERVVKEIKDRVDDIERRVDEALKESKRTVDESEREVKEMVERIEEMARRVKGEDVERTVRKLLEEIKDSVRKSKEDVRRSVEEIERLVRKVKEDVKRLLRDIRERAK

SEQ ID NO: 5569 - protein, 170 aa, Artificial Sequence; identical to SEQ ID NO: 5568
  Synthetic

SEQ ID NO: 5570 - protein, 185 aa, Artificial Sequence
  Synthetic
SKVEKALKKIEDVLEDIKRLVEEVVERDERLLERLEEENKRADEKSKELVKRLTDLVRENKGKEETVKRVVDRVTEEVKRVVDKTREVLKKIEDSSRRVLEEVERLLREVEKEVTDILDEIRKDNLREALERIREILEEVRKAVEDLLRKIKETLKRIRERVKRLIENLEKSLEDARKEVDRLRK

SEQ ID NO: 5571 - protein, 185 aa, Artificial Sequence; identical to SEQ ID NO: 5570
  Synthetic

SEQ ID NO: 5572 - protein, 177 aa, Artificial Sequence
  Synthetic
DVDERIEELLRRIERLVEESERDVRRLKREIDDLVTKSLKTVEESLKRIKELVDRVSEEAKDEDKVRTVKTKVDEALKRSKRTAEESKRLVDEARKEIEDVVKKSREIVKRVIDEIKKIRNKDDVERVVRRVLKEIDDSTKEIRRIVKRVLEEIERTTRDDKRVIDEVRELIKETSR

SEQ ID NO: 5573 - protein, 177 aa, Artificial Sequence; identical to SEQ ID NO: 5572
  Synthetic

SEQ ID NO: 5574 - protein, 178 aa, Artificial Sequence
  Synthetic
DADELVTEVRKRVRETLEEIRTILDEVRKRVKKTVEDIRTEAERVKREVDKLVKEVRDNNLPEEMVEKIRRMVDTVAREVEEAVKRSEDTLDRIRKLVEKVLDDSRKTLEEIEKLVKENKGKDREIEKLLDDNRRLIEEVLRRIDELVREDEELVKRVLDRIRTVLDRIREEVDEVRR

SEQ ID NO: 5575 - protein, 178 aa, Artificial Sequence; identical to SEQ ID NO: 5574
  Synthetic

SEQ ID NO: 5576 - protein, 178 aa, Artificial Sequence
  Synthetic
DVRELLKKVEDEVRRTLKEIERILKEVKTESDKTLKEVAELLERLDRDVKRLVKEVRDNNVPEEVVRRIEKVARDVKEEVKRLLKELERSVEELARRVKDALRKSARTLEEIRRLVEENQGKKEEIRKLVERNKELVRDVLRRIKELLKRDKEMLEEIRERIKEIEKRLKELLERAKR

SEQ ID NO: 5577 - protein, 178 aa, Artificial Sequence; identical to SEQ ID NO: 5576
  Synthetic

SEQ ID NO: 5578 - protein, 185 aa, Artificial Sequence
  Synthetic
SEIEEVLKRVEEMIRRSKKLTDKVLREVEKMIRELDKKTDEVLERSERLARELKELVRRDVPDSEKVERIREKIDRLVKESRDSVKKNKDENREIVRRVRDLVRENKERLDKVLEDVDREVKRVRRRERIEEILRRVTEAIKRSKEDSERIRETVTRLIRESEENSKRNLERVKKVIDELREEIR

SEQ ID NO: 5579 - protein, 185 aa, Artificial Sequence; identical to SEQ ID NO: 5578
  Synthetic

SEQ ID NO: 5580 - protein, 185 aa, Artificial Sequence
  Synthetic
DKLEEVLKRVEEMLRELDKETDDVLKTVEDLLRRLDELTDEVLKESRRAAEELKRKVDRDIDRSERAERIKRKIEELVKESERSVEENKRRNREVLDRVTKLAKRNKERNREVLKRIAEDVKDIRREEKIREIEKKARKLIKDSRKNIRDILETVKRLIEESDKNIKENEKRVRKVIDELDKEIK

SEQ ID NO: 5581 - protein, 185 aa, Artificial Sequence; identical to SEQ ID NO: 5580
  Synthetic

SEQ ID NO: 5582 - protein, 182 aa, Artificial Sequence
  Synthetic
REKEEIIKKVKDVVKRVKEELKKIVEESERLVREVEEELKRSNEKSRDLVRRAEEELEKKSTDKDVRERVKEIVKDLRRLLREDKRLVEEILKRLRELLERDRRTIEEILKELEDLLRRIEESDRREEELDRLIKRVEDRARKVLEDSKRTIEEIEKVARDVLRRSEETVKEVEEKARRALK

SEQ ID NO: 5583 - protein, 182 aa, Artificial Sequence; identical to SEQ ID NO: 5582
  Synthetic

SEQ ID NO: 5584 - protein, 189 aa, Artificial Sequence
  Synthetic
SAVEEIVKEVERIVREAEKALKKSVDDNRRIVEDAVRTLKRLVEEAARLVDEARKELTKKSTTEDVERRVREIVRDLERLLEEVEKRVEDIIEELKKSLEESERHTREVVKKLRELLEEIKRVVTEKGTDEDVLRELKRLLKELERVVEEVLRRDRKWLEDTRREVKRVVEELKRLLDELREVVERARR

SEQ ID NO: 5585 - protein, 189 aa, Artificial Sequence; identical to SEQ ID NO: 5584
  Synthetic

SEQ ID NO: 5586 - protein, 185 aa, Artificial Sequence
  Synthetic
KELEDLVREIEDTVDRIEREIRKLVEDDHRSVRKAEEDNRRLVKESEDLVRRIEEEIRKKETTEEVKERAERVIRELRELLKRNREIVERSIRKLEDINRRSKEIADRVIEELRRLLKEVRKVVKDGVDEEVMRRLKEDIERLMEEIRREVEKLNETTKEVVKESLETHKRIIERIREVAEETRR

SEQ ID NO: 5587 - protein, 185 aa, Artificial Sequence; identical to SEQ ID NO: 5586
  Synthetic

SEQ ID NO: 5588 - protein, 175 aa, Artificial Sequence
  Synthetic
SSLEELLKEIRKRVERIKEELDRALKEDHDIVRKALRELDEMLKKNEETVRRAMERIKDKREVIKELEDSLRKSEEIVRRLKETLKRSNEDSERLVREIKKKLEELARTIEDLVRRGVPEDVVRKVLEELEEEARRVLRELRESLKRTEELVRRALETLKRSDEETKKLVEDIER

SEQ ID NO: 5589 - protein, 175 aa, Artificial Sequence; identical to SEQ ID NO: 5588
  Synthetic

SEQ ID NO: 5590 - protein, 175 aa, Artificial Sequence
  Synthetic
SSLEELIKEDHRVVREAEKRLEELLKEDHDRLREAKEELERVLKRDHETLKEVVERIREKREVIEELKRSNEESRRLVEDAKRRLDESNERSEEIVRRLKEELKRSNDDSRRVVEEGVPEEVLKKIIERTRDLVRRALRTMEESIKRTEELVKKLLDELEASIRKTEEDADRIRK

SEQ ID NO: 5591 - protein, 175 aa, Artificial Sequence; identical to SEQ ID NO: 5590
  Synthetic

SEQ ID NO: 5592 - protein, 175 aa, Artificial Sequence
  Synthetic
SSLERLIEEDHETVRRVKKTLDDMLKRDHEVVDEARRRLDELLKRDTDIVRDAVKRIRDKREVIERLRESNDDSRRIVEEIKKTLKRSNEKSKRIVEELKRRLEESNERSRDVVRKGVPEEVLKKIIKETKELAKEAVERLEESIKETEDLVRRVLKEMEESLRRTEELVREIER

SEQ ID NO: 5593 - protein, 175 aa, Artificial Sequence; identical to SEQ ID NO: 5592
  Synthetic

SEQ ID NO: 5594 - protein, 180 aa, Artificial Sequence
  Synthetic
SIEEVIERIREEAERLLKELEEVNRESTRLAEDLREELRRVLENSRALVKELKERIRKESLLKEVDELAKRLTEEHERLLREVEDIMRKVNKHDTELLRTVEELMKEVKRRLEELRRRNVDDKSLKELLRDVERKIREVRKRLKESLERVEREIRRVREEIKRLNDESRERIERVKRRVD

SEQ ID NO: 5595 - protein, 180 aa, Artificial Sequence; identical to SEQ ID NO: 5594
  Synthetic

SEQ ID NO: 5596 - protein, 176 aa, Artificial Sequence
  Synthetic
DAEELLRRLDKSSKETLKRNEESLRRSEETSKRSLDTNRRSLEKIEKIATDLRRKLSERKIRELLKRIEEILRKVAEDVRRNSEHNKRLLDRSRENVRRISEHNRKLLEELAELAKRGDVDERVVREAEKLDEDNTRHSRRNLEESKRLDEENIKRSEDLLRDVRRLIEEVLEEAR

SEQ ID NO: 5597 - protein, 176 aa, Artificial Sequence; identical to SEQ ID NO: 5596
  Synthetic

SEQ ID NO: 5598 - protein, 188 aa, Artificial Sequence
  Synthetic
SKLDEILERAKKLIDDLRKESDDVLRRDRELIERIRRKSEEVLERVKRLIEELEDRVRKVRDEDLKRKLEEEVKKILEDVDDVIRRITEEIRRTARESEKVIEDISRKIDEVLDRLRKLIEELRKESDEDEVRRVLRELERLVKELKDKNKESLDELKKTNDRLEEENRESLRRAREEARRILEEIRR

SEQ ID NO: 5599 - protein, 188 aa, Artificial Sequence; identical to SEQ ID NO: 5598
  Synthetic

SEQ ID NO: 5600 - protein, 188 aa, Artificial Sequence
  Synthetic
DELEEILKRVEKLIRDSIEKIRRILEEDRELIKELIKESREVLERVRELIKTLEKKVKDVDKEELKKRLEDEVRKVEEDVRRLIEEITRKIEKTLRESKKKADEDKEENKKILDEVRELIRDLREKTDRRTVEEVLKRIEELVKRSLEESDRVAKEVRKTNEEVKKTNEDSLRKIKELVKRILEKIRK

SEQ ID NO: 5601 - protein, 188 aa, Artificial Sequence; identical to SEQ ID NO: 5600
  Synthetic

SEQ ID NO: 5602 - protein, 188 aa, Artificial Sequence
  Synthetic
DELEDVLREVRKLIKELEKKSREVLKRDKELIDRIRKESEEVLKRVEDVLRKLEDEVRKVREERLKEELKKKVERVLREVERLIKEISDKIRKTLKESRDVIREISEEIKDILRRAREKARDLADKSDKRRVDEVLEEIERRVTELNKKNEESLRRAEKTNKELDEENKESLERIRKLIEDILRKIEK

SEQ ID NO: 5603 - protein, 188 aa, Artificial Sequence; identical to SEQ ID NO: 5602
  Synthetic

SEQ ID NO: 5604 - protein, 188 aa, Artificial Sequence
  Synthetic
DELERILEEVKRRIERLIERLREVLERDKKLIEDIRRESEDVLRRVEEVIKKIREELERIRDRRLREELMKKIEKLLREVDKVIKDISEKIRRTLERSREVIERLKEEVEKVLREVEDMIRKLAERSDRETVKDVLRKLRKIADEVRRDIERVLDEARKTNKRLDEENKDSLKKLRDRAKELLDEVRR

SEQ ID NO: 5605 - protein, 188 aa, Artificial Sequence; identical to SEQ ID NO: 5604
  Synthetic

SEQ ID NO: 5606 - protein, 174 aa, Artificial Sequence
  Synthetic
RELEEVLKEAEKLIREITEEVKEALRRDEKTVRDNIRDLRRVLEEVRKLIEEILDRVRRRGPRDELERDVERIADKVRRAITRSRKHVEDSVRTTKEMIDRLRRKVEKILTEVRKKIDSKFLERLEELITRLKERIDKALRDLEKTNDELRKRSEEVLRRLERLLERLREEIRR

SEQ ID NO: 5607 - protein, 174 aa, Artificial Sequence; identical to SEQ ID NO: 5606
  Synthetic

SEQ ID NO: 5608 - protein, 172 aa, Artificial Sequence
  Synthetic
SEVERVLEDSRRTNEEIIKRLRDALRESEKTNRDIEKRLREMLKKSKETNERIKRSDRDKDELKKLVEKDKKEVEDALKDLEDLVREDKERVDEALERMRKLVEDDKEALERRIKDKKVLDKARELVRRTEEIVKDVIRKSRELVKESKERVDRVITESRRVVKKTLDDIRK

SEQ ID NO: 5609 - protein, 172 aa, Artificial Sequence; identical to SEQ ID NO: 5608
  Synthetic

SEQ ID NO: 5610 - protein, 172 aa, Artificial Sequence
  Synthetic
SEIEEALKRSKETNERIIRKLEEVLRRSRKTNEEIIRRVERVLEDSERTNREIEKSDRRKEEVAKLVDDDRRKVEKALEEARRLVEEDKERVEKALRDMRELVKEDKERLDRTIKGEEFLRTVKKLVDDTRKAVEEVITRSRRLVEESERRVREVIDRMRKLVEETKRKLDK

SEQ ID NO: 5611 - protein, 172 aa, Artificial Sequence; identical to SEQ ID NO: 5610
  Synthetic

SEQ ID NO: 5612 - protein, 172 aa, Artificial Sequence
  Synthetic
SEIEKALKESEDTNRKIKDDLRKVAERVRKLIEDVIRTLERVLRDSERTNREITRSDRDKDELRKLVERDRERVEKVLRDAKRLVRTIKEDIRRALEEMKKLVEEDEEKVKKKIKDEDVLRKAKRLVDETLKEVERVIRELEKLVEDLEETVKEVIKRSRELVDETEKRIRD

SEQ ID NO: 5613 - protein, 172 aa, Artificial Sequence; identical to SEQ ID NO: 5612
  Synthetic

SEQ ID NO: 5614 - protein, 172 aa, Artificial Sequence
  Synthetic
EEIERALKKSEETNRDIIRKLREVNERDKRAVERDEEELKKALDESRKTNEDIRKSDREKEELRKLVEEDRKRVEKVLTDSKRTNEELLRHSEDVLRKLRKLVKEDEKRLKDEIKDKDVLETVRKLVEDTLREVERVITHSLKRVEDTLRKAKEIADRMRTLVRKTLEDIER

SEQ ID NO: 5615 - protein, 172 aa, Artificial Sequence; identical to SEQ ID NO: 5614
  Synthetic

SEQ ID NO: 5616 - protein, 172 aa, Artificial Sequence
  Synthetic
DEVERVLEKSKRTNEDIIRRLEEVNKTDRKLVEDDIRRLEKALRDARKTNEEIRTSDRDKDLLRKLVEDDKKRVKDVLRESRKTNDDLRRHSEKALEEARRLVDEDRERLEREIKDEDVLRKVRELVERTKERVERVIDHSRKVVETTLREVERVIREIEELSKDSERKIRK

SEQ ID NO: 5617 - protein, 172 aa, Artificial Sequence; identical to SEQ ID NO: 5616
  Synthetic

SEQ ID NO: 5618 - protein, 172 aa, Artificial Sequence
  Synthetic
SDAERALKESEDTNREIIEKLERVNKRDKDIVDKIREDLKRVLERVRDTNRRIRESDRRKEELKELVERDKERIEDALRRLEELVKRLEDHSRELLKDAERLVRTDDELVKRRIKDERVLREVKRLIDETKRIVDEVIKHSKEEIDKLREEVERVIKELRELSDKSLDDIRK

SEQ ID NO: 5619 - protein, 172 aa, Artificial Sequence; identical to SEQ ID NO: 5618
  Synthetic

SEQ ID NO: 5620 - protein, 172 aa, Artificial Sequence
  Synthetic
KEIEDVLKKSEDTNRRIIERLRKANDTDRRLIEDTIRKLREVLKEAEKTNKDIKDSDRDTSVLRELVRRDERRVEEVAREMHKLNEDIREHSERVLRELRRLVEEDRDRVRREIKDEDVLRTVEELIERTEREVERVIAHSEDLIRRSNEDVKRVIKTIRELSEDSKRAADK

SEQ ID NO: 5621 - protein, 172 aa, Artificial Sequence; identical to SEQ ID NO: 5620
  Synthetic

SEQ ID NO: 5622 - protein, 174 aa, Artificial Sequence
  Synthetic
DEERVLKELEDLLREILKDIERTVRESRKLVKTILDEIEEVARHNRKLIEEIRREVKKKEVLDEVEEALRRSVKNLEDILREVERLVREDEEKNRKLVEDITRIADTLVKVLEAGTRDLKELLETVRRVIEEVKKVLKRSLEESKKVIDDVRRHLEKNNRDIKTVIDRVREKAK

SEQ ID NO: 5623 - protein, 174 aa, Artificial Sequence; identical to SEQ ID NO: 5622
  Synthetic

SEQ ID NO: 5624 - protein, 174 aa, Artificial Sequence
  Synthetic
SVEEVVEEVKRLIEEVEKTNKKTVEDSKRLIDDIRRRIEEVMRHNRELIKKIEREVTKEEVVRKIRDVLRKSEENLKELLREITERVKKDEKDNEENLRRTRELLEEMERLARAGTIDLRELLERVRRLVEESKRNAEESLRRSEKVIKEATDHLRRNNETIKRVIDRVREEAK

SEQ ID NO: 5625 - protein, 174 aa, Artificial Sequence; identical to SEQ ID NO: 5624
  Synthetic

SEQ ID NO: 5626 - protein, 174 aa, Artificial Sequence
  Synthetic
DTERVLKTLRDLIDTILKRNEEILRHNEKLSRDSKRRIEEVARHNRDLARRVEEEVTKEEVVRKAREMMKRSLRNLEELLKEDDKVLRDSLRHVEENLRRTEKLLRELEELLEAGKRDLRKLLEDVKEIIKTSKENVDRNNDRIRRVVERSEKHLEDNNRDVKRVVDEVREEAR

SEQ ID NO: 5627 - protein, 174 aa, Artificial Sequence; identical to SEQ ID NO: 5626
  Synthetic

SEQ ID NO: 5628 - protein, 174 aa, Artificial Sequence
  Synthetic
KEEEDIKREIEKRITEIKKKNEEVLRRVEELIKRIHELNKRIEDTIDEEIRRIEDLVRRGTDKEDLKRRVKEIEDRVRRLIEDSRKKIKDIEEEVKDLARRSRKEIKEIKDEVRKKVDDDVLRKLKRLLDEIIKHSEDVLRKIKELLDEIKRDSDRVFKKLKELLDRIAREIEK

SEQ ID NO: 5629 - protein, 174 aa, Artificial Sequence; identical to SEQ ID NO: 5628
  Synthetic

SEQ ID NO: 5630 - protein, 174 aa, Artificial Sequence
  Synthetic
RELEEIDRKIKKLIEDIHRENRDILRRIRELIERIKKKNEDILREVRKLIKEIEDLVREGAPKEELKKRIEDIMRRVEKLAKESRDEIDRILEEVERLAERSRRKIDKIMEDVKREVDDKVLKKLEDLLREIKKDSDRVLEEARKLLEEIKRHSDEVLEEIKKLLDDIKKRVET

SEQ ID NO: 5631 - protein, 174 aa, Artificial Sequence; identical to SEQ ID NO: 5630
  Synthetic

SEQ ID NO: 5632 - protein, 174 aa, Artificial Sequence
  Synthetic
SELEKIDDEIRKLIEDIHRLNREIARRNEKTIREIRKKNEDVLRRNKRSADEIDRLVKEGVDKRELRKEIKKSNDESRELIDRSRKEIKKSNDETRRLAEESRKLIEDIRREVERRIDSEALRKLKRLLEEIERDSRRVLDELHKTDEDIERHSREVEDRAHKTDKTIKDRVET

SEQ ID NO: 5633 - protein, 174 aa, Artificial Sequence; identical to SEQ ID NO: 5632
  Synthetic

SEQ ID NO: 5634 - protein, 174 aa, Artificial Sequence
  Synthetic
SEDEKILEEVRREIERIHEENRKVRERIERLIREIHKLNREVLERNKESIEEIRRLVEEGAPKEELRKTVRKSNEDSKRLAKESKDRIDEIEREVEKLIRDSEREIERIEEEVRRKIDSKFLEDIERLLREIDKDSKRVLEELKRLLDEIRKDSDRVLKTAHDTDDKILKDIDK

SEQ ID NO: 5635 - protein, 174 aa, Artificial Sequence; identical to SEQ ID NO: 5634
  Synthetic

SEQ ID NO: 5636 - protein, 174 aa, Artificial Sequence
  Synthetic
KEEDEVREEIKRRIEEIARLNKEIEDEIRELIKRIHELNREILKKVRKLIEEIEDLVRKGVPKEELRKRIEDIRRDVERLLRESEDRIRRIEERVDRLLKDSRDKIDRIKEEVKKKVDSEVLRELDELLRRIKKNSEDVARKLKDLLRRIREDSERVAKEIRRLVEEIKKKVDK

SEQ ID NO: 5637 - protein, 174 aa, Artificial Sequence; identical to SEQ ID NO: 5636
  Synthetic

SEQ ID NO: 5638 - protein, 182 aa, Artificial Sequence
  Synthetic
DEVKRIVDEVRRLVEKVHRVNEEVVKESEDLVREVHRKNKRVLDESERLVEEVERVLKRDVSDRRKVEELVEELRRLNEETRRAVKRSSEELKRINDETRRELEDNSRKLKEVLDRVEKELRKGNGDERVLRTAEEVIRRLEKHSKDLLDTSRRLAEEILRKSDDLLRRSKEKIDDLKRKIK

SEQ ID NO: 5639 - protein, 182 aa, Artificial Sequence; identical to SEQ ID NO: 5638
  Synthetic

SEQ ID NO: 5640 - protein, 182 aa, Artificial Sequence
  Synthetic
SEVDRIKEEVRKLLEEHHKRNEDIVREVTRLLEEHHKKNEEVVRESEKLVKKIREILRDRVRDEDKVRDLERRVERLNRETRRELTESSEEARELVKRVTDELRKSSKELTDVVRDVERLLDEGRGDERVLEEARKVVRELNRRSEELLKRARELVERLDRKSEELLRKSERIIKKIEEDIR

SEQ ID NO: 5641 - protein, 182 aa, Artificial Sequence; identical to SEQ ID NO: 5640
  Synthetic

SEQ ID NO: 5642 - protein, 182 aa, Artificial Sequence
  Synthetic
KEVEEIVRDVRRLVEEHHRENRKIVETVEDLVRKVHRENKRVVEESERLVDELTKILRDTLSDKDRVDDLKKKVDEINEETRRHVERNSREAEKLLRDVEKEVRKSSERLRDLERRVRKLLRDGRGDEEVLKRVREAIRRLNEDSKRLLKEARDVVERIKRNSDKALEESKRKLKEIEERIK

SEQ ID NO: 5643 - protein, 182 aa, Artificial Sequence; identical to SEQ ID NO: 5642
  Synthetic

SEQ ID NO: 5644 - protein, 178 aa, Artificial Sequence
  Synthetic
SKMEEVRRRIKEEADRDEEDNRRVLEDIRRLIEENKRRNEEVLKRIEKKARDLLERIKKDGRTEEIERLLRELEREVDEAVKRSEKNNRDSNRKIEELAKRSRERNRTTNEDIKEVLRRGEIKEEIIKEVSTLNEKLKRDTDEILKEVTRLNERLKEETDRILEEVKKLIDKVRKAVE

SEQ ID NO: 5645 - protein, 178 aa, Artificial Sequence; identical to SEQ ID NO: 5644
  Synthetic

SEQ ID NO: 5646 - protein, 178 aa, Artificial Sequence
  Synthetic
KEADDVKRRLDDLIRRNEEKIRDVRRRVKELVDRNRKKIKEVLDKVKEIIDRLKDEIDKTGRDEKIEKKLEDVRREVTEAVKRSREDNRRSNEEVRRLVEDSRRNNKKSNDEVREVLRRGEIEERIIEEVTRENDRLRKESDRVLDEVSKLNDEARKETDDVLKTVDELVREVAEKAK

SEQ ID NO: 5647 - protein, 178 aa, Artificial Sequence; identical to SEQ ID NO: 5646
  Synthetic

SEQ ID NO: 5648 - protein, 185 aa, Artificial Sequence
  Synthetic
SDAERLLETVRRIAKRLKELNEEVLREAKRIIDRVREENERSRETIREIMKKLKEDIDRIGGRDEEDLRKLLEDAKRIIEEILRRNEELLKEIEKEVDTVLKKNERLLERAEEEVRRMIEEIRTRDGPGVDEILRDVERLLEEVRRSVKESTRRIKRLLDEVRKSVKESTKEIKKLLKDVEDAAR

SEQ ID NO: 5649 - protein, 185 aa, Artificial Sequence; identical to SEQ ID NO: 5648
  Synthetic

SEQ ID NO: 5650 - protein, 185 aa, Artificial Sequence
  Synthetic
KDIEDLRRRIEEIIEEAKRLDKTSLELIRRIIKRIKDENKKMLDEAEKIIRDALKTIDDVGGRDEEELRRLLRKAEEDVRDVDRRNEKLMRDVDKEVAEVLERNKRLLDEIRKRVERVIEDIERRRGPGVEDVTRRIEELLEEVRKSSEDSIRDIRRLLKEVRDSFKRSSDELKRLLDEVRKRAE

SEQ ID NO: 5651 - protein, 185 aa, Artificial Sequence; identical to SEQ ID NO: 5650
  Synthetic

SEQ ID NO: 5652 - protein, 185 aa, Artificial Sequence
  Synthetic
RELEEVVKELRRLLEEVRKRVEDSIKRLDELLDEVRRSNKKSSEDTRKLLKELEDEARKVMERVPDERVRRVLDELRKLVDDNHRENEEISRRMKELVDRSRKHVEEVLRRLEELVKRIEDELRKGERDVREVREEIERIVTKARKVVKEDDDLVKRIVAEARRLSKESEEKVREIVKRAEEKVR

SEQ ID NO: 5653 - protein, 185 aa, Artificial Sequence; identical to SEQ ID NO: 5652
  Synthetic

SEQ ID NO: 5654 - protein, 174 aa, Artificial Sequence
  Synthetic
DEVEELREELERLLKESEDRLREVKKRSDDSLKESRELIKKVRDTLERLLREVEDKVEDERIVEKVRKAVEEVERHLRENEKTIARVVEETRRLLKRNLDEARRVVEEVRELLKRNKDVETVAREVRERVERSKRHIEKVLKEDEEMVRESKKNIEDLLRRVKEDIDRLKEEVD

SEQ ID NO: 5655 - protein, 174 aa, Artificial Sequence; identical to SEQ ID NO: 5654
  Synthetic

SEQ ID NO: 5656 - protein, 174 aa, Artificial Sequence
  Synthetic
SKADRLREELDRLLKEVKELNERSKRESDRSLEEIKRLIEKVERESEKTLREVRAKVDDERIVREAEKIVRETKEELKRLEKRVEEVVRRTKKANDDNLKAVTDMVRRVRDLLARNVDIDTVVEEVKKLIKEILDHIRELVEDDKRKIKEILEEIKKLAEDDRRKVEEVKRKVD

SEQ ID NO: 5657 - protein, 174 aa, Artificial Sequence; identical to SEQ ID NO: 5656
  Synthetic

SEQ ID NO: 5658 - protein, 174 aa, Artificial Sequence
  Synthetic
SDVEDLKKKLDELLEEVERTSREVRKTSERSLEEVEKLLRRVKEESKRLLEEVERDIKDESIIDEVRRLVERSEENLREILRRITKVVEDTERRLKESLDEAREVVERVRDLLERNVDVKKVLDDVKKLVDDVKRKDKKLLDDDRRRVEEALEHIKRNLDRSRDLIRRIKEKAK

SEQ ID NO: 5659 - protein, 174 aa, Artificial Sequence; identical to SEQ ID NO: 5658
  Synthetic

SEQ ID NO: 5660 - protein, 174 aa, Artificial Sequence
  Synthetic
DEVKKLKDDLDRLLDEIRRKIEKVRKDSEDSLKRVEELIRRVEEESRRLLEDVKREISDEEIIREAKKAVEESKKNLDDIRREVKRIVEETERLLKKLDDDLKRVVERVKELLDRNKDIKKVLDDVRREIRRIDEEIKRVEEEDRRMVTELLKHIERNLERSKRLADEVKEKAR

SEQ ID NO: 5661 - protein, 174 aa, Artificial Sequence; identical to SEQ ID NO: 5660
  Synthetic

SEQ ID NO: 5662 - protein, 174 aa, Artificial Sequence
  Synthetic
KEVDELRKALKELLDEVRETSKRVLDETRRLLEEVRRELERVKRESDETLKRIKDRVKDKRLIEEVKRVVEKTRRDLRKIEDEVRRAVEESKKNLDESIKTVEKVVREVKELLDRDRDVDTVLEDVKRKIDELKEHDKRNLDESRRLITELLERIKKLAEDDRRVIEEIERRIQ

SEQ ID NO: 5663 - protein, 174 aa, Artificial Sequence; identical to SEQ ID NO: 5662
  Synthetic

SEQ ID NO: 5664 - protein, 184 aa, Artificial Sequence
  Synthetic
KTMDEIKKEVTDLVRRIRELNERVERTVEDLVRKSRRLNERVLREVERLVKEVRDALRDKDEKDAKRIKDKLDEILRRVKKVLDDNSRHTDKVLEEVRKLLEDDTRELDRILEEVDDVIKKVGKDDETLEKVVDDVRKRIKRSKEHSDEVLEDAKKKIDENLEHSRRVLEEAKKLIDDLKDEIR

SEQ ID NO: 5665 - protein, 184 aa, Artificial Sequence; identical to SEQ ID NO: 5664
  Synthetic

SEQ ID NO: 5666 - protein, 184 aa, Artificial Sequence
  Synthetic
EKAERIIEEVTDLVRRVRETTKTVKEEVRKLVERSKRRNEEIRREVKELVDEVEKKLREKDEKDARRIRKELKEVLDRVDKLLTDDSRKVEEIRREVEERLDESRKRIEKILKDVEDLLRKIGTDKDALEKVRRDVERLIRELEKTDRDVLEEVKKLIEESERNSDRILEEVRRIIEELKKKIK

SEQ ID NO: 5667 - protein, 184 aa, Artificial Sequence; identical to SEQ ID NO: 5666
  Synthetic

SEQ ID NO: 5668 - protein, 184 aa, Artificial Sequence
  Synthetic
SVVDEIRERVERLLREVEKTTEELRDTVRKLVEESEELTKRIEDEVRKLVEKVRRELRRKREDEVTRIRKELEDILKEVKRLLDENRDKVRRVLERAKRLLEDSKRRLDEIVERVRDLLEKIGTDEDKLREVLEEVKERIDRLKELDKKILEDVKRLVKESKEELKDILRRARKLIRDLEEKIK

SEQ ID NO: 5669 - protein, 184 aa, Artificial Sequence; identical to SEQ ID NO: 5668
  Synthetic

SEQ ID NO: 5670 - protein, 184 aa, Artificial Sequence
  Synthetic
SEVEKMLKELKELVERALERDKDALRKLRDLVRESLERDKRMVDKLDELVKEIEDRIRKRKESREDVKRLLKRLREELDKIRKENEELVRRLKEELERIKEENKKLLEELKKRLEDAVRKVGKDKREKVDKIRRDVKRLLDESRESLERSEKDVEKLLEDSRDSLRKSKKRVEELVKRVEEALK

SEQ ID NO: 5671 - protein, 184 aa, Artificial Sequence; identical to SEQ ID NO: 5670
  Synthetic

SEQ ID NO: 5672 - protein, 184 aa, Artificial Sequence
  Synthetic
REVEEALKESTDTIKKILDDDRKAMDELKKLVDKSLEDDKRAVDRLRELVKEIKKIIKKRKDLEEKVKELLRRLEEELRKIEEENRRLVEELKRKLEEIKKKNEKLVRDNEERLKEVVERMGKDKKEDVDRIEEESRRLNEESRDSLRKSEDTVRKLLEESKESLDRSRREVEKLLKEVEDALR

SEQ ID NO: 5673 - protein, 184 aa, Artificial Sequence; identical to SEQ ID NO: 5672
  Synthetic

SEQ ID NO: 5674 - protein, 185 aa, Artificial Sequence
  Synthetic
SELEELDREVEELVERSKRTNERVVEESKRLVDESRRDIDRLLEEVRKLVKDILERIKEEGGESEKAEKEVRDLIRRIKELLDEIRKRVERSNEENEKLLRENKKLDEKSVRDLEDVARKIAKRVRSEDVRRLLEKIERLIEESNRSLERSREESERLSKESEDRLRELEKTVKELLKRVEEALR

SEQ ID NO: 5675 - protein, 185 aa, Artificial Sequence; identical to SEQ ID NO: 5674
  Synthetic

SEQ ID NO: 5676 - protein, 185 aa, Artificial Sequence
  Synthetic
DEIRELLKKAEELVERSLRDNEKVVDELKKLVDESLRRIREMLKRAEDEVRKILEDIERKGGESDDAKRRVEKAIREIEDLLDKVRREVEKSNEELKRVLDENRRRDRESVERLRKELEDVERRIRSDEVDTLRRTVDKLVKDSNRSLEESKRTLEDLIRRSKEELDKLEKDVRRLLDEVRKALK

SEQ ID NO: 5677 - protein, 185 aa, Artificial Sequence; identical to SEQ ID NO: 5676
  Synthetic

SEQ ID NO: 5678 - protein, 174 aa, Artificial Sequence
  Synthetic
DELEDAMRRVEEMAERSERNIRRSIRKVEELVTRSKKNIEDSLREVEKVAREAEELLRRNVDTDEVVKRVEEVVERIKRHNDENNKTSDRLVKEIEKENRENNKRTEEVVRDVARRVTGEEVKRRLDELLKRVTDLDRDSEKKLRELLEEVTKLDKESKDRLDELLEKVRRDRE

SEQ ID NO: 5679 - protein, 174 aa, Artificial Sequence; identical to SEQ ID NO: 5678
  Synthetic

SEQ ID NO: 5680 - protein, 178 aa, Artificial Sequence
  Synthetic
SEVDKLLDRLTKLAKRSIDEARRLVERDREVLEKSIRDAEKLVERDEKVLEDIKRLIEREGPSEELLKRVEDVVRRSREDLEELLKRSKEVVKRSDEALRRLLERSKDVVREVEDELRKKNLDETVRRLVTELNKASKKVVDDVRRESEKSNRDSEDVVRKVKKASDKSLEDVERDIR

SEQ ID NO: 5681 - protein, 178 aa, Artificial Sequence; identical to SEQ ID NO: 5680
  Synthetic

SEQ ID NO: 5682 - protein, 181 aa, Artificial Sequence
  Synthetic
EEVERIVERLKRLAEEDSREIKEVMDRNRESVRRILKRIKDIVEELRRLVEEIKKKIEKDGPTEEVEKRVKELEERVDEEVKKLKELVKRNHDEVRRVLERSRDTVRRIREDVERVAREISDKEKVERLEKDIRRLEKESEDALRRLEDTSKRTDDEIERAIEELERTITDLVREIRERVR

SEQ ID NO: 5683 - protein, 181 aa, Artificial Sequence; identical to SEQ ID NO: 5682
  Synthetic

SEQ ID NO: 5684 - protein, 182 aa, Artificial Sequence
  Synthetic
REVDEIRKELDDRVREIKKRIEEAVEDSRRTVEEIKRRVEEVDKTDRKLVEDIKREIDRRKDAREKVERLLEELKTHSDDSERRIRELIREDEETVRRVLEEIRKLIRDLEEKVKRVEKDISDRKKAEELRDRVRKLVEEIERLLEELRRTLEKTRREIERVVEENRRSVEELIREIKERVD

SEQ ID NO: 5685 - protein, 182 aa, Artificial Sequence; identical to SEQ ID NO: 5684
  Synthetic

SEQ ID NO: 5686 - protein, 174 aa, Artificial Sequence
  Synthetic
DDERRVKEEIKRILTEAKKVIDENKRRSEEVLDRVRKLVKENKDENDEVLKTVDELVRRGSPKEEVLRRVEELLERSKRKIKEVLDRVTKLNEESKRHSDEVLEKVERDLRRLAEEARIEEVRKELKRVLDEVRRLVKETEETDRTSNRTVAELAKDLEKKTDDIEREVRKKVT

SEQ ID NO: 5687 - protein, 174 aa, Artificial Sequence; identical to SEQ ID NO: 5686
  Synthetic

SEQ ID NO: 5688 - protein, 186 aa, Artificial Sequence
  Synthetic
DRVERILKKIEDALRKVEELIRRNKKKIDDVLDEVRRLVEESKKRIDEILDEVRDRITKLKDDEKVVREIEKEVRRLIEEARKDDERTNRKVKKEVEESERDNERSNREVDKVIRDIKREIERDIGGKKEAKRLKDLLDTVRETVKRLNDELRKRSEEVLRRVDKLNKESKKRLDEVLRTVREELR

SEQ ID NO: 5689 - protein, 186 aa, Artificial Sequence; identical to SEQ ID NO: 5688
  Synthetic

SEQ ID NO: 5690 - protein, 182 aa, Artificial Sequence
  Synthetic
REIEEVKKENDKSLKEIEKIIREVKEENKRSLDKIKRIIERALEEIKRMLEKAKKLADEGVDRSVVEKAIKDIERLLEEIRKEVERVLEENEELLRRIERRVKEVIKKDKKLMEDVARKLKELDKFLTEVKRSFEKSVEDIKRLLKEVSESVKRSTDEIRRLLDEVRRAVEEVLRRIRELLR

SEQ ID NO: 5691 - protein, 182 aa, Artificial Sequence; identical to SEQ ID NO: 5690
  Synthetic

SEQ ID NO: 5692 - protein, 179 aa, Artificial Sequence
  Synthetic
SLVEELRRVVEEVRKTLEELVKRLEDSVRRSAEEIRKLIEDAERSVRESERAVKETGDGKILEEAKELVERSERKVRKLLRDLERLVEESEREVRRIADEVRRVLDDLRRKIEDLERKRVTKEIKELLEEIKEMLRRLKKKAEDIDRTNRELEKEVRELVERLLRDNRRLLKEVVERAK

SEQ ID NO: 5693 - protein, 179 aa, Artificial Sequence; identical to SEQ ID NO: 5692
  Synthetic

SEQ ID NO: 5694 - protein, 179 aa, Artificial Sequence
  Synthetic
DKIEEAKKNVDESKRRVEELIRELRESVERSKRDVERLVRELEESVERSLETVKRDGDSRILREAERLVEESEKKIRELLRRAEKLVEDSARKIEELLREAEELVKESEDLIRDLERKNVTKEVKELLKRNSDLLRRVEELVKKLDKENRDLLRKVREDAKKLLKENEDLLEKVKRDAR

SEQ ID NO: 5695 - protein, 179 aa, Artificial Sequence; identical to SEQ ID NO: 5694
  Synthetic

SEQ ID NO: 5696 - protein, 179 aa, Artificial Sequence
  Synthetic
DEIEKAEKNVRDSRREVERVVKKLKESVDKSREEVERLVRELERSVEESRRLVEERGDSKILKEAKDLVDESRKEIEELLRRAEELVRRSEEEIRRLLKRARELVKESRDRIEELAKRGVTKEVDRLLERNSRLLEEVEERAKELDERNKKLLEEVRRRAEEVDKRNKDLLRTVDRRAR

SEQ ID NO: 5697 - protein, 179 aa, Artificial Sequence; identical to SEQ ID NO: 5696
  Synthetic

SEQ ID NO: 5698 - protein, 179 aa, Artificial Sequence
  Synthetic
SLIEEARENVKDSKKKVKELVDRLRKSVEESRERVREVVRRLRESVDTSADAVRKAGDSRILEEAKRLVDTSRKKIDDLLREAEELVKRSADKIKRLLEEATKLVEKSRRDIEKLAKDGVTEAVKRLLEENSKLLADVADEARKLNEENERLLREVEKKAKKLDDENRKLLEEVIETVR

SEQ ID NO: 5699 - protein, 179 aa, Artificial Sequence; identical to SEQ ID NO: 5698
  Synthetic

SEQ ID NO: 5700 - protein, 179 aa, Artificial Sequence
  Synthetic
DEIEELKKNVEDSRREIDRLIKELKESVEKSRKDVEKVVKELRESVKDSLDKLEKTGDSEILKEVRRLVERSEREIERLLEEARRLVDTSREEIDRLLKKARKLVEESERKIEDLRRKGVTKEIKELLKENSDLLERVREEAETLDRKNKELLERVKRKADRLNEENRRLLKEVIEKAR

SEQ ID NO: 5701 - protein, 179 aa, Artificial Sequence; identical to SEQ ID NO: 5700
  Synthetic

SEQ ID NO: 5702 - protein, 181 aa, Artificial Sequence
  Synthetic
SEVEKLLRDLERLLEEIVKEAEDLDRENKERLKEIARKARELNEENKDLLRRVKELVDRNVDKDTLRDEVRKAVEDTKRRVDDLLRDVKRVADETKKKVDELLERVERVLRRVKEEVRRIDDERLVREVERVIREVRKRVEEVVRKVEESIKESEERVKELVKRVTDSLERSKKEVEDAIR

SEQ ID NO: 5703 - protein, 181 aa, Artificial Sequence; identical to SEQ ID NO: 5702
  Synthetic

SEQ ID NO: 5704 - protein, 181 aa, Artificial Sequence
  Synthetic
SEVEELLKRLEDILRENERRARELNRKNKEVLKDNRRRAEEVNRRNKRMLDEAERLAEDNVDKRELLERVKKVARETRELVKDLLRHSEKVVRDTRKVVEDILRHSEEVAERVRREVKKISDEKLVREVETKIEEVRRRSEELVKEVEKSLKESEDDSRRLVREIEESIRESEERIKRRVE

SEQ ID NO: 5705 - protein, 181 aa, Artificial Sequence; identical to SEQ ID NO: 5704
  Synthetic

SEQ ID NO: 5706 - protein, 178 aa, Artificial Sequence
  Synthetic
DEVEEILEKSRRTLEENKRRAKEAVRRSRETLRESEERVKRVVEELRDRLRRIEEEPRRREEIRKVLEELARDVERVLKELEELSKRDEDEVKRVIDENRKSLDKDRRDVEKVIREIQDEDALRKIKKVLDETETESRRTLEELRKVLEETHRRNEKLIRDLREVLKEIEEAVRRREK

SEQ ID NO: 5707 - protein, 178 aa, Artificial Sequence; identical to SEQ ID NO: 5706
  Synthetic

SEQ ID NO: 5708 - protein, 178 aa, Artificial Sequence
  Synthetic
DEVEEALRRLEDLLRRNVEEAKEVVKDSERTLREDAERVKRVVEKSKRTLEAIEKRDLRRELIKEVLDKDREDVDRVLKDSKRTLEEDKERVKRALERNKKSLEDISRRVEDVIRKVTDEEAVRRIEEVLKKIREDSKRTIDELRRVLERTEEETRRLIKELEDVLRRTEEEVKRRLK

SEQ ID NO: 5709 - protein, 178 aa, Artificial Sequence; identical to SEQ ID NO: 5708
  Synthetic

SEQ ID NO: 5710 - protein, 186 aa, Artificial Sequence
  Synthetic
SEVEKVLEEIKRLLDRIKERVDETDRRNKELLKKIKDEVRRAVEEIRRLLEEIKKSADEKGGERKEVRDEAKRVLDRIRDLLRKLREEIERVLRESRKLNEESNKEIKDLLKEVEDRVEDIKRKIGDEKLVREVEEVVTRVRKTIEDLVKKDNDSVRKSEERIKEVVKRIEEEVKRVLEDVDRLAK

SEQ ID NO: 5711 - protein, 186 aa, Artificial Sequence; identical to SEQ ID NO: 5710
  Synthetic

SEQ ID NO: 5712 - protein, 177 aa, Artificial Sequence
  Synthetic
DEVRELLERNRRLLEEIKKTVKDLIRRNEELLKRIEDDAKRLIDRNEELLDELEKRLKDDRLIREAKERLKKSLEDVKRRVEEVKRRLEKSLEEVETIIREAEKRNRDSLREMERRVKGEELEELRRVVEESDETIKRLLEEAKESVDRSLDRIRKLLEDVRRSVERSKKRIDEKRK

SEQ ID NO: 5713 - protein, 177 aa, Artificial Sequence; identical to SEQ ID NO: 5712
  Synthetic

SEQ ID NO: 5714 - protein, 177 aa, Artificial Sequence
  Synthetic
DEVRKILKDIEDILREIEERVKRVIERNKRILEKIREDVKRVDDRNKKLLEELERKLKGRELIKRAKEELDRTLEDARRLIEEAKRTLDESLEDIRRLIEEVSRRIERLLEEIRRKVKGDDLRRVEEVAKRIKDRIRELLDEIRRSVERSKRDVKRLLDELRRSVEESKRRIDEREK

SEQ ID NO: 5715 - protein, 177 aa, Artificial Sequence; identical to SEQ ID NO: 5714
  Synthetic

SEQ ID NO: 5716 - protein, 177 aa, Artificial Sequence
  Synthetic
SEVDKLLRENEKLLEDIERTVKRMLERIKKLNDDVHREIRRIDEENRRLLDEIEKKVRDERMVREVTERLKRTLDEIRDIARKAAEEHDRLLEEAEKIIRDVREESDRSLEEIERKVKGRDLDRLRRVVEKSKKRIEELEREARKVAKDVKKNLEELLEEVKESVRESEKRIKETEK

SEQ ID NO: 5717 - protein, 177 aa, Artificial Sequence; identical to SEQ ID NO: 5716
  Synthetic

SEQ ID NO: 5718 - protein, 184 aa, Artificial Sequence
  Synthetic
SLKERIEEELKKVKDTSDRLNEEVRRSVEDTRKRSEDLNEEVRRSVEESRRRVESLLKRIEDEDKARELRKKVEKVARDTRRLIKEDKDRSDKMVRDTERLIEEDARESEKAVREVEELVRRVDKEEEVKKIIERIEEILERSERRNREIIKRDEEALKRSEERNREIIERDKEMLERLEREVR

SEQ ID NO: 5719 - protein, 184 aa, Artificial Sequence; identical to SEQ ID NO: 5718
  Synthetic

SEQ ID NO: 5720 - protein, 184 aa, Artificial Sequence
  Synthetic
SLIETIKEVVKRVAETSKRLNDRVREELRKVEREVEELNREVERVLREVETAVDDLVKKIEDEEKVRRVEELVREVAREVRELIKENKEEVDRIAKEVEELVETDKRDVDRVVREVEELLKRVRRREEAEDIIRKIEEVLKKSKELNDRIIERIKKMLEDLRRHNEEIIEKIRRALKRLEDEAR

SEQ ID NO: 5721 - protein, 184 aa, Artificial Sequence; identical to SEQ ID NO: 5720
  Synthetic

SEQ ID NO: 5722 - protein, 184 aa, Artificial Sequence
  Synthetic
SLKETIRELLKRVEEESRKLNEDVARSVRETKRRSDRLNEEVERSVRRSEEEVRRLLKRIEDEEKARRLADKVRRLVERTKKLIDEDRDEVRRVVEETKELIKDSKKKVDELSEEVERLVDKIDRKEKAEEIIRRIKEMLRRDEEENRRIIERDERALDKSRRLNEKIIEEDKKAMRDLEEEVK

SEQ ID NO: 5723 - protein, 184 aa, Artificial Sequence; identical to SEQ ID NO: 5722
  Synthetic

SEQ ID NO: 5724 - protein, 181 aa, Artificial Sequence
  Synthetic
SEVEEIIKENRRTLERDRREVEKVIEENKRSLEEIERKVREIIKDNDRSAKEITELAKAGVPRKDLKRFLEEDKRRVEKVLDELRKLLEEDRRKVEEALRKSEKTLREDERRAREVIRRIDDEELVDRLRKSLRDVREESKKLIDELRRSLEESDRRVKELIDRLRKSLDDSRKLVDDLRR

SEQ ID NO: 5725 - protein, 181 aa, Artificial Sequence; identical to SEQ ID NO: 5724
  Synthetic

SEQ ID NO: 5726 - protein, 181 aa, Artificial Sequence
  Synthetic
SEVEEIIKDNERTLEEIRKRVEDVIREIRRLLERIERRVREAIKRNEESLRRIKELVERGIDRRELEKLLRKDEEDVRRMLEELKRLLDEIRKRVKEAIDELERLLREDEKRADEVIRRIEDDELVRTLRESLRRVAEEVKRLLKEVEDVAREVEDRVKKLIEDLRRSLEKSREDVERDSK

SEQ ID NO: 5727 - protein, 181 aa, Artificial Sequence; identical to SEQ ID NO: 5726
  Synthetic

SEQ ID NO: 5728 - protein, 188 aa, Artificial Sequence
  Synthetic
DRVREIIKRLRDLLREIRTVVRKIIEDNRKSLEEIEEHNRRVIRELRELLKEIKETVEREGRNDEVKERLDELLRRLKKRVEEIVRRNEKLLEEDKRRIDEALEELERLLRRLKRVVEKAVDELAKENKEEMIRTVKKVITEIAEEVKRLADEVRDSVRRSEEAVRRLTKETKEVVDDIVRRVRELIE

SEQ ID NO: 5729 - protein, 188 aa, Artificial Sequence; identical to SEQ ID NO: 5728
  Synthetic

SEQ ID NO: 5730 - protein, 188 aa, Artificial Sequence
  Synthetic
KKVEEIIEELKKLLREIEEHNKRVIEENERSLEEIKRHNEEVIEELRELLERIEEVVKRKGKNERVVEELEKLARDLKKRAEEAVERNKRLLDEDRDRMRKVLERNERLLRRLRTRVEKVLRDLKRDRKEDMIRTVEDVVRRIERRVRELSRESEESIRRSTETVKKLTKDTRDVVRRILKTVRDRIK

SEQ ID NO: 5731 - protein, 188 aa, Artificial Sequence; identical to SEQ ID NO: 5730
  Synthetic

SEQ ID NO: 5732 - protein, 187 aa, Artificial Sequence
  Synthetic
SLEERLREVLKDIERRVRELNETNKRVLDKSKTTVDELLKRLREVLEEIREEVRKLIEELARRGKREVLEKIKKDLEELRKTVEEAIKEIERLLREDEKRVREALRDSERLLEELRERVRKAIEEVKGREMIEKVLRDLEELAKRIEDKNRETIKESEKTLEEIRRRVDRLLEELRRLLKEIAKEVK

SEQ ID NO: 5733 - protein, 187 aa, Artificial Sequence; identical to SEQ ID NO: 5732
  Synthetic

SEQ ID NO: 5734 - protein, 187 aa, Artificial Sequence
  Synthetic
SLEETLEKVLRDITERSERLIRENEKNLRDVKREVEKLNERNRDVLKKIREKVRELIEELRRKGKKEVLEEIEERLKRIEEEVRRALERSREILREIEKRNDETLKTSKDTLERIREEVEKISDKVKGEEAIRKVLEELKKLLEEDERRAKRVSEESKELLDRLAEDNERTIRKLERLLEELERRTK

SEQ ID NO: 5735 - protein, 187 aa, Artificial Sequence; identical to SEQ ID NO: 5734
  Synthetic

SEQ ID NO: 5736 - protein, 182 aa, Artificial Sequence
  Synthetic
SEVDKVLEELKKLLDDDRREVERLLRELRRLLDRDRREVEKSIRTLEKLLKEIEDIVRERKEAKEELRRLLEEIEDVSRKSLEDNEKTLRDIRRTVEKILRDNEKTARDIKKRVEEIERRIKDKRALERVREVLERAEDESRKLSERIKKVLEDIERESKRLSEEDREVLKRIKEEVERLEK

SEQ ID NO: 5737 - protein, 182 aa, Artificial Sequence; identical to SEQ ID NO: 5736
  Synthetic

SEQ ID NO: 5738 - protein, 182 aa, Artificial Sequence
  Synthetic
SEVDKVLEELKELLKRLEEDVKRSSKESEDLLRKDEEDVRRSIRELERLLEEIEERVRRRKDAKEELRRLLDDIRRKSEDSLRRNTETMEENRKKSEESLKRIEDAAREIAERVKDIERKIKDERALREVRKVLEDIKKSVDELLKEDKDNLRETARESERLSREDKKVLERIEERVKELED

SEQ ID NO: 5739 - protein, 182 aa, Artificial Sequence; identical to SEQ ID NO: 5738
  Synthetic

SEQ ID NO: 5740 - protein, 182 aa, Artificial Sequence
  Synthetic
SEVEKVIEELKKLADDDRRRVEKSLRELRKLLEELEKRVRDSLEKLKKLLKEIEDRVRRRKDMKEELRKLLEDIERESRKSLEDIKKMLEKIERKSRESLKENEETARRITRRVEDIERKIKDEKLLREVRKVLREARETSRELSRADEKVLRDIRREVKRALDADKKVLDDIRERVKELEK

SEQ ID NO: 5741 - protein, 182 aa, Artificial Sequence; identical to SEQ ID NO: 5740
  Synthetic

SEQ ID NO: 5742 - protein, 184 aa, Artificial Sequence
  Synthetic
DEVEKILKEIDDAVKDLKRKSDKSLTDDRRMVEELKKKSEESLREVEEMVRRLEDEASRTTDEEKLDRLRKKVETVERKIRKTIRDLEDDVRRIVETTKKTIKELKDKARKIVEDVKRLVDRLEDEKVVRRVRDILDKLRKTVERLVEENEDSARRTEETIRKLVKDNEDILRELRRLIEERRT

SEQ ID NO: 5743 - protein, 184 aa, Artificial Sequence; identical to SEQ ID NO: 5742
  Synthetic

SEQ ID NO: 5744 - protein, 182 aa, Artificial Sequence
  Synthetic
SEVEEMLERLKELLRRIEKVVRDSLRRLKELMRRDEEEVRRSLRRLEELLKEIERVARERKEVQEELERLLREVEKVVRTSTEKNKRSLEEIREVVRRSSERLKKLLEEVKRRVKEVLDRLGDKKVLDEVKELLERIEETVRRLIEENERVLEEAEELSRKLSEDNEKVLEDARREAERLTK

SEQ ID NO: 5745 - protein, 182 aa, Artificial Sequence; identical to SEQ ID NO: 5744
  Synthetic

SEQ ID NO: 5746 - protein, 182 aa, Artificial Sequence
  Synthetic
DEVEEVLKELEKLAREDEDRVRKSEKKLRELADKDREDVERSLRRLERLLEELKRVVEERKEVKEELERLLERIEEVVRKSTEDNKRSLEEIERVVRESSKENKDTLDRIRERVEDILRRLGDKDMLERVERLLREAEKLSEKLSRDNEDLLRRARDLSRELSKENERLLEDIRRRVEEAIK

SEQ ID NO: 5747 - protein, 182 aa, Artificial Sequence; identical to SEQ ID NO: 5746
  Synthetic

SEQ ID NO: 5748 - protein, 182 aa, Artificial Sequence
  Synthetic
REVEEVLERLKRLLDTLEREVRKSLEELKRLLDELRKESKKSLDELRKLAEELERVVRRLKEVTERLDELVRRIEKKVRDSIRRLKKLLEEIEKKVRDSSKKLEELLETIKRVVEEILRRLGDEKMLREVKRVLEEAERRVRELIEENKRLLKEIKEEVKKLIEENEKVLEEARRLAEELKK

SEQ ID NO: 5749 - protein, 182 aa, Artificial Sequence; identical to SEQ ID NO: 5748
  Synthetic

SEQ ID NO: 5750 - protein, 182 aa, Artificial Sequence
  Synthetic
DEVREVLKKLEKLADELREEVRKSLEDLKRLLREDEERSKESLKDLERLAREIEEVVKKKKEVEEELEKLLREVRKKVKESLDRNKKSLDDIRKRVKESSDKLRELLKRIKEEVEDILRKLGDEKALRDVEELLRRIEERVRRLIKENEDLLREIEKTSEKLSRDNKELLKEIEERVRRLRQ

SEQ ID NO: 5751 - protein, 182 aa, Artificial Sequence; identical to SEQ ID NO: 5750
  Synthetic

SEQ ID NO: 5752 - protein, 182 aa, Artificial Sequence
  Synthetic
DEVEEALKTLEELMRRDKEEVDKSLEKLRRLLKEDEDRSRESLERLKRLAEELEEVVKKEKEVKEKLKKLLDDIRRLVEESLERNKRSLEEIERTVRESSRKNKETLEEIKKVVDDVLRRLGDRRVLERVKKLLEDARRLSERLSEENERVLEEAKRRSEELSKRNEDLLREIEKKMKEDTR

SEQ ID NO: 5753 - protein, 182 aa, Artificial Sequence; identical to SEQ ID NO: 5752
  Synthetic

SEQ ID NO: 5754 - protein, 182 aa, Artificial Sequence
  Synthetic
SEVEKVLEELKKLADDLRRTSKRSEEELEKLARELEKRVRESEKRLRDLLRELEDVVRKKKEVKDELRELLKRIEDVVRRSTEELKKLLDDIRRRVKESIDTLRRLLEEIERRVKKILEDLGDKDALKRVKELLDRIREEVEKLIRRNEKLLRDIEEKVRTLLERNERVLEEIKKKVDDDIK

SEQ ID NO: 5755 - protein, 182 aa, Artificial Sequence; identical to SEQ ID NO: 5754
  Synthetic

SEQ ID NO: 5756 - protein, 182 aa, Artificial Sequence
  Synthetic
DEVREVLEELRRLMKELRDVSEKSLRDLRKLAEEDKDRVRKSLEKLRELLRTLEDVVRKRKEVREELDKLLEDIEREVRTSTKENKESLERIREVVERSVRKLERLLEEIKRVVDDILRKLGDEKMLREVEDLLRRAEKEVRRLIEENKKLLKEAEETSRKLSKENEDVLRDIRRAVEELKR

SEQ ID NO: 5757 - protein, 182 aa, Artificial Sequence; identical to SEQ ID NO: 5756
  Synthetic

SEQ ID NO: 5758 - protein, 182 aa, Artificial Sequence
  Synthetic
SEVEKALEDLERLAKELEKVSRESLRRLEKLLEDDRRRSKRSLEELEELLDRLRDTVRRRKEVKEELRKLLDRIRERVKESLDRNEESMREIKEVVDRSIDRLRRLLERIRRVVKKVEDDLGDEKALREVRDLLRRIEERVKKLIEDNRKLLEDARRESERLSEENKRVLEKIEREVKKLED

SEQ ID NO: 5759 - protein, 182 aa, Artificial Sequence; identical to SEQ ID NO: 5758
  Synthetic

SEQ ID NO: 5760 - protein, 182 aa, Artificial Sequence
  Synthetic
SRVEEVLKKLEDLLRRLEEVSERSLRELRELVKRLEDVVRRSEKKLKELADRIEEVVRRRKEVREELRELLKRVEDTVRRSNEELKKLLDEIRKKVEESIRTLKKLLDEIREEVERILRELGDKKALDDVRRLLEEIEKRVTELIERNRRLLEEAEDRVRKLLRDNEELLKRIEKLVRDLER

SEQ ID NO: 5761 - protein, 182 aa, Artificial Sequence; identical to SEQ ID NO: 5760
  Synthetic

SEQ ID NO: 5762 - protein, 182 aa, Artificial Sequence
  Synthetic
SRVEEVARKLEDLLRELKRVSDESLKTLEKLMTDDERRVRESLDKLRELAREIDEVVRRRKEDDEKLKRLLERVEEVVEKSNRDNRESLERIRKVVEESIRKLEKLLERIRREVKKIEEELGDEDALREVRRLLERAEELVRELIKRNEDVLREAKRTSDELSERNRRLLERIKETVDRKRK

SEQ ID NO: 5763 - protein, 182 aa, Artificial Sequence; identical to SEQ ID NO: 5762
  Synthetic

SEQ ID NO: 5764 - protein, 177 aa, Artificial Sequence
  Synthetic
REVEEILKRIEELLRRIKKLSEETLREIAKLLEDIKRLSEETLKSNKDLLKRVRDELRTEEAIKKVKEENDKNLKDSEKIIREVAERIKRALEKSREIIKKVKKEIEDLLDEARKKIDSRMLREIERIIKELKELVDKLLEDNERLIERLDREVKRLLEENEKSVREASREIDERRR

SEQ ID NO: 5765 - protein, 177 aa, Artificial Sequence; identical to SEQ ID NO: 5764
  Synthetic

SEQ ID NO: 5766 - protein, 177 aa, Artificial Sequence
  Synthetic
DEVEELLRRIERLVEEARRLVEELLETNKKLLKDIEKLSRDTLKSNEELLREVKDRVRTEELVRRVAERNRKNLEESERIIREVKRRNEENLREAERIIRELERLIKELEREVREKVDSEMLRRLETIIREAERDLRRLLKEARDSVKKVSDEIKRLLEENKRSVDRVSREIKRVEK

SEQ ID NO: 5767 - protein, 177 aa, Artificial Sequence; identical to SEQ ID NO: 5766
  Synthetic

SEQ ID NO: 5768 - protein, 181 aa, Artificial Sequence
  Synthetic
DEVEELLKEIRELIEEARRRIEELLKEDRDIVRRVTELSRRTLEKIKDLIRKIKDIADRNDKRERAVEKVAKEIKELKDESKKVIDDIDKLIKESDEKAKKLIEEMKKRIKELKDKVRRDVDSEMLRRLEELIKEIEDLVRKLLEELKRSVRETEERVRKLKEDNDELIKRIDELVKEREK

SEQ ID NO: 5769 - protein, 181 aa, Artificial Sequence; identical to SEQ ID NO: 5768
  Synthetic

SEQ ID NO: 5770 - protein, 185 aa, Artificial Sequence
  Synthetic
SSLDDLRRLAEELLRTNKKLMEDLRRTNEKLIKEIEDVLRRIRESSKRIKEEVDKLTRDVRGDEELKRVIDELRKKVEDNLERVKRLIDRLRELVDRNHERVKTLVDDSRKKLEDLRERVERLPIDRKVLERVKEAVDEVRRSVEESLRDAKRMDEETRKTVEDVRREVTKSVEDVKRRIDESRK

SEQ ID NO: 5771 - protein, 185 aa, Artificial Sequence; identical to SEQ ID NO: 5770
  Synthetic

SEQ ID NO: 5772 - protein, 184 aa, Artificial Sequence
  Synthetic
DEVDEVVREVERLLEELRKENDKSVEEDKRLVDKLREEVKRILEEVRKLLEDLARKAKEDKREKVVEELRREAKKILDDIRRVIEELKKKITEILERTREAIRRSEEAARKIVEDIERVASKLKDKDVLRKLREVIKEVERIAEEVVRKNKDSADKSRKIIEDVVRALKKVVDDVRKIAEDLSR

SEQ ID NO: 5773 - protein, 184 aa, Artificial Sequence; identical to SEQ ID NO: 5772
  Synthetic

SEQ ID NO: 5774 - protein, 181 aa, Artificial Sequence
  Synthetic
DEVEKAVRESEETVKDIRRRNDETVRRLRELAKRLKERNEESVRRLRDLLRRLDEEVARRGRREEVEKVLKRIKDEVRRTLEESRKILEDIERDIERSLRDSRRLVTEDLDRLDKLLRKTTDERVLRDIRRVMEDSERIVKEVLDRNRKVAEDVRRIVEEVLRVNEDVLRKIEKRVRELKK

SEQ ID NO: 5775 - protein, 181 aa, Artificial Sequence; identical to SEQ ID NO: 5774
  Synthetic

SEQ ID NO: 5776 - protein, 181 aa, Artificial Sequence
  Synthetic
SELEEIKKRVDRALEENNKLLKEIEERVRKSNRDNERLLKEIEDRVREVTERIKKVEEEGRDRSVLEKIVRKVLDDIRRVMEESEELNRRSNKEIRRVLEESRELLKRVREEIEEVLKKVTDEDVLKKIRDLAREVEENVRESERKIKKLAEDDNRSVAESLREIKRLADEVKRRVDEARK

SEQ ID NO: 5777 - protein, 181 aa, Artificial Sequence; identical to SEQ ID NO: 5776
  Synthetic

SEQ ID NO: 5778 - protein, 182 aa, Artificial Sequence
  Synthetic
SELEEVRKRVKDVNRKNKELLDEIERTVRELLEDDRRLVDEAKKELDTLLRDIERLRREGVDREVLDRVLKRVKEIADRVKELLDRSLERLRREIERLKELVERSREEIERLIRKVETELKDVEDALREIRRLLEEVRKSIEDSKRLIEELLRRLKKVTDESRKKVEDLLREVEREVREAKK

SEQ ID NO: 5779 - protein, 182 aa, Artificial Sequence; identical to SEQ ID NO: 5778
  Synthetic

SEQ ID NO: 5780 - protein, 182 aa, Artificial Sequence
  Synthetic
RELEEIEKELKRMLDENRRLLERIEEEVRRLNEDNRRLLEEIEKTVEDLLEKIRKLSKEGVPEEVLRRVLREVEKIIKDAKKLLETTAERIRTIIEEARKRSEESLRRVTEIVKEVLRKLKDVREALKRIEELLREIEEVVKRSKTEIERLLRELEESVRRSDERIERLLKRVKDVVDEEER

SEQ ID NO: 5781 - protein, 182 aa, Artificial Sequence; identical to SEQ ID NO: 5780
  Synthetic

SEQ ID NO: 5782 - protein, 182 aa, Artificial Sequence
  Synthetic
EKEKEITKTLEDLIRKNRKLLEEIERRVKEVLKRDRELLEEIERRVADMLRRIRDVLRKGVPEEVLDRLLKEVKRIADKARRDLDRSLDEIRRIAEEAKKRNRDSLEEVKRIVEKVATEVKDLREVLERIKRLLEKVEKVSTESAKRIEELLEEVKRVTDDSKRRVTELLREVERVVDEVRR

SEQ ID NO: 5783 - protein, 182 aa, Artificial Sequence; identical to SEQ ID NO: 5782
  Synthetic

SEQ ID NO: 5784 - protein, 180 aa, Artificial Sequence
  Synthetic
DTLRELAKKAKELDDRNRKLLETVEELVRRVNEKNKDLLRRVRELARELLDRLRKLAREGSGKALRDIKKEIDRLLEELRRLVKESADEIDEILKEARRLVDESREEIKRLLDEVRDKVEDEEVRRELERLVRKLEESVRKSRKDVEDLITELKKSVKESLKEIEDLVRRLREVVKEIER

SEQ ID NO: 5785 - protein, 180 aa, Artificial Sequence; identical to SEQ ID NO: 5784
  Synthetic

SEQ ID NO: 5786 - protein, 182 aa, Artificial Sequence
  Synthetic
EEVDRILKESEDTIREIRDRVRKMLETSKKTVEEIKRRVDRALERDKKLVEDLRERVERTGRDKEVEKIVTDILRHSRELVREIEKLITEDKREVERALEEIERLVREDEERVRRVVEELRELKEAVEKMRRIVRESREVVARIREDIKRVLDESDKVVKDLKRAADRSVEEVKKVVDDIKK

SEQ ID NO: 5787 - protein, 182 aa, Artificial Sequence; identical to SEQ ID NO: 5786
  Synthetic

SEQ ID NO: 5788 - protein, 184 aa, Artificial Sequence
  Synthetic
SELERLKETSKDTIKKIKDLLRELKKTVDDVIERDKTLLDDLREKVERVIRRIEELLKRTRDDRLLEKILREIKEALKKLEEDVRKILKENKDALRELEDRVRKIKDDNRKALRRLEEEVARLKDEKVRDEIRKLIETNKRVADRVEEEVRKLIEDSERSLRKSEKDVKELIKKVEEVMEEVRR

SEQ ID NO: 5789 - protein, 184 aa, Artificial Sequence; identical to SEQ ID NO: 5788
  Synthetic

SEQ ID NO: 5790 - protein, 184 aa, Artificial Sequence
  Synthetic
SIEETVKRLIEEIERVLRDARRESKRLSEEDKKVLDEIREEVRKLEEKIKTVLDKARKDISDEDKLRRVKERVEEAIRRLRKLLREIEERSRESLRDNERTAREIERKVREIIKELRELLERLRTEKLLDEVRRRVEEVIKELEELLRRDKERVDRSIRELEKLLEEIKERVDRMIKELEDRLR

SEQ ID NO: 5791 - protein, 184 aa, Artificial Sequence; identical to SEQ ID NO: 5790
  Synthetic

SEQ ID NO: 5792 - protein, 182 aa, Artificial Sequence
  Synthetic
REVEEADKTVKELIKRNKELLDRIKKEVDELIRRDKELLDKAERDVDRLIKELRDVAREGVDRKVIDELRRDLERLIKKLAEDNKRSLDEARELIREVEERDKRSLDEARKLIRDAERRVKDGKEVVDEIRRLLRELEKVSEDTKREIRELLKRAEESVRRVTERIERLLKELRDVIREIEK

SEQ ID NO: 5793 - protein, 182 aa, Artificial Sequence; identical to SEQ ID NO: 5792
  Synthetic

SEQ ID NO: 5794 - protein, 182 aa, Artificial Sequence
  Synthetic
DELEKIKKDVKKMIRDNEDLLRRVEERVRELNRRNEELLKEIEKRVEELIKRLEDVARRGEPEEVITTLEKEVRRLIKEVAERDEESLRENRKLIKEIEERDRESLRRAEKLIREVEKEVKDKREVLEAIRRLEKEARDVSRRSTRKIEELLETSETSSEKSKRRIEELLRRLERVVEEARK

SEQ ID NO: 5795 - protein, 182 aa, Artificial Sequence; identical to SEQ ID NO: 5794
  Synthetic

SEQ ID NO: 5796 - protein, 186 aa, Artificial Sequence
  Synthetic
EELERAAERIEELLRSNRDLADKITKLSRETLEKIKDLLRKIEKEVRELLERIKDLERRLKDKDTLRREIERLLREVTEIIKRVKKEVDELLRESEEIMTRVKKENEDNLRKAEEIVRDAERRVKDKEEVLRELERLLRELKKSVDELSRLIEELLRENKRLIDEVKKRIDELLEELKKLIEKVKK

SEQ ID NO: 5797 - protein, 186 aa, Artificial Sequence; identical to SEQ ID NO: 5796
  Synthetic

SEQ ID NO: 5798 - protein, 181 aa, Artificial Sequence
  Synthetic
EIEKVVEEVIRRVRKVLEEVERSVRDTIERIKDVLRRVEEVVRRTDKTIRDVLDRIRKEISDKDKLARVKEIVDEALERSRRSLDEVRKRVEDVVRDSERSLEEAERIVREAIKRLEELLRQKVRDEDIRRVLEDIRRELKRIVDENRKLAEEIIRTLERMVEKNKELMKEVVKKLEEDSR

SEQ ID NO: 5799 - protein, 181 aa, Artificial Sequence; identical to SEQ ID NO: 5798
  Synthetic

SEQ ID NO: 5800 - protein, 181 aa, Artificial Sequence
  Synthetic
RIKETVDKVIEEVRRVLEEVRTTVKRTDERIKEVLEEVEETVRRTLEEIRRVLEELERAIKDKDKLDKVRKKVEEVLRRSERSLERAEEIVRKANKESKDSLDEAERIVREVIKELERVLKDNVRDEDIRDLVRKIKEELRRIVEKNRELMEKVERELRRIVEENERLARRIKEELDRDMK

SEQ ID NO: 5801 - protein, 181 aa, Artificial Sequence; identical to SEQ ID NO: 5800
  Synthetic

SEQ ID NO: 5802 - protein, 181 aa, Artificial Sequence
  Synthetic
RIEEIVERLIREVEKVLRDVERTVDKTDRKIREVLEEVRRISDESIKEVREVLEDLERKIKDKDKLKEVRDEVREVIKELEDTLRKAEKIAREVNKESKKSLDDIRKEVKDVIERLEDLLRNKVRDEDIRRLAEEIKKKLKRMVERNKELMERIEREIREIVERDKELVERIKRKLRELAR

SEQ ID NO: 5803 - protein, 181 aa, Artificial Sequence; identical to SEQ ID NO: 5802
  Synthetic

SEQ ID NO: 5804 - protein, 181 aa, Artificial Sequence
  Synthetic
SIEDVVREVIKRVEDVLRRVEEVSRETIERVRRVLREVEERVERTDERIRRILDKLAKSIKDEDKLRKVEEEVKRVEEESRESLERIREIVERVIRELERTAEKAREDVERVIRELEELLARNVRDEDIRRLVKKIEEDLTRIVERDKELLEDIERELRRMVEENERLLEEIERRARDEER

SEQ ID NO: 5805 - protein, 181 aa, Artificial Sequence; identical to SEQ ID NO: 5804
  Synthetic

SEQ ID NO: 5806 - protein, 175 aa, Artificial Sequence
  Synthetic
EELERLARDVDKRVEDLKDDIRKIREEVKRLLDDNRRRAEEILEESRKSLETLTDLMRRNRVDKRELEELAEESKREVKRLLEESEEHIERIKERVDRLLKELKRKVDKIKEDVKRDARSEIVKRVLEKLDEVLKDLKRTIDELKKRLEDVLRESRDIARRALEENERVLDELRK

SEQ ID NO: 5807 - protein, 175 aa, Artificial Sequence; identical to SEQ ID NO: 5806
  Synthetic

SEQ ID NO: 5808 - protein, 175 aa, Artificial Sequence
  Synthetic
SEEDRIAEESRESLEKLKDDIRKIEDRVRKLLEDNKRRAEEILREVEEDLKRIEELFKQNRVDKEDLRRKVEEIERKIRKLMEESKKHVEKIIREVKKLLDELRRKVEESLKEIKKKLRSEIVRRLLEENKRVLDELEKRIEELLRRLDKVLKESERIAREAERKIEEVLRKLEK

SEQ ID NO: 5809 - protein, 175 aa, Artificial Sequence; identical to SEQ ID NO: 5808
  Synthetic

SEQ ID NO: 5810 - protein, 181 aa, Artificial Sequence
  Synthetic
SAEEIIDRVTKEAKKSIDRTRDRITKLRRELEESIRRSRDIITKLLEELRRVVEEVKRDKRELEELVKKIKEVIDRLREKIERNVRKTEDMVRKLEEKIDRIVRRTEKRVEELKEEAKRVRTEKVVEDLERKVEEIVREDEDLVRRLAEEVKRVVEDDERTAKKLEDDVRRIIEAVKRELK

SEQ ID NO: 5811 - protein, 181 aa, Artificial Sequence; identical to SEQ ID NO: 5810
  Synthetic

SEQ ID NO: 5812 - protein, 173 aa, Artificial Sequence
  Synthetic
SLEELLEEARKTVERLIRESERVLRESEERVRRLIEELERVVRETRKRVKEVIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 5813 - protein, 173 aa, Artificial Sequence; identical to SEQ ID NO: 5812
  Synthetic

SEQ ID NO: 5814 - protein, 181 aa, Artificial Sequence
  Synthetic
SITEEIKDIERKVEKLIRELDEENKRILETLEREAKDVLRRIEDINEKLHRRARDLKRKGVDRREVDKLIREADKLHRDLKELIDRLATEVKDRLRKSLERVKKLIKEIRELVERLAEKVTREELKRVLDRVLKKVEDLLRKLEKSVRDSERRLEELLRELREVVKRVRDNIEKVLEELER

SEQ ID NO: 5815 - protein, 181 aa, Artificial Sequence; identical to SEQ ID NO: 5814
  Synthetic

SEQ ID NO: 5816 - protein, 181 aa, Artificial Sequence
  Synthetic
SIREEAREELKRLEEEAERLDRENREILKELTREFKELLKESRDINREIHERIRKLKKDGVDRKDVRRTIEDAKRKHEESHKKVEDLIRTVTERLKKSLEDVKRLIDEVRKRVDELRKRSTDRKLDKVLKEIEERLRELLKRLEDSVRESEKRLRDLLRELAKVDEEAKRNVEKVLKELED

SEQ ID NO: 5817 - protein, 181 aa, Artificial Sequence; identical to SEQ ID NO: 5816
  Synthetic

SEQ ID NO: 5818 - protein, 179 aa, Artificial Sequence
  Synthetic
SIKDEIRKLLEKVKREVEEIDDRNRRLLEKVKREAEELLEKNRRLLEEVRKRAEELKDSSEEMVEKLLEDATRLVKTSEDEIRALLKRAEDLVRDSRRRIEEILRTARRALERLREKFTDKDLERVVRDVERRIEELIRKLERSVDRSEEEVRRLIEELRKSVEDSKREVDRVVEELRR

SEQ ID NO: 5819 - protein, 179 aa, Artificial Sequence; identical to SEQ ID NO: 5818
  Synthetic

SEQ ID NO: 5820 - protein, 179 aa, Artificial Sequence
  Synthetic
SILEDVRRLLDEVKKLVEELLRENRRLLEEVKKEVEKLDRKNRELLREVRELVKELKDSSEEMVETLLRRAKKLVDDSREEIDRLLEELRRLVEDSRRKIEELLERAERLLEEVRRRFTDRKLEEAVREVEERVRDLIRKARESVDESRKRIEDLIRELKKSVEESLRDIERLIKELRD

SEQ ID NO: 5821 - protein, 179 aa, Artificial Sequence; identical to SEQ ID NO: 5820
  Synthetic

SEQ ID NO: 5822 - protein, 179 aa, Artificial Sequence
  Synthetic
STREDARRLVERVRKEVKRLLKKNSDLLREVTERVKTLNERNRRLLEEVEREAKRLKDSDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 5823 - protein, 179 aa, Artificial Sequence; identical to SEQ ID NO: 5822
  Synthetic

SEQ ID NO: 5824 - protein, 179 aa, Artificial Sequence
  Synthetic
SAEDVVREIEKTVRELMRRVEESVRKVEEDVKRLIKEVKDSADESEKKVERLLEEVKREKEEDEEVIRKLERLVEEDKERIRRAVRRLEELLKRDRERVEDVLRKLAELLERLKDRATKRKESEEELRRLLEEIKKEVDKVIRENEETLKRIKEVVERVIEDNKRTLREIEEEVRRIRK

SEQ ID NO: 5825 - protein, 179 aa, Artificial Sequence; identical to SEQ ID NO: 5824
  Synthetic

SEQ ID NO: 5826 - protein, 180 aa, Artificial Sequence
  Synthetic
SVEEVVKRILETIKDLMRRIKKNSEDVLETIKRLADEIRESVKRSNERIRELIKDIRETRKGDKVERIVRRLEELLRRNTRLVEKIERDLDRLLKENEDLLREIIKTLEKMLRDVRRIAEEGVGTDELEKLLREVEEIVKDVSRKSDTSLKKAEERVRDVKRKDEKTLRDAEEVVRREKK

SEQ ID NO: 5827 - protein, 180 aa, Artificial Sequence; identical to SEQ ID NO: 5826
  Synthetic

SEQ ID NO: 5828 - protein, 182 aa, Artificial Sequence
  Synthetic
SVEDLVRDVRDKAKRTSDEIRKLIERSKEIFERSSREIRRLIEESRDTARRVVEKLKKNGVDEELIRRLEKLVRELEKKHEDILRKNEELMREVVKEHERILERNEELMRELDDKARKNKDKSEEEIARLVEEVKRLVKESLELIEELHRRSEKLVRDSLREIKTLNDESRKIVTDVLREVT

SEQ ID NO: 5829 - protein, 182 aa, Artificial Sequence; identical to SEQ ID NO: 5828
  Synthetic

SEQ ID NO: 5830 - protein, 182 aa, Artificial Sequence
  Synthetic
KVEELVREVTEIARKVREDLERLVRESERRMRESSEKIKRLIEESRRRMKEVVEELKREGIPEELIKDLERLMREVDEEHKRILKKNEDLARELIEEHKDLIRRLEKLAEDLIREAEKNKDKSEEEIKRLREKVKRLVDKVKREIERLNRKSRELVKKSEEDIEKINRESRELLRKVLEDAK

SEQ ID NO: 5831 - protein, 182 aa, Artificial Sequence; identical to SEQ ID NO: 5830
  Synthetic

SEQ ID NO: 5832 - protein, 182 aa, Artificial Sequence
  Synthetic
DVEELIKEVKDKAKRTSDEIKKLIDESKRVLDEVVRRLEELVKRIKESADRVLEEIAREGVPEEILKKVEDLVRELKKRLEDLIERVKTVVRELKKKHDKILKENEELLEEVVRRAEENRDKDRKIAKKLVDDVERRLRKSLRLIEELNKESRDIVRELLRLIEELLKEVEELVERLLREVK

SEQ ID NO: 5833 - protein, 182 aa, Artificial Sequence; identical to SEQ ID NO: 5832
  Synthetic

SEQ ID NO: 5834 - protein, 175 aa, Artificial Sequence
  Synthetic
SELEKVLDEVRKRAKESLRRSEELAKRVEEMDERNLRNSKELRERVEEVIKRLLEVARQNRSDKKDLLRRIEEVLEEVRRHIEENLRHNEKVLEEVERVSEKNLRDVKRVLEEVRRKARSRVLEEVERIVKRVLDEDKKVLDRLRRSVERSSRESEKVLDELKKRVDRVLDEVRR

SEQ ID NO: 5835 - protein, 175 aa, Artificial Sequence; identical to SEQ ID NO: 5834
  Synthetic

SEQ ID NO: 5836 - protein, 175 aa, Artificial Sequence
  Synthetic
SELEKVFEDVKRRLDESLEKSKELLKRVRDTDRENLKNSKRLLERNKRLVDDLLRVVEANTRDKRELEKKNKDVADETREHSRRNVEHNKEVLRRVEEESRKNLEEVKEVLKDVRRRVRSRLLEELEKRAKKVLDDDKRVLDEARRSSKRVTDEDRKVLKTAEDINREVSKRIRD

SEQ ID NO: 5837 - protein, 175 aa, Artificial Sequence; identical to SEQ ID NO: 5836
  Synthetic

SEQ ID NO: 5838 - protein, 175 aa, Artificial Sequence
  Synthetic
SELEKVVDDVRRRLDRLLETSEKLLEDATKRLKDSERKSDEIVKTNEELLERLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 5839 - protein, 175 aa, Artificial Sequence; identical to SEQ ID NO: 5838
  Synthetic

SEQ ID NO: 5840 - protein, 174 aa, Artificial Sequence
  Synthetic
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 5841 - protein, 174 aa, Artificial Sequence; identical to SEQ ID NO: 5840
  Synthetic

SEQ ID NO: 5842 - protein, 174 aa, Artificial Sequence
  Synthetic
RELEEVFKEVEKELRDNLRKVEEVLREVRERLKENLDRSKEVLKDVRRRIKELLDLARGGKDKRELEKRVRKIEKDVRKLMEESKENNKRILERVEEAMKDSERDNRRILDKVRKKVDSKLLERLERKVEETLRRSREVIEDAKRIVEETLRRSEDIIREAKEIIDDVLEKIRR

SEQ ID NO: 5843 - protein, 174 aa, Artificial Sequence; identical to SEQ ID NO: 5842
  Synthetic

SEQ ID NO: 5844 - protein, 180 aa, Artificial Sequence
  Synthetic
STDDALRKIERRHKELTKEVRDMLRKVDEEVKRLIEENEDVLRKLREEVDRVIKDIRRADTPNVDELLDEVRRLLEEVERHNKKTLDDLEKRLRDIREKARKLLEDNERALERIKRVVEAGKVDLEDLRRDSERIIEEVKRRLDELRREVEKVIDDVRRLSEKNEKDARRIIEEVKRRLD

SEQ ID NO: 5845 - protein, 180 aa, Artificial Sequence; identical to SEQ ID NO: 5844
  Synthetic

SEQ ID NO: 5846 - protein, 180 aa, Artificial Sequence
  Synthetic
STEEVLDEIRKLHKTLTEDIKRVLREIEELHRRTIEENKEVLDKIREDYKRVIDDVRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 5847 - protein, 180 aa, Artificial Sequence; identical to SEQ ID NO: 5846
  Synthetic

SEQ ID NO: 5848 - protein, 180 aa, Artificial Sequence
  Synthetic
DEDKVLRKVKKLVEDIRREIERILREAERLHKELTRRNEEVLERIRRLVDKVIKEIRKADTPDVDRLIKEVRDALRRLEEHNRETLRENETVADEIRKKVEELLKRVEEVLETIRKVIEEGKRDLRELLERVERVIREVRRDLKRLLDESRDVVRRVEERSRRNLEEVKRDIERVKRELD

SEQ ID NO: 5849 - protein, 180 aa, Artificial Sequence; identical to SEQ ID NO: 5848
  Synthetic

SEQ ID NO: 5850 - protein, 180 aa, Artificial Sequence
  Synthetic
SKEEVLREIERLHKETIRRIEEVLREATELHKRLTETNKRVLEDLEREAREVIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 5851 - protein, 180 aa, Artificial Sequence; identical to SEQ ID NO: 5850
  Synthetic

SEQ ID NO: 5852 - protein, 180 aa, Artificial Sequence
  Synthetic
SKEEVLDEMRRLHETTKRDIRRVLKEIEELHERTLRENKRVLEEIKELVRRVIEDIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 5853 - protein, 180 aa, Artificial Sequence; identical to SEQ ID NO: 5852
  Synthetic

SEQ ID NO: 5854 - protein, 180 aa, Artificial Sequence
  Synthetic
DRERVLREMERLVRELLRENREVLDEIRKLHERTVRRNRELAKRLEEEAKEVIDRIEKTKTPNVEELLEKVRRALERVKRHNEKTTRDDERVLRELEKHNEETTRELKEILDRILERVRDGKVDVKKLLEEARDVIRRAKEKSKRNLDESRRVVKETDDLSEKNREDVRKIIKEVEEELK

SEQ ID NO: 5855 - protein, 180 aa, Artificial Sequence; identical to SEQ ID NO: 5854
  Synthetic

SEQ ID NO: 5856 - protein, 180 aa, Artificial Sequence
  Synthetic
DVEEVLREIEELHRRTIERIKKVAKKVREDVKRVLDENKKVLDELRRRVEEVIEKIKKADTPNVEELLKTVEKMLEDVKRHNEETTRRAADILRKIEDKARKLLEEDERVLREIEKVARDGRVDMRELKKRSDDVVRESEKELRRLEDEIRKVIEDLKKLSEDNEREVEKVIRKVEEDLR

SEQ ID NO: 5857 - protein, 180 aa, Artificial Sequence; identical to SEQ ID NO: 5856
  Synthetic

SEQ ID NO: 5858 - protein, 184 aa, Artificial Sequence
  Synthetic
DMERIVDTLRKLNTDSNRRSKEAIDRLRKTNKDSLDKVEEVLREAERLAEDVLRKVEEKVTSEKLERIRREIERVVEEVRKRIEEIKRKIKESLRRVDKLITENSKKNKDSLDRVEDIIRKVGSKKEVLKKLLEEVKDSNRRSEEDVRRMEEEVKRSNDELLKELKEILDKVREAIKKLEEKVK

SEQ ID NO: 5859 - protein, 184 aa, Artificial Sequence; identical to SEQ ID NO: 5858
  Synthetic

SEQ ID NO: 5860 - protein, 184 aa, Artificial Sequence
  Synthetic
SAEDIIRRLRDLNRRSNKKSRDVAEKLRRDNKRTLEKVERKARELKKLAEEVVKEVRDKVTSEKLRRIEKEIRDVVDRVRRLIEEIAREIERSLEEVKRLIKENERKNEESLRRVDDIIKKVGDLEEVLRRMLKEVEDSNRDSDRDVRRIEEEVRRLNEELDKKLEDLEREVRRMIEEIRRKVK

SEQ ID NO: 5861 - protein, 184 aa, Artificial Sequence; identical to SEQ ID NO: 5860
  Synthetic

SEQ ID NO: 5862 - protein, 178 aa, Artificial Sequence
  Synthetic
SELEEVKERVERVLKRIRDLTRELEDRVDKILEKSKRTLDELEKRVREVIARIKELVKRLKDDRRAVKEILDEIREMLKDLEKKARDNLKEVEDRRKELEKLSRDSIKEVEEVLKELRDKVRSEVLKRLEELAREVIEEDKRALERLDRKIRRVLDESRDVLRKIRKLIEDVLREVEK

SEQ ID NO: 5863 - protein, 178 aa, Artificial Sequence; identical to SEQ ID NO: 5862
  Synthetic

SEQ ID NO: 5864 - protein, 178 aa, Artificial Sequence
  Synthetic
SESETIEKEADEMLKRSKKTLEELRKTVKRILERIEKLTRDLEKTAEDIIRKIEDDLRRLKDDERVVDEIIERIKKELRKLEERSRESLRDIKRVLDELRRRMEENLKRVEEILKRLEERVRSEVAKRISEKIRRVLEDSRRVLEELEDLIRRVLERDKRALERIKEDIDRIIRRVRT

SEQ ID NO: 5865 - protein, 178 aa, Artificial Sequence; identical to SEQ ID NO: 5864
  Synthetic

SEQ ID NO: 5866 - protein, 177 aa, Artificial Sequence
  Synthetic
SELEAVLDELRKLVKELEDRLRKVNEESRRLIKELLDRLREVDERSRKLIKDLAEKARRRGVDEKLLDELRRRLEEHNKENRKLEERIRKLLEEHNRENRKITKELRDLLKELEELLDEVDTDELRKRVRDLVRRVDELIKRSKRHAEELTREVEEKVRESEEHVRRLVKEVEDRIR

SEQ ID NO: 5867 - protein, 177 aa, Artificial Sequence; identical to SEQ ID NO: 5866
  Synthetic

SEQ ID NO: 5868 - protein, 171 aa, Artificial Sequence
  Synthetic
DEVEEADKRVEDEVRRLKRLVEEHTKRVEDKVRTLKKLVKEHTDEVRRAVEELKRRRDDEESVRRKIEEIKRRSDKIRRDVERKIEEVYRDSERELRRIKKEIEDVLREMKRRDIDEDVLRKVKELLEDVARLVEESHEEARKLLKEVEDRLRESVREVEELLRDVERRTR

SEQ ID NO: 5869 - protein, 171 aa, Artificial Sequence; identical to SEQ ID NO: 5868
  Synthetic

SEQ ID NO: 5870 - protein, 174 aa, Artificial Sequence
  Synthetic
DEVEKVKEEIRRIVKELEDRVEEHKKEAKKIIDELRRLVKRHREEVEEIVKKLEELVRRNSPREEIEKELDKVRRRSDELHKDAKKKLDEVREDSKRMAEEIKRTLEKVRDELRRKISNEEVLKEAEKLLEDVERKLRKSHEDLERLLKEVEEAVRDSNEEVRERLDRVREKMR

SEQ ID NO: 5871 - protein, 174 aa, Artificial Sequence; identical to SEQ ID NO: 5870
  Synthetic

SEQ ID NO: 5872 - protein, 174 aa, Artificial Sequence
  Synthetic
DEDRKVEEDIRRIVKRLREIVEKHNREAREIIKRLRDEVRKHRDKARKIVTRLDELIKRNTPEEEAKKEVDDVRRRSKEEHDRFDKELKEVRERSKEMADKIKEDLDRVRDELRRKIKNKDVLKEAEELLEKVKRDLDRSHEELEELLKRVREELEDSNRELEKLIEEVERKVR

SEQ ID NO: 5873 - protein, 174 aa, Artificial Sequence; identical to SEQ ID NO: 5872
  Synthetic

SEQ ID NO: 5874 - protein, 174 aa, Artificial Sequence
  Synthetic
SEVEDVDDRIRKIIKKLEDLVRKHNEDARRIIDELRELVERHNRRAREIVRELEDLVRRNKPRERIEEKLREVKKESEDVLKEAEDRLREVRKRSREVHEEARRRLEDVRKKLEERIDSEEVLKKVEKLLKEVLDLMKESNEELEKLLEEVKREMEESVKELKKLLDEVREKVK

SEQ ID NO: 5875 - protein, 174 aa, Artificial Sequence; identical to SEQ ID NO: 5874
  Synthetic

SEQ ID NO: 5876 - protein, 179 aa, Artificial Sequence
  Synthetic
KEIEDVLEKVRKVVTDLKKKLEDVNRESEKLVREVVKELKRVDDESRKLVERVEKEADEKGVDETLKRKLREYLKEHHKRNKKIIDDLKKYLDEHHDKNRRIIEELDRLLKEMEEIIRRNELSEEELDRRIKELKDRADKLIKDSKDNVEELRKKAEELIRRSRKNVEDLVRKATEDVR

SEQ ID NO: 5877 - protein, 179 aa, Artificial Sequence; identical to SEQ ID NO: 5876
  Synthetic

SEQ ID NO: 5878 - protein, 179 aa, Artificial Sequence
  Synthetic
RELEEVLKKVEDLHRDVMKKIDDVVREASELHKKVKEDIDEVVKRAEDVLRRVKRELDKRGGIEEVKRRLDKVLKDLRKEVEDIKRKLDEDNKTLRKKAKEIKDELKENLKRLEDVVRRGDLDKDELDEHIERSLRKVTELVKDLKEHIERSLEEAKELVRRLEELIEELLRRLAEEVR

SEQ ID NO: 5879 - protein, 179 aa, Artificial Sequence; identical to SEQ ID NO: 5878
  Synthetic

SEQ ID NO: 5880 - protein, 177 aa, Artificial Sequence
  Synthetic
SEVEEVLREAEELLKEVRDRLRESVEKSKRLLDEVRRKIEESHRRHKELSDEIRRLAEERNLDKTLEEKIKKVNDENRRRLRELERTLEEVLERNKETVRRLEDELRKVLERLRRLAKDVDIEELRKEIKKKIDEMRRLVKEDTERLERVAEELRRRVEEDKERSKDVVRRLREDVK

SEQ ID NO: 5881 - protein, 177 aa, Artificial Sequence; identical to SEQ ID NO: 5880
  Synthetic

SEQ ID NO: 5882 - protein, 177 aa, Artificial Sequence
  Synthetic
SEVEEVLKRAEELLDDVRRLLERSHRETERLLDEVRKRVEDSHREHRKLSDEVRRKAEERNLPEELDERLKTVNEENKKLIEEIKDRLDRVREEDEKSLKELKDKLDEVRDRLERLKKDVDIEELRKDIERAVKELRERVEENTRRVEELVRRLRELVEEDRKRSKEVADEMDERVR

SEQ ID NO: 5883 - protein, 177 aa, Artificial Sequence; identical to SEQ ID NO: 5882
  Synthetic

SEQ ID NO: 5884 - protein, 177 aa, Artificial Sequence
  Synthetic
KEVEEVLDTAKKLLDEVRRELERSHEEHKRLSDEIRERLERSHEETERLLKEVKEEVDDKNVEEELKKKLDEIRKEDEETLRELEERLKRADDKNEKIVRELEKRLRDVEEELRKLMKDVDIEELKRRIDDMVRRLRELVERDRRESKKVADDLRRLVKENTERAREKIEELRKDVE

SEQ ID NO: 5885 - protein, 177 aa, Artificial Sequence; identical to SEQ ID NO: 5884
  Synthetic

SEQ ID NO: 5886 - protein, 177 aa, Artificial Sequence
  Synthetic
SEIEEVLKEAEKLLREVEKELRRSHEELKRLLKEVRDKVRRSMEESERLLEEIKKKADERNLEDELRKRLEKVLRDNRETIRRIEEAIKRVEEENRKTIRDIERTLREVLERLKELKDRVDIEELKRRIEDAARKLEKLVKDDRERIERKVRELERLVEEDKKRLRDRVRKMDEDVR

SEQ ID NO: 5887 - protein, 177 aa, Artificial Sequence; identical to SEQ ID NO: 5886
  Synthetic

SEQ ID NO: 5888 - protein, 174 aa, Artificial Sequence
  Synthetic
REVEEIVKKVRKEVTRLLREVEEDMKRNRDTIRELLKYVKKDLEENKDIIRRLLELIRRDGSTKELRKTLEDKLKESEDNLRRVAEELREKEERSKRNLDRIEREARERVKRLEEEGVSEEARKDIERLLEEVRTKLRENEEDLRRLVKEVDRELKRNRDELERLAKEVRDELK

SEQ ID NO: 5889 - protein, 174 aa, Artificial Sequence; identical to SEQ ID NO: 5888
  Synthetic

SEQ ID NO: 5890 - protein, 174 aa, Artificial Sequence
  Synthetic
SEAEEIAKEVEKRIRELLDRVRRMVEESEKYARDSLRKIKRLLDEVRRRIEELLRKIRRDGPTEELRKELERIKEEIDELLKKIRKENEDAHRRSKELIDRMKEELDKIKEEIDRKNLPSEVAKKVKELLDEVERILREWEKEDRRLLKESEDLLREVEKEVRKLLRRVEEELK

SEQ ID NO: 5891 - protein, 174 aa, Artificial Sequence; identical to SEQ ID NO: 5890
  Synthetic

SEQ ID NO: 5892 - protein, 174 aa, Artificial Sequence
  Synthetic
SESEKILEEAKRRIRKLLEDVKEMVKRSRDYARESLKRIKDLVEESKREIDKLLEEIKRSGPTEELEKRLREINRRSRELVKKIREENERLHRRSKELVKEMEDRLREIEEEIRKKGLPSEVEEDLKRLLEEVKRELKRWEEDDKRLLDDSERALKEWEDTDRRLLKRVEDELR

SEQ ID NO: 5893 - protein, 174 aa, Artificial Sequence; identical to SEQ ID NO: 5892
  Synthetic

SEQ ID NO: 5894 - protein, 174 aa, Artificial Sequence
  Synthetic
SEVEEIVKDAERYIKESLDRIRKAVEESRRRITELLKEVERLLREVRKRIKELLDEIRRDGPTDELRRKLEKIEREIKKRLDDLRRELEEIHKRSDELVRRMEEENKKAEEEIRRRGLGSDAERKLEELLEESRELLKRWRDDDKRLVDDVRRKLKEVEEEVRKLLKEVEDELR

SEQ ID NO: 5895 - protein, 174 aa, Artificial Sequence; identical to SEQ ID NO: 5894
  Synthetic

SEQ ID NO: 5896 - protein, 174 aa, Artificial Sequence
  Synthetic
SEVEEIVKEAKRRIDELLKKVDELLKESERYARKSLKDNKDMVRRSEERIRELLEKIKRDGPDDKIREELKKINKESEDLIRKNKEDNERFHKKTEDMLKRLKEELDEIEERIRRKGLGSEAEKRLKDLLDRVKEKLDEVRRRDRELLEESKDLSRRWKERDDRLLEEVEKALK

SEQ ID NO: 5897 - protein, 174 aa, Artificial Sequence; identical to SEQ ID NO: 5896
  Synthetic

SEQ ID NO: 5898 - protein, 176 aa, Artificial Sequence
  Synthetic
REIEKIREDLERLLEEVKRAAEEWRRRDEELVRKLEELIKRVLDEDRRLLRELRDKGKGERLKEIERRSEESRRRLKRLLEEIRRLSKRSKEELDEALKRVEEEVRRIEDKLRKVRGREVIKKVLEEIRDKIRKILKTIEDLVRKSEDLIRRVLEEIERILDESRRDVEEVKRREE

SEQ ID NO: 5899 - protein, 176 aa, Artificial Sequence; identical to SEQ ID NO: 5898
  Synthetic

SEQ ID NO: 5900 - protein, 174 aa, Artificial Sequence
  Synthetic
DEDRRVKTEIKKLLEELTRRSREVEEDDRRLLDELTRETERIEEDLRRLLEEVRRSGVPEDKLREIEREIRELRKRLEDLNKEIKDLSEKTRKELRDLNRRLKEIVDRLKERIDKEGATDEIEREVRKVEEDYRRSLRRVLEESRKIAERYKKKLDEMREEVRRRAKKVKDEVR

SEQ ID NO: 5901 - protein, 174 aa, Artificial Sequence; identical to SEQ ID NO: 5900
  Synthetic

SEQ ID NO: 5902 - protein, 177 aa, Artificial Sequence
  Synthetic
KSVEKIVEDIKRVADKILEDIKRSEDRVREIVDRHRREIDKVVKEIVKRVEDLKRNNIPREEAERVLRDVERKVEEINRRMEEHLRKLEEEVKRSHDEIRRKLEELEKRVRDIKKDVDKDEMEDLKRRVDELKKEIERALKEHKDKVKKLLDDLRRLNEELRREVRRVLEEVRETTR

SEQ ID NO: 5903 - protein, 177 aa, Artificial Sequence; identical to SEQ ID NO: 5902
  Synthetic

SEQ ID NO: 5904 - protein, 191 aa, Artificial Sequence
  Synthetic
DEIERVEEALKKVEKDLRRLIRELEKLNDKIERDIRRLHEETNKRLKEVREKVEDMIRRVSARAPEEDLRRLKEEIDKLVRELEKKDRDLAKENERKIRELRKHLEELLREAEREIKRIEDKVREAKKRGEDRRVVKKLLDEIEEILRRLKKLVDDHARESKRILRESERKVEALLEEIEEILKRLEEKVK

SEQ ID NO: 5905 - protein, 191 aa, Artificial Sequence; identical to SEQ ID NO: 5904
  Synthetic

SEQ ID NO: 5906 - protein, 180 aa, Artificial Sequence
  Synthetic
DEIERVLREIDELRKKVEKVIEDSRRNAKRWLDRVKRTAEELNKLSDELLEEVTRLAEAGIPEEKVKELRDRLEELDRRSKEKIKKLKRDLERNLRETERTIEELKRELERLVEKIRREIDSRAMEEVRKTAEEVIKTVDKLLKELRKTYEDILRDIDRLLKEHHARNRRVLEEVERLTQ

SEQ ID NO: 5907 - protein, 180 aa, Artificial Sequence; identical to SEQ ID NO: 5906
  Synthetic

SEQ ID NO: 5908 - protein, 171 aa, Artificial Sequence
  Synthetic
SEREEVKKRLDDVRREAKRLLDEVRKRLEESHRKHKKLLDEVRKRLKEVEEEAKRRGVSEDLERELKRLLDELDKKLKESLRENEKTIRDIEESLKTVLKKLEDLVKKLRDDNVRKEKVTKIIEDLKRELEEMFRKLKRLVEEDDRRSKESLEEVRKLVEDARRKIEEDTR

SEQ ID NO: 5909 - protein, 171 aa, Artificial Sequence; identical to SEQ ID NO: 5908
  Synthetic

SEQ ID NO: 5910 - protein, 181 aa, Artificial Sequence
  Synthetic
SSIEKLKKVVEDIKRRSEDLNRELEKVVRDVKKRSEELNEELRKVSEEIERRLRELLKRISDEKKLRDAARLIDELRKNSERVSRENEELVRRLKKKVDDVSRKNKEIVKDLERRVDEVRKRGPAEERFVEELRRALKKDEDDMRRVVEDIERLLEEDERRMKKAVEDHRRLLEELEERAK

SEQ ID NO: 5911 - protein, 181 aa, Artificial Sequence; identical to SEQ ID NO: 5910
  Synthetic

SEQ ID NO: 5912 - protein, 174 aa, Artificial Sequence
  Synthetic
DESEELKKVLKEIEDEVRRLIREIERVLEEIERRDRELLKRDEETLKRIEEEVRKLRLSEELKKEAKKRLDESRRRLRELHEESKKRLDDIRERLERLLRELEKRLTEVDKRIKREGAREEIIEELRRILKEAEDVIRRIIEEVRDVLRESEKRVRESIDENRKILEELRRRAK

SEQ ID NO: 5913 - protein, 174 aa, Artificial Sequence; identical to SEQ ID NO: 5912
  Synthetic

SEQ ID NO: 5914 - protein, 170 aa, Artificial Sequence
  Synthetic
DEEDRLRRELEKVRRDADRLLEEIRRVLEEVERRSKELLKRDEDSLREIVRTVTEETKRDEIKREVDKIAEDTRDHLRKHEEKTRRIKEEVKELLKRLKDKVDKVRKEVEAKKVTDEVLEEIRRILEELRKEAEDIIRRIRELLRELEKNVTDSIRRNEEMLKELRRKVK

SEQ ID NO: 5915 - protein, 170 aa, Artificial Sequence; identical to SEQ ID NO: 5914
  Synthetic

SEQ ID NO: 5916 - protein, 180 aa, Artificial Sequence
  Synthetic
SEAEKILEDMKRYIEEHIERVKRSLEENKKKDRELIEKSRKSLEDARKKIRELLELVRQRKTSEDVLRKSIRELEEDLKKHEEDSERDKRRLEEDHKRHEDESKKSLDDLERRLEEVERRGLVSEEILKRIRDLVKELEERDRRVIEEMKKSNKRTEDTDREVLERIRRLVERLADEARK

SEQ ID NO: 5917 - protein, 180 aa, Artificial Sequence; identical to SEQ ID NO: 5916
  Synthetic

SEQ ID NO: 5918 - protein, 185 aa, Artificial Sequence
  Synthetic
SELERVIEEIKRLLERLKRENEEVKKRVKKLLDELRKINKDVEDTVRELLKRVKELVDRANLDEKSRRDLEKKREETKRELEEIKKKSDKNLTDLKRELEKIMEDSKRDIEKIERETKKLEEDRLGKDEIEEALRRVEEHIKRHLKTVKELAEKAERHIREHLKEVKRMLEKAKRTIDELLKKIK

SEQ ID NO: 5919 - protein, 185 aa, Artificial Sequence; identical to SEQ ID NO: 5918
  Synthetic

SEQ ID NO: 5920 - protein, 175 aa, Artificial Sequence
  Synthetic
SLREAAKEVLERVRREVEKLRKSNEEVLTRVREEVKKLLETNKDVLRRVAEILKTANVDKRIADRVRDELRRYEERLKEEADRIRKMLEDYERESRELRERIERTIKALEDRVEKKGEVSEEDIREIEDILRKIAETVETLNRRLEDILREIRKSSKKTIDELREKAKELEDRTR

SEQ ID NO: 5921 - protein, 175 aa, Artificial Sequence; identical to SEQ ID NO: 5920
  Synthetic

SEQ ID NO: 5922 - protein, 182 aa, Artificial Sequence
  Synthetic
SEVDEDLKDIKRYLDEHRKRVEEVVKRLEDRSRETAREVEEDVKRIERKVEEAKKEADERGNRKERLEELRKELKKERDDLRKRNEDDRRDLDRERKRLEKELEDSRRKLDKKEDELRKKNLDEDAKRRIEEVLERVRRELERSEEKLRRVLEKHREDNDRLEEELDRVLRELEKILDEVAT

SEQ ID NO: 5923 - protein, 182 aa, Artificial Sequence; identical to SEQ ID NO: 5922
  Synthetic

SEQ ID NO: 5924 - protein, 182 aa, Artificial Sequence
  Synthetic
DEVRKILKELKELVKRIEDKLRKYLEDVRREVERIEEEVRRNLERIKRLAEEIERRVRRDGKSKELAEEVKRKLTENEKEDRKRERDVREKNKEDKRRLEEEMKKVEETLKRKEDDVRRRNLSEDVKRKIDKVLDEVRRLLEDIKRRVEKINTDTERLLKKLAEDSKRALEEVKETLERAER

SEQ ID NO: 5925 - protein, 182 aa, Artificial Sequence; identical to SEQ ID NO: 5924
  Synthetic

SEQ ID NO: 5926 - protein, 179 aa, Artificial Sequence
  Synthetic
ELRERIKRALDEHRRVSEELERRVREANKRHNEVSKEVKDDLKRSHDELRESLERIKRRGDLSEEMEKKLRERLERSKREIEKKEKENRDEHEKSRKKVEDKKRDNERRVKEMEDKIEKDGRVEEEDLKRIREETERLKEDVRRYLRELEKLSRDLRRKVEELLKDNKRKVKEIEDEAK

SEQ ID NO: 5927 - protein, 179 aa, Artificial Sequence; identical to SEQ ID NO: 5926
  Synthetic

SEQ ID NO: 5928 - protein, 182 aa, Artificial Sequence
  Synthetic
DELETLEERIRRSVERVRRELKRYKEEMDKHSEDLKRLVDKNLEDVRRELEEIRKLATDGRFDEDVERTVEKRLKDNEDRDRERSRKVEDDNRRSREELEKLKKESDEELERTKKEVEERNLDEDMEKKLRELLERHERENKKAREDVEEANRRNEEVLKDIERRSKKALDDVRRELERVRK

SEQ ID NO: 5929 - protein, 182 aa, Artificial Sequence; identical to SEQ ID NO: 5928
  Synthetic

SEQ ID NO: 5930 - protein, 178 aa, Artificial Sequence
  Synthetic
SLKEVLDKIEEDHRRMSKRNEEVLEEVKRRAEKLLKDAEEVLRRVRERIEELIRRVEETKGRTERLRELEERIRKRDEEIERKLRKELERLKERLRRYRERTKELNKKFEEDLRELRKKGVDVKELKKRADESRKTVERLSRELKKELRKVEEDVKREVEKIEEDLKRIARRVREESR

SEQ ID NO: 5931 - protein, 178 aa, Artificial Sequence; identical to SEQ ID NO: 5930
  Synthetic

SEQ ID NO: 5932 - protein, 180 aa, Artificial Sequence
  Synthetic
SELERLLEEVERLLEKLERDNKRLLDDVRRLLERLRRDNERLLEKNKRLLDRLREEVSRVSDEKFLREVEKKLRDNEREAERVAEESEKHLRDVKKRLDELLETSERNLREVRERLERVRRDEDIEKLAREVKRHIERHKEELDRLRKEVEKNARKHEEDLRRLEERSKKHVEDIERETR

SEQ ID NO: 5933 - protein, 180 aa, Artificial Sequence; identical to SEQ ID NO: 5932
  Synthetic

SEQ ID NO: 5934 - protein, 180 aa, Artificial Sequence
  Synthetic
SELEKLLEDVKRLLDELRERNEKVLEDARRLLEELRKRNEDLLRRNRELLERLEREVSKVEREEVLDRVRRELEKNERRVDELRRESEKHLREVKEELDRLKEKSETNLRDAERELTELKDDEDIDRVRRRVERHIREHERDLREVKKRIEEDAKRHRDRLKKLEEDSREHVKRMEDRTR

SEQ ID NO: 5935 - protein, 180 aa, Artificial Sequence; identical to SEQ ID NO: 5934
  Synthetic

SEQ ID NO: 5936 - protein, 182 aa, Artificial Sequence
  Synthetic
KLEELAKELRRLLEELRKRSKEVIDRLRRLNEELRKTSEEVIRRLRELNRRLTEKARRRLKDEGEKLKEAEKLSEDHRRKVEELLKKSEEDSRRHREKLEELERRSREDLRRLREEIERVLKDRDIKEEVLRKVREEVKEHERRLEDALRRSKKEIDDHKRELEELLKENAEEVRRVEERIR

SEQ ID NO: 5937 - protein, 182 aa, Artificial Sequence; identical to SEQ ID NO: 5936
  Synthetic

SEQ ID NO: 5938 - protein, 182 aa, Artificial Sequence
  Synthetic
KAEELVRELKRLLDKLREESKKVIEELKRRLDEVAKKSEDVVEEMRRLLEELKEKIERRLKDKGEDLKRAEEKLKDIEREIDKLEKESRKNLEDIKRDLERLLKESEDDLKRLEDEIDTVRKDGNIREEVLRDVRRKVEDHRRKLDEIRKRVTDEARRHERELEKALEKIRRDIRRIEEELR

SEQ ID NO: 5939 - protein, 182 aa, Artificial Sequence; identical to SEQ ID NO: 5938
  Synthetic

SEQ ID NO: 5940 - protein, 182 aa, Artificial Sequence
  Synthetic
KVEDLLREAKALLDELKRESERIIKELRKLNDDLTKKSEEVIRELEKLLRDLKKIVDERLKDRGKDLEEVRRRLEEIKKEIDDALEKSRRNSEKHRREVEEVLERSERDLERIREELERLAKKGDIKEEALKKVRKEVEDHKRRLKEAVDRNRKKIKDHEEELERTLRDIRRKIDKERRELE

SEQ ID NO: 5941 - protein, 182 aa, Artificial Sequence; identical to SEQ ID NO: 5940
  Synthetic

SEQ ID NO: 5942 - protein, 176 aa, Artificial Sequence
  Synthetic
EELERLLKRVRDESKKNRDKVREDLERSRRKSKRHEDELRRLLKEARDDIDRVRDLRRKNSQRREDLKRILDTLREKLKKMMEDSERDLRRWEEENRKLNKESKEELDRLKEEIDKSPIGEEVVKEAEKILDDNRKENERVSEEDKELLERNKKKAEDVLRELEELIRKLAEELKK

SEQ ID NO: 5943 - protein, 176 aa, Artificial Sequence; identical to SEQ ID NO: 5942
  Synthetic

SEQ ID NO: 5944 - protein, 179 aa, Artificial Sequence
  Synthetic
SELEELLKRIRDKSKENEDEVRTDLKRVRDYARRHEERLRELLERVRDELRKAEELRRAGEVSEKVVKEIVDKLRKMIEEIKREVDESKKRLDDDLRKIADTSRRKAEELKKDLDKVRTDGADERVLEEIERIMRENKRRNEEVIKEIKELIDRLRRKSERVIEEIKKRIDELRDKARR

SEQ ID NO: 5945 - protein, 179 aa, Artificial Sequence; identical to SEQ ID NO: 5944
  Synthetic

SEQ ID NO: 5946 - protein, 179 aa, Artificial Sequence
  Synthetic
EEEREIEERLRKKIEEIRREDKRHHDEVRRKVKEIKEEDREHHERVKRKAEEVKKRIETTGPRREEVEKIEREVEKNSRDHKRRLDEIRRELEKDSEDHKRRVKEIEDDIKRDLDEIRRKVKDDKDVLRELKRLLDELRESARKNNEDLKRLLEELEESVKRNNDELKKLLDELKERAR

SEQ ID NO: 5947 - protein, 179 aa, Artificial Sequence; identical to SEQ ID NO: 5946
  Synthetic

SEQ ID NO: 5948 - protein, 186 aa, Artificial Sequence
  Synthetic
RELEELAERVKRLLERDEELLRRLKDAVRRLSEKDRRLLERLAREVKRLLDELRDLVRKRLKDKREDLERVEKMLREIKRDLEDHKRRVEETNRRLEEEVRKHEEEVKKDNDDIRKELREIEERKLDKELLERVITELERKARESEKKHEDSLRELERLARESEERHKRSLEEVERKIEEIKRDLD

SEQ ID NO: 5949 - protein, 186 aa, Artificial Sequence; identical to SEQ ID NO: 5948
  Synthetic

SEQ ID NO: 5950 - protein, 178 aa, Artificial Sequence
  Synthetic
RELEKLEDEIRRELRRIEKELKDYERELEERADKDRRDIEDYRRRLEERVKEIEDRLRRDGSDEEELRRIREESRKTLEELKRHLDKSRKESEDTLRRLEKRLRDIEKRAEEIKRELDRAGVSEELRKILEDALKRVREEVKRILDRNRELLRESEELVRRVLKRNRDLLREVDERVR

SEQ ID NO: 5951 - protein, 178 aa, Artificial Sequence; identical to SEQ ID NO: 5950
  Synthetic

SEQ ID NO: 5952 - protein, 182 aa, Artificial Sequence
  Synthetic
DKVREALKRLKDKMETYERRSKKHIEDHKRKLKEYEERVRRNIKRLREELKKLEEDAKTRGPREKDVTEILKRIEDHLEEHHRRSEEVKRDLERNLEEAHKDSRRVLEELKKELEKIRRGDLSEELLKRVDELARRIMKRIKELNRENERVVRESLKRVDELNKRSEKVHKEVLDRLEELRR

SEQ ID NO: 5953 - protein, 182 aa, Artificial Sequence; identical to SEQ ID NO: 5952
  Synthetic

SEQ ID NO: 5954 - protein, 178 aa, Artificial Sequence
  Synthetic
SLKEELEKLVRDIIRDNRRLLEENEELVRRSEESNKRLLEENEETARRIKAELERAGIPEEELKELVKRLEEELRRIKEEADRLDEKHKDDLRRIREEAKKIDDELKKELDEIKRKDDSEKLVEEVKRKLKRKLEEIRREHRRTKEEIKKTNEDIKRRHDETLRRLEKTLEDIKERTR

SEQ ID NO: 5955 - protein, 178 aa, Artificial Sequence; identical to SEQ ID NO: 5954
  Synthetic

SEQ ID NO: 5956 - protein, 182 aa, Artificial Sequence
  Synthetic
SEVEKILEELKREVREHERRVEKLVRELEDYVRRHREKVKRIEERLRDKLREIEELVKEGRLDDSEVERLKREVEDEARRLEEEHEKSLRRIEEKLREIEKDHKRSKEELDKRLEDIRRRGLPEKAVREIETLADEIRERIERSLKRIRDLIREIKEDLRRSLERIREIIREIKKAIDDRRK

SEQ ID NO: 5957 - protein, 182 aa, Artificial Sequence; identical to SEQ ID NO: 5956
  Synthetic

SEQ ID NO: 5958 - protein, 182 aa, Artificial Sequence
  Synthetic
SEVEKILKEIRDENERLKKEIEEILRELERKLREHRREVEEVLKRIREKIETLKDESRREDRGSERVDKVRRELEETLKRIKERHDESRKELREKSERIKRRIEEYKERNDRKLEEIERANLPEEMLREMERISREDRETLKRLTDRIREMIRRLEEEIKRSEREAREIIKEAKKVLEDEAT

SEQ ID NO: 5959 - protein, 182 aa, Artificial Sequence; identical to SEQ ID NO: 5958
  Synthetic

SEQ ID NO: 5960 - protein, 179 aa, Artificial Sequence
  Synthetic
SRVEELIKDLRRSTKELEDRVRKLLEELKDKTRRTEKRNREKLEKLKEELRKLEEDVKREGPRETDLDERVKELEKAAEDSKRELDENLERVTREIEKIKREIDKYRKDSERRIEEIRKSGDDDEKVRKVMEDDRRKLKKILDDVEDVLRKHKKVLEDLKRTNDDVLREARKLAEKIRR

SEQ ID NO: 5961 - protein, 179 aa, Artificial Sequence; identical to SEQ ID NO: 5960
  Synthetic

SEQ ID NO: 5962 - protein, 181 aa, Artificial Sequence
  Synthetic
SAEERLKEALKRLDDVSKRSEEEIRRMIKRIERISRESLKRLKDLNRRIKELVERIERRLKVDDELRRLRKRVEKLNRDSEETAEREREDNERMIRELEKRLREEKEDNKRFLKELEERLRRGPVDERLLEEIKRYIDEHKRRLDELRKDIERYLEEHKERLRELEKRHEELLRTLDREAK

SEQ ID NO: 5963 - protein, 181 aa, Artificial Sequence; identical to SEQ ID NO: 5962
  Synthetic

SEQ ID NO: 5964 - protein, 185 aa, Artificial Sequence
  Synthetic
SAEEDLDRMRKKVEDVIREDKERVRKLLERAKEVIRESEKKHEDLRRRIRKVIKEIRERTNGSSDELRKIEDLLRRLEKHVDDSEREVKKNEEEIREEVERHLKRSEDNAEEIRKEIEEVERRKVSDTDLERELRRIDKHLRDHKDEARKSEERVEDHLRRHRERVRRNEEDVEDKLKKLKDETK

SEQ ID NO: 5965 - protein, 185 aa, Artificial Sequence; identical to SEQ ID NO: 5964
  Synthetic

SEQ ID NO: 5966 - protein, 175 aa, Artificial Sequence
  Synthetic
REEEELKRRNKDHNRRHREDTKRIAEDVDRKLREWKKKSDEAREEVKRLLERLKELADRNEVEEREVERLLKELRDRVKELKEESDRDLERLRRTVEELLKKLDKNLKESEDELRKKPESEDLRRLMKENRETIRESAEILERLRERVEDLVRRDREILEKLLRDIEELAERIKR

SEQ ID NO: 5967 - protein, 175 aa, Artificial Sequence; identical to SEQ ID NO: 5966
  Synthetic

SEQ ID NO: 5968 - protein, 184 aa, Artificial Sequence
  Synthetic
SVEDELRKLEERLKRIADELRRLVEKNIEDNKESLKEIEKLIRENIERNKEVLKRIAERGKREDELRDIERKIRESIEKLKDLLRRAEEKVRRSIRRLEKILKELKEKVDKLKEELKDLTDKRLDKDELKKALDDVDKKLEDLRREVEDRDRKNEEDNRRLRKELEERSRENKEFLDKLAREAD

SEQ ID NO: 5969 - protein, 184 aa, Artificial Sequence; identical to SEQ ID NO: 5968
  Synthetic

SEQ ID NO: 5970 - protein, 175 aa, Artificial Sequence
  Synthetic
SEKDESARDIEEKLERHLRKSDESRRRNEKRIKEHRDRSDESRKKFETDLKRIEDEVRKRGPNRDELDELLKRLKDELDDHRRRTEKSARESKKHLDEHRKRTEDSLRTFEEELKKLEPDEKLKDLERKVREVIDRDRDILRRLEEEHRKVITEDEEILKRLEEKAREAIERIRR

SEQ ID NO: 5971 - protein, 175 aa, Artificial Sequence; identical to SEQ ID NO: 5970
  Synthetic

SEQ ID NO: 5972 - protein, 175 aa, Artificial Sequence
  Synthetic
SEKDERLEEIKRRLKEHKRRSEEAVKDNDRKLEKHKRDSDRSAEEVKKKLEEIEKRVRKDGPRETELEELDRRLRKELEDHARRTDESMKRSEEHLRKLKKEIDESLKEFKKELDKLEKDKKLDDLEREIRKVIEESKRLLEELERRHRRVIEEDKRILDELRRLIEELIEDAKR

SEQ ID NO: 5973 - protein, 175 aa, Artificial Sequence; identical to SEQ ID NO: 5972
  Synthetic

SEQ ID NO: 5974 - protein, 175 aa, Artificial Sequence
  Synthetic
SEKDEELKRIKEDLERHERESEDDVRRNEEKIRRHRRKTEEAVKEVEEELKRLEEDVRREGPGRDELEKASEDMKRRLDELRRRIEESMKESDKHLRELEEKVRRSSRRFEEELKKLERDRDLERLRKEIREVIEKSKDLLRELRRRHEKVIEDSEDILRKLEKKIKDLVDKIRK

SEQ ID NO: 5975 - protein, 175 aa, Artificial Sequence; identical to SEQ ID NO: 5974
  Synthetic

SEQ ID NO: 5976 - protein, 175 aa, Artificial Sequence
  Synthetic
SRKDEEVKRVKEKLKKHEERSRDMVRKVEDKSRRHREKIKEAEREVRRRIEELEEDVRRRGPRRDELERVKRELEKRLEELEREIRKSLEDAKRDLERLKREIDKSLEELKRELEKLEEDKKLEDLREEAERVIRRSEKLLEELREHVERNIDEVREILRELAELVKRVIDEIRR

SEQ ID NO: 5977 - protein, 175 aa, Artificial Sequence; identical to SEQ ID NO: 5976
  Synthetic

SEQ ID NO: 5978 - protein, 184 aa, Artificial Sequence
  Synthetic
SVEDILRTLRRLLEELEEESERILKRLREIIETNVRRVKELLRRLKERLDELAERLKAKVREEEVLRRLAEELKRAEDELRKLEEDVKKSVKELRDKLETLRRDVRRNLEEIRKELEKIEKDRVTSKELDDLLKKVEEHLRRHKRKLEKALKDVEDESREHEKELRRALKRIERLLRELERKAD

SEQ ID NO: 5979 - protein, 184 aa, Artificial Sequence; identical to SEQ ID NO: 5978
  Synthetic

SEQ ID NO: 5980 - protein, 180 aa, Artificial Sequence
  Synthetic
DEEEVIREIEKRFRDLIRRAEDVLRRIAEKMKRLKDKTRRLLEELRESNRKLIKELRDRIRDERLRKEVEDLEKTSRDRLDAIREELRESEERAREILDRIRRLIEELRRTAKERLDELRDTRRSKEVRDRVEEELKRIEDRLRKLDTDVDRYLKEHEDRLRKLKEDNERDLKRVEERAR

SEQ ID NO: 5981 - protein, 180 aa, Artificial Sequence; identical to SEQ ID NO: 5980
  Synthetic

SEQ ID NO: 5982 - protein, 177 aa, Artificial Sequence
  Synthetic
DIEELLKEVKKEVDRVEKKVKELIDRNKERVDRVREENERVADEVRKLIKELRDRIRDDEEVVREVEEVLRRVEKKLDELSRHVDEVLKESEDRLRKVLKLVREVLEDATKLLKDIETRELVEKVAREAREKLKKVEDLLRKISRRSEELLRRNREATKKILKELRELLRRVEEKRR

SEQ ID NO: 5983 - protein, 177 aa, Artificial Sequence; identical to SEQ ID NO: 5982
  Synthetic

SEQ ID NO: 5984 - protein, 185 aa, Artificial Sequence
  Synthetic
SEAEEALKRHRKLNKEAEKRAKDATDDSKRLLDEIRKRAKEASEDSKRLLDEARRLREAGARKEEVEKIIDEAAKKSKKAAEEARKAADDAARKSRKAAEEAKKLADDSARDAERAAREAKDREDKERVRRILEEAKKTARELRERIKKLLKENEDAAKKLRDEIDEAAKKNKKAADEAREEARR

SEQ ID NO: 5985 - protein, 185 aa, Artificial Sequence; identical to SEQ ID NO: 5984
  Synthetic

SEQ ID NO: 5986 - protein, 185 aa, Artificial Sequence
  Synthetic
SELEKVLEEHRRLNDEIRKELEDVTRKSEETNKRIEEDLRRVTKEAKDLLERIKEKLEAGRRKEEIREEVKKVLEDSERVIEKVKRLLDESLDRSRKMIKKVEDLVRDSLRKAEEVIRRVRDKEDRRRVEEILRDMKETVDKLKKEIEKLLEENKESAKELRERIKENLETNRDLVRKLEEDIKR

SEQ ID NO: 5987 - protein, 185 aa, Artificial Sequence; identical to SEQ ID NO: 5986
  Synthetic

SEQ ID NO: 5988 - protein, 175 aa, Artificial Sequence
  Synthetic
DEAEKALEEVRDLIREIRERDRKVTEDVERLNREIREKLKEVTERVKRSNDDIRRLLEEGRDKREIKKLIEESNELVRKVVKEATELIRDSNRLVKEAVDTSRKLIKEVLDRVREMPVDKSILEELERLVRELRKESEKSLEDLERLNKKLEDEVRDILRKLNKLNEDLLRKVEE

SEQ ID NO: 5989 - protein, 175 aa, Artificial Sequence; identical to SEQ ID NO: 5988
  Synthetic

SEQ ID NO: 5990 - protein, 175 aa, Artificial Sequence
  Synthetic
SEMDEARKEVKKLLDEVRKRDEDVTRKVEELNKRIEERAKRVAEEVEKLIREILKRLRDGSRKEEARKLLEEVKRTVDKMIKELEELVRRSNRVVKEAVKESRELIKRILERVEKVPVDEKILEDLRRLVKKLKEESDRSLERLERLNERLERRIREILKRLEKLVRELRKEVER

SEQ ID NO: 5991 - protein, 175 aa, Artificial Sequence; identical to SEQ ID NO: 5990
  Synthetic

SEQ ID NO: 5992 - protein, 175 aa, Artificial Sequence
  Synthetic
SEAEEALRKVEELIRRVKKRDDEAVKEVRELNKRIADILREVLETVRKLLEDVEKALRDGSDKREARKLLEEILEAVKRAADRIEDLIRRSNEAVRRVVEESRDLIKRILEEVERAPVEEDILRTLRELVRDLERKSEESLKELNRLNEDLKREVKRVLDELEELVRRLKKKVDD

SEQ ID NO: 5993 - protein, 175 aa, Artificial Sequence; identical to SEQ ID NO: 5992
  Synthetic

SEQ ID NO: 5994 - protein, 185 aa, Artificial Sequence
  Synthetic
QVEDVIRESKKLTEDSEKRVRDIIRRLKKTIKDSEDRVRRMVEELRERIKRLRERLESEDERVVREVERVVRELEKLVKEAEDRARKFLETSDRIVREIEKRAREMLEESKRVLEEIKRLADEGVSDEVIETLLRKDRDLNRRVNEELRKLEEEVEELNRRVNETIKEILRRIAELIRRILEKTK

SEQ ID NO: 5995 - protein, 185 aa, Artificial Sequence; identical to SEQ ID NO: 5994
  Synthetic

SEQ ID NO: 5996 - protein, 185 aa, Artificial Sequence
  Synthetic
KVEEILKELEELIKRSKETVDEVIKRSKDLVDESRRRIEDVIRELEKLIRELDKKLETDDKDVVKEVKEAVKRLRDEVKRIDDEVRRAVEKSKEVLDEIRRRVDELVKRSKRLVDDIRRLLAEGVSEEVVRTLVKEIRDLNKRVNEEIKRLLDEDKKLNEEVNRLIKELKKEIEDLIREVLEDKR

SEQ ID NO: 5997 - protein, 185 aa, Artificial Sequence; identical to SEQ ID NO: 5996
  Synthetic

SEQ ID NO: 5998 - protein, 185 aa, Artificial Sequence
  Synthetic
EVEDIIRESKKLIEDSKERVKEVIKESKRLIEELERTVREVIKELRERVDRLRKKLRDDNEEVERRVTEAVERLKELIERIRREVEEAVRRSEETLEELKRRADKLVEDSRRVLEEIKRLADENVSKEVLDTLLKEDRDLNEDVKRRITELLEEDRRLIEEVKKRIRELRERIKRVIEEVDRATT

SEQ ID NO: 5999 - protein, 185 aa, Artificial Sequence; identical to SEQ ID NO: 5998
  Synthetic

SEQ ID NO: 6000 - protein, 175 aa, Artificial Sequence
  Synthetic
STAEEIVRRIRDVNRRINEAIERLLEEDEKVIRDVERRIEEVLERDRRVIEEVKRRVRTEEVVERVIRRSEKTIEDLKKLVEKLLRDSARTIEKIERLVREVIKETKRLLEEIKRRNVDERIIEEIKRILKESEDRLRRILETSRERLKELKKKLERVLEDSKKKLDELRRELRK

SEQ ID NO: 6001 - protein, 175 aa, Artificial Sequence; identical to SEQ ID NO: 6000
  Synthetic

SEQ ID NO: 6002 - protein, 175 aa, Artificial Sequence
  Synthetic
REAEDLVRKVREVNKKANRDIKELLDRDEKVIREVARAAEAIVDEARRIVEEVERKIREERVAKEVLERLKKILDELAELAKRVLERSEETIERIERLAREVLRATRDLLEKIRKNNVDERIIKEIKETLDESRKRAEEVLEKSRRLLEELRKRVEEIVKRIKELIDELERRVRK

SEQ ID NO: 6003 - protein, 175 aa, Artificial Sequence; identical to SEQ ID NO: 6002
  Synthetic

SEQ ID NO: 6004 - protein, 187 aa, Artificial Sequence
  Synthetic
SAEEIIKTLEELVEKLKRDAEETLRKIEELVRRLEEEARKSSEKIRKLVEDLAKEARERTRSKEVEKIVEEAKRRLDEIIKRNNEVVKRVLRELEELIERNRKVVEDALRELKKLIEKLEDLVRRNTGDEVLTEVLKEITELVKRLKELSDRTLEEVRKLVERVKRESKRTLEEAEEVVRELKERLR

SEQ ID NO: 6005 - protein, 187 aa, Artificial Sequence; identical to SEQ ID NO: 6004
  Synthetic

SEQ ID NO: 6006 - protein, 187 aa, Artificial Sequence
  Synthetic
DAERLLREVEELVRRLEEEMEKTDREIKELIKRLEERLRTTSREIKKLIEDLEREARERTRSEEVDRIVKEVIERLKRVLDKNNEIMERARERLERLLEENKKIVDEVLKELKELIDRLKDLVDKNGGREVLKKVIDEIRKLVKRVKDESKRSLDEIRKLAEEVDRRSKKVLDEIRRLVDEVRERLR

SEQ ID NO: 6007 - protein, 187 aa, Artificial Sequence; identical to SEQ ID NO: 6006
  Synthetic

SEQ ID NO: 6008 - protein, 187 aa, Artificial Sequence
  Synthetic
DAEDILREIKKLADDLKREADKSLKEIEELARRLEEEAERSLREIEELARRLKKRADEKTTDKKAEKIAREALKLAKEAAEENKKVAEEAAELAKRAADEDKKVAEEALKLAREAAEDARRLAEENGGREALKRAAERARELADRARKLSEDTLRKAKKLADDARKLSRETLEKARELAERAERRLT

SEQ ID NO: 6009 - protein, 187 aa, Artificial Sequence; identical to SEQ ID NO: 6008
  Synthetic

SEQ ID NO: 6010 - protein, 178 aa, Artificial Sequence
  Synthetic
DEAEEVRERVKKLIEESKRLIEEVRRRVRTISERSAELIEEVERRVDKMARDVERLLKDNVDKRELKRVVDDILRLVETVIARLRDTVRDLDRLVEEVIRRLHETDRRLKEEIDDAFRRLQDDEVLRRLEKLVRDSNDEIRRVLKELKEVVKKNRDEIERVLKEARKKVEDLLREIER

SEQ ID NO: 6011 - protein, 178 aa, Artificial Sequence; identical to SEQ ID NO: 6010
  Synthetic

SEQ ID NO: 6012 - protein, 178 aa, Artificial Sequence
  Synthetic
SEVERVRRENEETIRRIDEVIKKIEEDNKRTIDEIRDVIRRVKETVEKTNREIEKVRRDNRDKRDLDKLIKDSNRLVREVIERLRRLVKESLDTVKKAADELKRLVKESKELVEDVIRRVRDDEALRELRKSNEDLERRIRKVLEDLKRSNDELLEEIDRVLKRLHKSDEDVRKRVTD

SEQ ID NO: 6013 - protein, 178 aa, Artificial Sequence; identical to SEQ ID NO: 6012
  Synthetic

SEQ ID NO: 6014 - protein, 174 aa, Artificial Sequence
  Synthetic
RELEEAEKTVEELIRRIKEIIDEVLKRDRDVSERSKELIDKVKREAEKIVEEIERLLKNNVDRDELRKMVERLRELVKKVLEELRKTVRELEETSRRALERLRRLLKRLREIIEKDVRSEVLRKLDKKVKDLKREIDDVVRESKELIKRNRRRVEEVAKELERLIKEVKDRIDT

SEQ ID NO: 6015 - protein, 174 aa, Artificial Sequence; identical to SEQ ID NO: 6014
  Synthetic

SEQ ID NO: 6016 - protein, 174 aa, Artificial Sequence
  Synthetic
DELERVREEVRRLIKEIEEIIERVERRDEEVSRKSEDLIRRVLKRDEELAKEIEDLKRNNVDKKELRKMVKKLEESSRRALERIRRTVKELEETSREALKRLEDLLRELEDVIRKLVRSRVLEELKRLVEELEREIRRVFEKSKKLIDDNRKKADDVVKRSEDLLREVKKEIDR

SEQ ID NO: 6017 - protein, 174 aa, Artificial Sequence; identical to SEQ ID NO: 6016
  Synthetic

SEQ ID NO: 6018 - protein, 178 aa, Artificial Sequence
  Synthetic
SESEEVERLVEDVSRRNTKAVRDIEEHSKDVSRRNKKLVREVEEHTREVIERAKELTKRRKTEEVIKRVLDTLERLMRESVKLLEETVERLRRLVEKSKRLIEKTMKELRDLIKKVVEDITGRDVVERIRRLLRENVEENKKVLKRSDDLLKKNERENREVVKKSEKDARDLVEEIKT

SEQ ID NO: 6019 - protein, 178 aa, Artificial Sequence; identical to SEQ ID NO: 6018
  Synthetic

SEQ ID NO: 6020 - protein, 178 aa, Artificial Sequence
  Synthetic
SEEEDVRRKVEKVSRENKDMVRRILEHSRKVSEDNRRLVKEILDRARKAIEDVKELIERLKREEDIERVVRELRKLVKTVLDLIRETVKRLRDLVRKSKELIKETVKELERLIEKVIRDITGRDVVREIKELLDRNREENRKVLEDSERLVDENEKDNKRVLDELRRLLKRAEEEARR

SEQ ID NO: 6021 - protein, 178 aa, Artificial Sequence; identical to SEQ ID NO: 6020
  Synthetic

SEQ ID NO: 6022 - protein, 184 aa, Artificial Sequence
  Synthetic
SIDKALRDLKEILDRNRKHSEDLLREAEELVERSNDHSRRVLEEIRKLLRELEEEIRKRVKDEKKLRELKEIVDRIRELAEELFRRSNESDKRIKETVEDMIRKSRESVKRIEELIREVIERIRDEKLVREVEKTVEDLSRENKKLNEDVKRTVDELIKKSEKLNEDAKRTIDELLKRVKERIE

SEQ ID NO: 6023 - protein, 184 aa, Artificial Sequence; identical to SEQ ID NO: 6022
  Synthetic

SEQ ID NO: 6024 - protein, 184 aa, Artificial Sequence
  Synthetic
SVEDLLRKLKTIVDENRERVKKSLEELRRILDENRRRVERSLRELRESNERLRKEIEDTVKDEEKLRRLRDLVRRSAERVEDAVRRSRETVREVEDRVEKLADESRKTVERVRELIEEAIKRITDEEVLKKVEETVKRLSDENRELNKRIKEEVDEMSKRNKELNKRIKEENDKLIKEVKDEIR

SEQ ID NO: 6025 - protein, 184 aa, Artificial Sequence; identical to SEQ ID NO: 6024
  Synthetic

SEQ ID NO: 6026 - protein, 183 aa, Artificial Sequence
  Synthetic
SVEDVLRELKELIDRNREEAKKTEKELRELIKRNDDEAEKVAKESKKLTEDLEKEAREKVRSRKLEEIKRILDENREVLRRVLEDSKRSVRELKELVDRVIRKSEKIVDDLRKLVERLAREVRDEKVLREAKERAKEISKRNKDVNEEARKRIKEISDKDKRILDEVRRESKEIEKRLKEALK

SEQ ID NO: 6027 - protein, 183 aa, Artificial Sequence; identical to SEQ ID NO: 6026
  Synthetic

SEQ ID NO: 6028 - protein, 174 aa, Artificial Sequence
  Synthetic
DDEERVREVVKRVKEDNERVDREIREIVKRLLEHDRELLEEIKKEVDRVAEELRKLKEDGVPEEDLRKVVKDIEELVRRLIDELRKSTDDARRTVEDLIERLRETVRKALELIERVVRSEVLERLRKTLEELEKRNEELLEEARRLLEESREEVRELLERAKKILEDLEREIRR

SEQ ID NO: 6029 - protein, 174 aa, Artificial Sequence; identical to SEQ ID NO: 6028
  Synthetic

SEQ ID NO: 6030 - protein, 174 aa, Artificial Sequence
  Synthetic
SREERVREVVKRMLERDEELLRRIREEVERALRRNDEVLREIERVVEEMEERVERLKREGVDRKDLERLVEEALRVVREAIKELERTTRELEDLIRKLIEELRDSTRKVDELIKRKVTDEVLEDLRRLLEESVRRVEDLLKKLTDIVRESRKRVRDILRKAKRIVDKLREEIKK

SEQ ID NO: 6031 - protein, 174 aa, Artificial Sequence; identical to SEQ ID NO: 6030
  Synthetic

SEQ ID NO: 6032 - protein, 182 aa, Artificial Sequence
  Synthetic
DVEREAKRLLEEVAEHVRRSIKELRKLLEDVARHVEKTLRELEKLTDDVRKRVEKLKRDVKEEEKLKEVVERLKRELDKVSEDAKKLVDENRRLLKTVVDTVRRLVEENRRRLEEVVRRVEEAGVDRKVVEDIREKVKDLKRKHDTVLEEIKKEVRRLEKEHKEVLDKSNEDARKLEEDLRR

SEQ ID NO: 6033 - protein, 182 aa, Artificial Sequence; identical to SEQ ID NO: 6032
  Synthetic

SEQ ID NO: 6034 - protein, 177 aa, Artificial Sequence
  Synthetic
SEREEAKKLLRENEEDNRRVDREVEKLTEENERINRRVNEEVRKLTEDIKRKVESVKRLSDKRMLDKAIKEVEELSERSKDTIRRVIEESKRLSEESKRTIKEVIKRSTDLMRELDKRVTTRDIVEDIRRKADRLRERNEETLKRDEDKLKKLEESNRKVLKEDEDELRRLADKLRK

SEQ ID NO: 6035 - protein, 177 aa, Artificial Sequence; identical to SEQ ID NO: 6034
  Synthetic

SEQ ID NO: 6036 - protein, 177 aa, Artificial Sequence
  Synthetic
SEAEEAAKRSRDTAKRAEEIAREAAERLKKNAEDAERIAREAKKTSKKTAKEAEDAARSNAPEKAIEDAARKNEELARRAAELIERAARTNRKIAEDAARLVREAAERNKELADRAIKTRDADELRELAKRTEDKARKLADELRKLADETEKKARKLAEEVKKLADDTRRKAEEARR

SEQ ID NO: 6037 - protein, 177 aa, Artificial Sequence; identical to SEQ ID NO: 6036
  Synthetic

SEQ ID NO: 6038 - protein, 177 aa, Artificial Sequence
  Synthetic
DEVEKAKEESRRTLKKIEDRVRKVAEDLKKNLEDIERRVREVLEELRRLLEEIEEVVRRNIDKKEIDRLAEEIKEIAKRIIDEIRELLETNRKIVEEILEEIKRLVDENKKLVDRVKETSDKEELERLVEKTEDKIRKLLEEIKELLKETEKKIRKLLKRIEELMKEIEDKIDEDKK

SEQ ID NO: 6039 - protein, 177 aa, Artificial Sequence; identical to SEQ ID NO: 6038
  Synthetic

SEQ ID NO: 6040 - protein, 177 aa, Artificial Sequence
  Synthetic
DEVERVKEELKRNLKEIREDVERVKEESRDTVRKATEIVKRVLEELKKSLEEIKKLVDDNAPERMIEEVLRHNKKLVERIEREIRRLVEENRRLVERVLRRVEELLESNRDIVRDIIRRRDVEELRDTLRKSAEDIERLLREIEDLVRKTTEDAKRLADEVRRLVKESERTIKERAD

SEQ ID NO: 6041 - protein, 177 aa, Artificial Sequence; identical to SEQ ID NO: 6040
  Synthetic

SEQ ID NO: 6042 - protein, 177 aa, Artificial Sequence
  Synthetic
SEVEKVDRELKDNLRRIEEEVRKVDEELRRLLEEIRRTVEEFKERSKRTVEEIEKVARENAPEEVIKEVLRRNRDLVRKVLKTIKDLLDEIRRRAEEIIKKVEDLLESNRRIVEEATKTRDVEELRRTLEESERRIRKLLEDLKRLLEEIEKDIRRLEEEVDKLVRDTEKRIDDLRR

SEQ ID NO: 6043 - protein, 177 aa, Artificial Sequence; identical to SEQ ID NO: 6042
  Synthetic

SEQ ID NO: 6044 - protein, 183 aa, Artificial Sequence
  Synthetic
SLEDELRRRITEAEKRIRDLLRRVRELVERSKKTIKDLLRKLEETARETKDEIRKLEEEVKEEELKELIRRVLEESDKTLEKARKELKEALDRSERSVEKIERLIEEVVKRLREVIERVRDVKEEEKVRRVEREIKEILKKIEEDVTRLLEENKKILKEVEDLVRELEKEDRDVLKKVRDDVK

SEQ ID NO: 6045 - protein, 183 aa, Artificial Sequence; identical to SEQ ID NO: 6044
  Synthetic

SEQ ID NO: 6046 - protein, 183 aa, Artificial Sequence
  Synthetic
DLRERLEEEIERARRDIEDLLRKAEELAKRSKDDIKRLMDEVRRLVEKTRRDIEKLLREVKDKSVKERIKEVLRESEKTMRDIEREIKEVLDKSDESLKKVKEDLERVVRTLDKLIEDVRRVTEEEKVRKVEEEIRRVLEKIRRDARKLLEENKRITDEVRKRVKELLEENRKVLKRIKDEVD

SEQ ID NO: 6047 - protein, 183 aa, Artificial Sequence; identical to SEQ ID NO: 6046
  Synthetic

SEQ ID NO: 6048 - protein, 183 aa, Artificial Sequence
  Synthetic
KLREELEKLAEEAKKRIEDLAREAREAAKRASESNKDLARRLRELAKRTEDEIKRLLDDAKEERAKKLAEDALRRSRETAERADKLAKDADKHDKEIAEKAEELAKKALKDLEEAARRARRADKEEAARKAAEEIKKILEEAERLAREALKELERSNEESERLARRAAEEDKRVADEARERAR

SEQ ID NO: 6049 - protein, 183 aa, Artificial Sequence; identical to SEQ ID NO: 6048
  Synthetic

SEQ ID NO: 6050 - protein, 183 aa, Artificial Sequence
  Synthetic
SLREELRKKIEEAKKRIEKLMDDVRKEAEKAKRSNEELLRRLRKLAKETKRRIEELLERVKDESVKERIRRVLEESDRTLREAEELIRRVNEHDDRILRKIEEEIKRVLEKLEKVIKDVERVDDEEKVRRLLKEIEEILRRIEDKVRKLLKELRDSNRDSKRLVDELMRRDKEVLRRIEEEVK

SEQ ID NO: 6051 - protein, 183 aa, Artificial Sequence; identical to SEQ ID NO: 6050
  Synthetic

SEQ ID NO: 6052 - protein, 183 aa, Artificial Sequence
  Synthetic
DLERELEELIKKAEKKIRDLRKEVEDVVRDASRSNKELLREAEKLAEETRKRIDDLRKEVKDRSVKERIKEVLRESEETLKEVRETLKRMDEHDRTIMREIEERIRRVVEELRRLIEEVRRVDKEEKVRELEKRIRDVLRRIEEEVRRLLKRLKDSNDDSRRRLEELLRRDKKVLEDIERETK

SEQ ID NO: 6053 - protein, 183 aa, Artificial Sequence; identical to SEQ ID NO: 6052
  Synthetic

SEQ ID NO: 6054 - protein, 183 aa, Artificial Sequence
  Synthetic
SLREELERLIKEAEEKIRRLLKEVKDLVRELSRTNKKLLKEVRDLAKRTKERIKRLLDELKEERAARLIEEALEASDRTLKKIEDLIRRVNEHDEEIARRIEEEIKKAVDELRRLIDTVRRVTDEDKVRKLLEDIERLLREIERLVRELLEELKDSNRRSEELVRRLLKEDKDVLEKAERDVR

SEQ ID NO: 6055 - protein, 183 aa, Artificial Sequence; identical to SEQ ID NO: 6054
  Synthetic

SEQ ID NO: 6056 - protein, 174 aa, Artificial Sequence
  Synthetic
DEEEELRRLVRRLMEEVKRLLEENKKLADELRKTVKKLLEDNEDLARRLREEVERKVKSRIMEEVKRLIDEVLRHSKKVIEEVEKEIRDVLRKSEKIIKEAEDLIRRVLELAESGRRDVEEVKKELEELLREVEELSRRSLKELKELLERVKKRSEESLKELEDLLREAERKSR

SEQ ID NO: 6057 - protein, 174 aa, Artificial Sequence; identical to SEQ ID NO: 6056
  Synthetic

SEQ ID NO: 6058 - protein, 174 aa, Artificial Sequence
  Synthetic
SEKEELKKEVDRLAEEVERLLRENEKRARDLERKIRKLLEENRRAADEVRKEVDRTVDSEKADRVRKEIEKVLRHSEKVIREVTKRIRKLLEDSERIIRTAKRLIDEVLRAAEAGEVDVEEVKKRLEDLLEEVKELSKRSEDTLRKLAEDVKRLAEDSNKKLEDLLEEAKERAR

SEQ ID NO: 6059 - protein, 174 aa, Artificial Sequence; identical to SEQ ID NO: 6058
  Synthetic

SEQ ID NO: 6060 - protein, 174 aa, Artificial Sequence
  Synthetic
SEKEELRDLVRRAKEDVDRLRRENEELNRRIEEDIERLLKENEDRNREVKDDIDKRVSSEIVKDARRLNRENHERSKRIIERAKRLNEENHRTSRKIIEEAKKLIDDVLKKAESGSVDVEEVKKELEELLRRVRKLSEDSLKHLRELLKEVRELSERSLRHLDELLRRVREKAR

SEQ ID NO: 6061 - protein, 174 aa, Artificial Sequence; identical to SEQ ID NO: 6060
  Synthetic

SEQ ID NO: 6062 - protein, 174 aa, Artificial Sequence
  Synthetic
KDEEDAERRARESDKSIEELRERNEREAKRLKEEVEKLLEENEKKVDELRKRVEKTVTSEIVDEVRKLIEEVLENSKRIIDEVRKRIEDVLRESEEIIRRVKKLTKRVLDLVKSGSRDMEEVKEELDRLNKEAEELSRRSLRKLEELLREARRLSRESKERLKKLLEDARRKSN

SEQ ID NO: 6063 - protein, 174 aa, Artificial Sequence; identical to SEQ ID NO: 6062
  Synthetic

SEQ ID NO: 6064 - protein, 174 aa, Artificial Sequence
  Synthetic
SDEERAREEARRSKESIERLLEENRRLAKELKKEIRRLLKENEDLVRKLKEDVDREVDSEIAREARKLIKEVLDESEEIIRRVDKKIDDVLRNSERIIREAKRLTERVLRLVDSGSRDIEEVLEELDRLNKEVEELSRRSLKRLEELLEEVRKLSEDSLRKLKELLDRVREKSR

SEQ ID NO: 6065 - protein, 174 aa, Artificial Sequence; identical to SEQ ID NO: 6064
  Synthetic

SEQ ID NO: 6066 - protein, 181 aa, Artificial Sequence
  Synthetic
DERERLRKALEEVRRTVEKLVRENEELLKKVEERVRRLNDEDRRLVEEIKRRADELRKRGEATDEVIERIRKVLTDSERISREILRKLEEMLDRSRKIVEEILRELERVLREIEELVKRVTNDEVIRRVEDELRKVLEDIKRLSDKNKRDLEEALRDIERLVKENNKRLKEALDDLERAAT

SEQ ID NO: 6067 - protein, 181 aa, Artificial Sequence; identical to SEQ ID NO: 6066
  Synthetic

SEQ ID NO: 6068 - protein, 181 aa, Artificial Sequence
  Synthetic
SEREDLKRELDEVRKDVARLNEEDRRLLEDARRDLEKLVRDNEELVERVKKTLKELEDRGELTEEVVEELDRVLDESRKIVEEILREAEKVLKESEEISKAIVKRAEDVIREIEELVKRVKTDEVIRRVRDRLRRVDEELKELVKRNNERLREVLERIRKLSRDNSERLKAALEKIKEEVR

SEQ ID NO: 6069 - protein, 181 aa, Artificial Sequence; identical to SEQ ID NO: 6068
  Synthetic

SEQ ID NO: 6070 - protein, 181 aa, Artificial Sequence
  Synthetic
SLKEKIEKLLEESRKDIEELNERDKKRVKESEDTVRRLNEEDEELVKRVREELEKLRKEGRLDDRVVEDARRMLERSRRISEEILKENRRVLEESKETSKRILEDNERAVREIKELIDRVRTEEVIKEVEKRLRDVTKTSREKVRENNRRLEEMTEDTKRLVEENNKDLDKALKDIRKKAE

SEQ ID NO: 6071 - protein, 181 aa, Artificial Sequence; identical to SEQ ID NO: 6070
  Synthetic

SEQ ID NO: 6072 - protein, 181 aa, Artificial Sequence
  Synthetic
KEREELEKLLEEVERDVARLNKEDKDLVDEIRRRVDELVKRDKELLDRVRDRLRELSERGDLDERVEEKLERVLRESEKITREIRERVREVLRESEKISEEIVRRARKVIEEIERLLRKVTDSRVIEKVKRDLRRVLEELRRLAEENNRRLDKALKELEDLVRKNNKKVEDALRKIEEEVR

SEQ ID NO: 6073 - protein, 181 aa, Artificial Sequence; identical to SEQ ID NO: 6072
  Synthetic

SEQ ID NO: 6074 - protein, 184 aa, Artificial Sequence
  Synthetic
ELAEDLRRLLKEVEDRSRDLLRKNRKLLEEVRERTERLIKELEDLLEEITRRVKDLIRKIKDEELLKKLEDLLREIEKLVREALERSRKTLEDIRKRVEDMVRRSKEVLERIRRLVKEAIEKLRDEELVRRVKEEIKRLMEEDKKLNKKSVEEIRELLKRDRDLIEEVKKEAERLLKEIEDEVR

SEQ ID NO: 6075 - protein, 184 aa, Artificial Sequence; identical to SEQ ID NO: 6074
  Synthetic

SEQ ID NO: 6076 - protein, 184 aa, Artificial Sequence
  Synthetic
DLERELEKLLDEVRRRVEELNKRNEDLARKVAEDTKELLKELRELLEEVKRRVRDLIRKITDEKLARELEDLLRKIEEDVKEAIKRSEETLERIIRDIERMIRESERLLREIEELVKEVIAKLRDREVAERVKEEIRRLLKEIEELNKRSEERIKKLLEDDRRLIERVKERIEDLLRRIEERTR

SEQ ID NO: 6077 - protein, 184 aa, Artificial Sequence; identical to SEQ ID NO: 6076
  Synthetic

SEQ ID NO: 6078 - protein, 179 aa, Artificial Sequence
  Synthetic
DEVDELLKRLEDSSRKAEEDVKRMLERLEDSTRDAARRVKEMIKRNEEVSDEAEKRIRTEEVVERVLRTSREIIERIREVVKETNKRDKEIVDEVKEVVRETNERDKDIAKKLRDRVRNLDKVVKEIDDLLRESERRNRELLREIEELLKESERINRELLKEVDKVLRDSEERVERRRE

SEQ ID NO: 6079 - protein, 179 aa, Artificial Sequence; identical to SEQ ID NO: 6078
  Synthetic

SEQ ID NO: 6080 - protein, 184 aa, Artificial Sequence
  Synthetic
DLERRLDKILRDIEEAARDNIRRNEELLKRSEENVRRNLEENKKKLEEIKREVEELERRVKDKDLLKEIRDVLERIRRVVERALKEIKDLLRRSEELVRKSIEDIRRVLERIRRVVKDVKERIRSEELAKRAEERLRELLKELHEISKKMLREIKRVNDEINKVSKESLDELDELVKEIKERTR

SEQ ID NO: 6081 - protein, 184 aa, Artificial Sequence; identical to SEQ ID NO: 6080
  Synthetic

SEQ ID NO: 6082 - protein, 184 aa, Artificial Sequence
  Synthetic
SLEEELRKMLEKVERDVRRNIERNKRLLDRSRENVKENIKKNRELLKEIEKDVRKLETDVKDKKLLDEIRKILEEIAKLVEESIRRIEEALEKSERLVERSIREIKRVLDEIRRLVEEVRKRIRSEKLAEDAKRRLEELVREIHKISEDALEEIKRVNKEINDVSKEMLDRLRELLKEIKERTR

SEQ ID NO: 6083 - protein, 184 aa, Artificial Sequence; identical to SEQ ID NO: 6082
  Synthetic

SEQ ID NO: 6084 - protein, 184 aa, Artificial Sequence
  Synthetic
SLEEELEKLLDEVRKEVKKNIDENKRLLDKSREEVRKNIKTNEDLLRRIEEKVRRLLEEVKDKDLLEKIKEMLKRIKELVEESIRRIREVLKRDEELVKKSIDDIRRVLKRIEDLVEDAKRKIRSEELAERAKRELKKLEEEIHRISREALERSKKTVEELHEISKRMLDELKRVDKRLEDETR

SEQ ID NO: 6085 - protein, 184 aa, Artificial Sequence; identical to SEQ ID NO: 6084
  Synthetic

SEQ ID NO: 6086 - protein, 184 aa, Artificial Sequence
  Synthetic
DQREDLDRRLREIEERVEENLRTNEELLKEVEKNAKENIDRNRKTLEDIKRRVDDLRRRVKDKDLLKRIEEMLRRIERMVRESIKKIKKVADDIRRLVKKSIDDIRRILEEIRRVVEEVKRRLRDDELVERVKDELRKLVKEIHDVSKKALEDLERLLRELNEISERALRTLEKLLRKLEEDTR

SEQ ID NO: 6087 - protein, 184 aa, Artificial Sequence; identical to SEQ ID NO: 6086
  Synthetic

SEQ ID NO: 6088 - protein, 184 aa, Artificial Sequence
  Synthetic
SLEETLKRILDKVREEAKRNIKENEDLMRESRRNVEENIRRNEKTLEDIEEEVRRLREEVKDEDLLRKIEKVLKEIRDLVRESIRKIRELLEEDKKLMDTSIRIIEKLLKELEELVDDIIKRIRSEELAKRVKEELDKIVRRVHEISRRALEESRKTVEELNRESEKVLRELERLLRRLEEEVR

SEQ ID NO: 6089 - protein, 184 aa, Artificial Sequence; identical to SEQ ID NO: 6088
  Synthetic

SEQ ID NO: 6090 - protein, 184 aa, Artificial Sequence
  Synthetic
SDEDDLRRILEEIRRNVERNIRENERLLDEIKKRVDENIKTNKKTLEDIREEVRKLEEEVKDKDLLRTIREMLRRIEEMVRESITRIRKVLDDIRKLVEESIKEIKRVLEEIKRAVEEVARRLRDRELVKRVEDTLRDLLRKLNEISKRALEELKRAVERIHRISRDALRELDRLRKELEERTR

SEQ ID NO: 6091 - protein, 184 aa, Artificial Sequence; identical to SEQ ID NO: 6090
  Synthetic

SEQ ID NO: 6092 - protein, 184 aa, Artificial Sequence
  Synthetic
DDEERLDKILRDIEENARRNIERNRTLLERSRENVKRNIDENRRKLEEIRRDVEDLKRKVKDEDLLREIEDVLRKIEEVVKRSIDKIRKMLEDDERLVEESIRRIREVLKRIRDLVEDVKRRLRDKELVKRAEDELRRLLKELNEISERMLRRSEETVRRLNEVSERALRELDRLRKKIERRTR

SEQ ID NO: 6093 - protein, 184 aa, Artificial Sequence; identical to SEQ ID NO: 6092
  Synthetic

SEQ ID NO: 6094 - protein, 184 aa, Artificial Sequence
  Synthetic
SLEETIRRILEESERNVKRNIDENRKLLKEIRDNAKRNIDENRRLLEEIERTVRDLERRVKDKDLLKEIRDVLERIRKLVEESIKRIEDLVRDVERLVEESIREIKRVLDEIRKLVKEVEDRIRSEKLAEDVLRELDKANKDINEISKKMLEDLKKAVEDVNRVSKEMLERLKRLREEIEKRTR

SEQ ID NO: 6095 - protein, 184 aa, Artificial Sequence; identical to SEQ ID NO: 6094
  Synthetic

SEQ ID NO: 6096 - protein, 184 aa, Artificial Sequence
  Synthetic
KDEERLDEILDRSRRNAETNIKRNKDLLDESRENVKENIKKNEDLARRIRERVEDLERKVKDKDLLKEIRDILREIEKVVEDSIRRIREMLRRDEKLVKDSIDEIRRVLKRVEDLVEDVKRRLRDEELVKRVEDELRRLNEEVNKISEEMLKRSKDTVRELNKVSEDALRKLDELRERIERRTT

SEQ ID NO: 6097 - protein, 184 aa, Artificial Sequence; identical to SEQ ID NO: 6096
  Synthetic

SEQ ID NO: 6098 - protein, 184 aa, Artificial Sequence
  Synthetic
SLEEDLRRILKEIRDNVRENIRTNEELLKRSRENVKENIERNKKLLREIEEEVRRLEREVKDEKLLRDIRRVLEEIRRDVERTIREIKRVLDEIAELVERSIREIKRVLDEIDRMVKEAEDRIRSEKLAKEVKDRLRDLLRKLNKISEDALRELKRLNDEINRISEEALERLKKLLEDLERRVR

SEQ ID NO: 6099 - protein, 184 aa, Artificial Sequence; identical to SEQ ID NO: 6098
  Synthetic

SEQ ID NO: 6100 - protein, 184 aa, Artificial Sequence
  Synthetic
SLEEKLRKILEESRENVERNIRRNEDILRKSRRNVEENIKTLEKILEDIKRTVDKLKKDVKDEELLKRIEEELRKIEDRVRRVIREVEKLLRDSEELVKRSIEEIRRALERIKELVEEAERRIRSEELARKVERELREMNKELNRISEEALKRIEEVNRDINRVSKEVIEELERLVEKIREDVR

SEQ ID NO: 6101 - protein, 184 aa, Artificial Sequence; identical to SEQ ID NO: 6100
  Synthetic

SEQ ID NO: 6102 - protein, 184 aa, Artificial Sequence
  Synthetic
DLERELRKAAKESRENAEKNKEDNKEAAKRSKENAEKNIRDNEETARKIEEDARKLEKDAEDEDLARTIRKAADEARKAAKESIDEIRRAAKESEDLARDSIRKIDEAAREAKKLADEAEKRARTEDLARKALRDLREANKRANEISKKALDEIRKANEDANRASKKANDDLRRLAEKAKRDAE

SEQ ID NO: 6103 - protein, 184 aa, Artificial Sequence; identical to SEQ ID NO: 6102
  Synthetic

SEQ ID NO: 6104 - protein, 188 aa, Artificial Sequence
  Synthetic
DLERELRELLERVRKDVRDNLETNKKLLEESRKNAEDNLRENDRLLKELEKRVKDLLDELRKDKEVLDKIKKLLDKLREVVERSLKLIEDLLREAEEVVRESLRLIEELLERVEEVVKRAAELIKRGLPEEVVKRVLDDIKRIVDEINRISKEMLDKLKRINDEANKISKRMLDELRRIAEEIEREVR

SEQ ID NO: 6105 - protein, 188 aa, Artificial Sequence; identical to SEQ ID NO: 6104
  Synthetic

SEQ ID NO: 6106 - protein, 188 aa, Artificial Sequence
  Synthetic
DLEERIKKLLEESRKNVEDNEKKNKDSLRRSREEVKRLSDENEKLLKRIRERAEKLKTDLKDDKDLLERIERALREVEDLVRKSKELNDRLLKKSEEVVKRSLDLIKTLLKRIDDLAKKILELLKEGRDKRVVETVLRELERINEEINDISRKMLKENEKILRDIKKINEDMLKRLKEALERVDREVN

SEQ ID NO: 6107 - protein, 188 aa, Artificial Sequence; identical to SEQ ID NO: 6106
  Synthetic

SEQ ID NO: 6108 - protein, 188 aa, Artificial Sequence
  Synthetic
SLEEEIRDILRRAEERVKELTKENERSLRESKKRVEDLSRENEKTLEEIKRDVDRLLKELKDEEEVLRLIEKMLRDARKVVEDARKLNEDLLRESERVVEEVKDKNRRLLEELRRVVEEIKRLIDRGEPEDVVREMLKDLERIVREISEDNARTLEENERILREIEEENKKTLERLREILKRIREEVT

SEQ ID NO: 6109 - protein, 188 aa, Artificial Sequence; identical to SEQ ID NO: 6108
  Synthetic

SEQ ID NO: 6110 - protein, 188 aa, Artificial Sequence
  Synthetic
SLEEEIRKILKRIREEVKRLTEENDKTLKDSERNVRENLTEIERILREAADDVRRLEEELREDERVLELIKRADKKLKDLVRDILRRIDEMLKRSREVVREVKRTNKEMLERIERIVKRATDLIREGRPEEVVERVLRELERLLEEIRDRNKKTLDDLRRINEEVNRISKDALEELRRLLRELRELVK

SEQ ID NO: 6111 - protein, 188 aa, Artificial Sequence; identical to SEQ ID NO: 6110
  Synthetic

SEQ ID NO: 6112 - protein, 188 aa, Artificial Sequence
  Synthetic
SLEDEIRKILDELRKNVRENLEDNKRVLREAEEEAKKLSEDNRRLLKELKERVKELKDRLRSDKDVLKEIDELLKELERVAKEVEDRNRRLMERVRDVVRRSLEEIKRLLEKLEDVVRRVERLMDEGRPEEVVRRALEEIERINRDINRRSKEVLDELREIVREAKEDNERTLRKLKKILEEIEEKVR

SEQ ID NO: 6113 - protein, 188 aa, Artificial Sequence; identical to SEQ ID NO: 6112
  Synthetic

SEQ ID NO: 6114 - protein, 188 aa, Artificial Sequence
  Synthetic
RLKEELERILREAEKNVRENLRRNRESLKESKETVDRLSEENKKTLEEVRTTVEELLKELKDKREVLKRIKEMLDTAKELVERALELNRDLLRKSERIVTESERLIKELEEELRRVVETVTRLLAEGRPEEVVRDALRKLEEINRRINEISERMLKENKRLLEEIKRINKETLDRLKELLEEIKEDVR

SEQ ID NO: 6115 - protein, 188 aa, Artificial Sequence; identical to SEQ ID NO: 6114
  Synthetic

SEQ ID NO: 6116 - protein, 181 aa, Artificial Sequence
  Synthetic
SDVERVEKELKKTNDELRKIVDEARKLLEKTNKEIRDINRTMMEELRRTNEDLKRVVERGEDRSVLKEILERSEKLVRESIKKNEDLLRESKRVVDKVIREIERILEKSRELVREALRRLTDRRVIERIREIARKNEEDVKKLLKELKDLLEKNKRDVEKASEENKKLLEDNERDVRREST

SEQ ID NO: 6117 - protein, 181 aa, Artificial Sequence; identical to SEQ ID NO: 6116
  Synthetic

SEQ ID NO: 6118 - protein, 181 aa, Artificial Sequence
  Synthetic
KEAEEAAKLLEDTNRRLKEIAEEAEELLRRTNEKAKKINDESREKIKDAARRAEDAARRGRPEKDLEKAARDAEEVAKRAIEESRRAARESEELAREAAKRLKKAADDSRRLAEEAARRLTDEKAIREIKELAKKNKEDAERALERIKRLADKNREDAKRADEDNERAAEEARRKAEELKR

SEQ ID NO: 6119 - protein, 181 aa, Artificial Sequence; identical to SEQ ID NO: 6118
  Synthetic

SEQ ID NO: 6120 - protein, 181 aa, Artificial Sequence
  Synthetic
DEAEDVERKLEATNKELNEINERSRKELETSNRELNRINTESEEEIRRIEERIDRVKKRGEPREVLRKIVKEIKDVVKRAIDLSREVLERSERIVREVIKDSERILRESERLVREALRRLDKKELIERIKRLLDKNREDVKRMNEDNKRLLKENRDDVKRMDEKNKKILDEVDEKAKEKEK

SEQ ID NO: 6121 - protein, 181 aa, Artificial Sequence; identical to SEQ ID NO: 6120
  Synthetic

SEQ ID NO: 6122 - protein, 177 aa, Artificial Sequence
  Synthetic
SEEEELKKLLDRVRERVERSLDEIRRLAREVEEHVKKVNDDIRRLLDEIRREVEDIERRVKDKDVLKKLREVLDEIEKLVRKVLEESTRSLEKARELVKKALERNERLLEEIEKLARDIPAGDEVRELVRTLEERIDDSTREVKKLIEDLKRENKRILDTVRDLVRRLREKIKRIAD

SEQ ID NO: 6123 - protein, 177 aa, Artificial Sequence; identical to SEQ ID NO: 6122
  Synthetic

SEQ ID NO: 6124 - protein, 177 aa, Artificial Sequence
  Synthetic
DEEERLAELLERVKRDVDRSLKRIRDLLKELEKHAKEVNDDIRRLLEEVERRVREMEKRVKDKDVLKKLKDLLDEIRRRVEDALRRSTTSVDKVRKLVERVLENNKRLLEEAEDLVRRIPAGREVEELIRRMLKRIRDSTKKVEDELRRILEENRRILEEVRREIDELKKAIDEISR

SEQ ID NO: 6125 - protein, 177 aa, Artificial Sequence; identical to SEQ ID NO: 6124
  Synthetic

SEQ ID NO: 6126 - protein, 177 aa, Artificial Sequence
  Synthetic
SEEERLEELLRRIEKHSRELIRELEKSLEDSEREVRKSLKRIEELLRRAERKVREIRKRVKDKDVLRELERLLREAEKRVREVLRNNERLLREDEELTKEVIKKSKKILDEIRDLVRRIPAGREVKKVLDDLLKRDRDAIDEARKLNEEMLKRIEDSSREVEKLLADMEKTIEDIEK

SEQ ID NO: 6127 - protein, 177 aa, Artificial Sequence; identical to SEQ ID NO: 6126
  Synthetic

SEQ ID NO: 6128 - protein, 185 aa, Artificial Sequence
  Synthetic
SIDDKARKDLKRILDENRDIVRRVEELIRRSDELLKRILDDVKRRIDELRKKLEDIARKVKSKDMAELLERVLREIEDLIRRVLERIKKVLDESRKLVEEVLKENKKSLEKVERLAREVKTRIKDDEDVLRDIDRLLKEIKKHAEDSLRKIEKLLRESEEKVKDILRKIKKLLDEARKEVEDRRR

SEQ ID NO: 6129 - protein, 185 aa, Artificial Sequence; identical to SEQ ID NO: 6128
  Synthetic

SEQ ID NO: 6130 - protein, 185 aa, Artificial Sequence
  Synthetic
SIAEEVEELIRRLETKNRKIVKDVEDAIRASDDKNRRVLDKVRKDVERLKRELDRIAKEVKSEEALKLLTRILEEAEKLARDAERLNKETLDESRDLIRRVKELNKTSLREARRLAEEALRRIKDDKEVLDRIKELLKKLEKHVKDSLDKIDDLLRKSEKHVRESLETIKRLLEELEREVERLAR

SEQ ID NO: 6131 - protein, 185 aa, Artificial Sequence; identical to SEQ ID NO: 6130
  Synthetic

SEQ ID NO: 6132 - protein, 185 aa, Artificial Sequence
  Synthetic
DEKREVERLIRELIEENRDIVRRVEKLVRESNKKLDEILEEIRERLERLREKLKDIKRRVKSKDALKLLEDVLKEARETVTRVEELLRKLLEESRKLVEEAKKRNKDSLRKVEELVRDAETKLKDNEEVLRRIRELLERVEKHVRDSLRRIDELLKRSEERVRRIIREVRERLKRLEEEVREAKR

SEQ ID NO: 6133 - protein, 185 aa, Artificial Sequence; identical to SEQ ID NO: 6132
  Synthetic

SEQ ID NO: 6134 - protein, 185 aa, Artificial Sequence
  Synthetic
SISEDAERLVRELLRKNKEIRDRVEELVRRSNDKNRRVLEEVEKRLRDIIRKLEDIERRVKSEEMKKLLEEVLKEAEDLVREVLKLNDDTLRESEELVKKAKEDNERSLEEIRELVERVERRVKDNEEVLRRIRDLLRRVTEHVEKSKRDIEKLLRESRDHVRRSKEKIKRLLDEARERVERSKK

SEQ ID NO: 6135 - protein, 185 aa, Artificial Sequence; identical to SEQ ID NO: 6134
  Synthetic

SEQ ID NO: 6136 - protein, 176 aa, Artificial Sequence
  Synthetic
DEEDKLRKLLEEAREAVKRALERVDKLLRDSEREVRRILEEVKKLLDESRKAVEDIRRKATDEEALERIDRVLENSEKIIRDIAELIRKVLEESRKIAKEARELIKAVLKEAEDIIREVSSEEAEELIRRVIRKAEKLLREVEELLRRSNDKLRKLTEKVRTDLERSKKRLEDEAR

SEQ ID NO: 6137 - protein, 176 aa, Artificial Sequence; identical to SEQ ID NO: 6136
  Synthetic

SEQ ID NO: 6138 - protein, 187 aa, Artificial Sequence
  Synthetic
SILEKVRELLERIRDTVRKILREIEKSLEDNKRHSDEVLKEIEDLLRDLERRVKEIEERIKDKDVLKKVKEIVDDVRRRVREVLEKNRRIAEDSERLVEEVLRRLKELLDEIKKRVDDVLRKLEERETEEILEEIERLIREVRRRLKKILDDVRELSRRANEKDRKSLEEVRKLVEDVRRELERVAT

SEQ ID NO: 6139 - protein, 187 aa, Artificial Sequence; identical to SEQ ID NO: 6138
  Synthetic

SEQ ID NO: 6140 - protein, 187 aa, Artificial Sequence
  Synthetic
DVEEEVKKLLEDLERHSRKVLEEIKKLLKELEDHNRKTVEDIEELLRELEKEVRKLEEDVKDEDVLRKIRKILDKIRKDVDRVLKLLDESMKEIEKLVRDVLRKNEEVLEEAKERVTRVLRKLRDRETEEILEEIRRLAEELEKEDRKTLKEARDLAREVKKRNEEIKRRVEELIKKVDRELKEVAR

SEQ ID NO: 6141 - protein, 187 aa, Artificial Sequence; identical to SEQ ID NO: 6140
  Synthetic

SEQ ID NO: 6142 - protein, 176 aa, Artificial Sequence
  Synthetic
DEDEDVRRLLRRLREKVRRVKKKIDDSLRENRKKVRKTNEEVKKLLEDNRRRIEDVKRKRQEKEVLDLLEEVERHVEDIVKKVSELDKESLKLSDDLAKKARELIKRVEEKIEKVVKDRRSEEARKLMRELEKELKEIEDEVDKMSEEINRKNDEILRRARELIKRNNELLEEIRR

SEQ ID NO: 6143 - protein, 176 aa, Artificial Sequence; identical to SEQ ID NO: 6142
  Synthetic

SEQ ID NO: 6144 - protein, 176 aa, Artificial Sequence
  Synthetic
SEEEEVRKLLERLERTVEKTNRDVERSLRENEKRVRETNDEVRRLLEENRRRIEDVERKLQDEDVLRLLEEVKKHVEEIVRRVSELDRESLEESKELAKRASKLDEDTRRLIDRVIEERRSEEAKRLIEELEKRNREVKKEVEEMSRRINKKNEEILREARKLIEENNKLLKDIER

SEQ ID NO: 6145 - protein, 176 aa, Artificial Sequence; identical to SEQ ID NO: 6144
  Synthetic

SEQ ID NO: 6146 - protein, 181 aa, Artificial Sequence
  Synthetic
SELDEIAKAIRRLLEEVRRKNERIDEDIRRLLDELREHSEKVLREIEELLRRLEDAVRKRKDADDILRKIKKLIEDVAELLRKSLEEARRLLEEVARLLKTSVDDIKRLIDRVAEELSRVKDKDARKRAKDVLRDLEKKVEDLKRRNDKTLTDAKRELDDSRRRVKRVLDELEKVLRDLKR

SEQ ID NO: 6147 - protein, 181 aa, Artificial Sequence; identical to SEQ ID NO: 6146
  Synthetic

SEQ ID NO: 6148 - protein, 181 aa, Artificial Sequence
  Synthetic
DEAERILEEVKKLLEEVERLNKKIDDEARRLLREVERENEEIDRDIKRLLDEVRKDVERNKESDEILRKIRELIERVARRLEESVRRIRELVKEVRKLVRTSNEDLRRLIRDVAEKMRRVKDEEVRRRAEEVLRELEKVVEDSRRRNEKTLRDMERRIKELEDRNRDTLRKLREVVKELER

SEQ ID NO: 6149 - protein, 181 aa, Artificial Sequence; identical to SEQ ID NO: 6148
  Synthetic

SEQ ID NO: 6150 - protein, 174 aa, Artificial Sequence
  Synthetic
SEEERVRELIERMREMLERLEESNKKVLEEIERVLEKSERDVERVIREIERTLEEVKDNDEVRELVKRVLDDLRRFLDESRKLVKEIVDRLREMAKESKKLVKEVLDRLRELLERNGDTDRVIREAERVLEEVRRRNEKVNKEARDLLKEVEKHSRDVLEDIKRLLEEIRERAR

SEQ ID NO: 6151 - protein, 174 aa, Artificial Sequence; identical to SEQ ID NO: 6150
  Synthetic

SEQ ID NO: 6152 - protein, 174 aa, Artificial Sequence
  Synthetic
SEKERIEDVIRRIEKVLKESRDEADRVKKEIEKRLRELEKRHKEVTTEVKRVAEEVKDNEEVLKEIEDALRENERMVEDVRRLVEDILRKLDKFMRESEELVRRIVKRLEDLLRNNGDSETVLREAEELLRRVKKHSKEVLDRVRELLKRVEEKSERVLRELERVLREIREKAR

SEQ ID NO: 6153 - protein, 174 aa, Artificial Sequence; identical to SEQ ID NO: 6152
  Synthetic

SEQ ID NO: 6154 - protein, 174 aa, Artificial Sequence
  Synthetic
KDEERIEELLRRNEENLRRLEDSNRKVLRENEEILKELKRRHEKITEDLKRELEKVKDNDEVERLVREVLKKNEELAKKVEDLVRRTTERLKRLVDKSRKLVREITERLRRLLEQNGDTDTVLREATELSKEVHKENRRVNEEAKDLSRRVAEESDRILRELKKLLDEIRKRAK

SEQ ID NO: 6155 - protein, 174 aa, Artificial Sequence; identical to SEQ ID NO: 6154
  Synthetic

SEQ ID NO: 6156 - protein, 174 aa, Artificial Sequence
  Synthetic
SDEERIRRVIEDIERKLRELEKRHKEVTRENKENAKELKERHDRVTKDIKKTLDDVKDNDEVRRKVEKVLDENRKMVEKVLELLERISRRNEELMKDVRRLVKEILERLKRLLDNNGDTDRVLEEIKKLLREVEERSDRALREAKKLSKRVHERSKEVIDRLRELLREIKREAD

SEQ ID NO: 6157 - protein, 174 aa, Artificial Sequence; identical to SEQ ID NO: 6156
  Synthetic

SEQ ID NO: 6158 - protein, 178 aa, Artificial Sequence
  Synthetic
DSAREMERRIRELLKRVEDKSEKALRDSKKLTKEVEEESERALRRTEKLLREVAELARRVDKKEIEDIAREIIKDNERVLEDIRRLSEESVRDNRRVLDEIRRLIEEIIEDLERVLRKGDLDEKRVRDVLREIEEVLRRLEERHERLTRDDERVLRELEDRHRKLSERVKKLLEELKK

SEQ ID NO: 6159 - protein, 178 aa, Artificial Sequence; identical to SEQ ID NO: 6158
  Synthetic

SEQ ID NO: 6160 - protein, 178 aa, Artificial Sequence
  Synthetic
DRAEKAEREIRRLLERVKEDSERVLRESEELTRRVEEESRKILEETKKLTRTLEELSRTEDKRLVEKISRETIRRNEEMLKDLKRLSDESVKRNEDALDDLRRLAEEIIRRLEEVLRRGDLDEERVKRVLEEIERLLRELEERHKRLTERDKEVVKRLADRHREVSEEDRRVLEELKR

SEQ ID NO: 6161 - protein, 178 aa, Artificial Sequence; identical to SEQ ID NO: 6160
  Synthetic

SEQ ID NO: 6162 - protein, 178 aa, Artificial Sequence
  Synthetic
DEMEEVIRRIETLLKRVVDESDKVLEDIKRLLDRVVEESEKALETTRKLLEEVAELARTVDKREIAKIIREIIERNRTVLEEIARLIKEIIDRNKKALDELRDLARRIIRDLAEALKRGDLDEDEVRRVLERVKKVLDELAERHKELSKEIKRELRRLEKEHEDLSEEVKRLLRELER

SEQ ID NO: 6163 - protein, 178 aa, Artificial Sequence; identical to SEQ ID NO: 6162
  Synthetic

SEQ ID NO: 6164 - protein, 178 aa, Artificial Sequence
  Synthetic
DEMREAEEEIKRLLDTVKTESDRVLEEARKLTRRVEEESERVLRETKKLTDELRKLSRKRDKELVKKISEDTIRRNEEAVKRIRELSKESIKRNEDALERIKRLIKEIIDRLEDVLRRGDLDEERVRRVLKEIREVLDRLEKRHKKVSKDDKEVLERLEKEHKRLSREDEEVLRELER

SEQ ID NO: 6165 - protein, 178 aa, Artificial Sequence; identical to SEQ ID NO: 6164
  Synthetic

SEQ ID NO: 6166 - protein, 178 aa, Artificial Sequence
  Synthetic
SRMEKVEREIRTLLKEVEERSRKVLDESRKLTEDVERISRDALKKIKELLEEVRDLARTVDKKILRKLAREIIERNKEMLKEVRRLSKESLDRNERALEELADLARRIIEELEKALRRGDLDEKDVRRVLREIEELLKDLERKHKELTRRDEEVLKKLEDDHRRVSEEIEEVLRRLEK

SEQ ID NO: 6167 - protein, 178 aa, Artificial Sequence; identical to SEQ ID NO: 6166
  Synthetic

SEQ ID NO: 6168 - protein, 178 aa, Artificial Sequence
  Synthetic
SRAERVKEEIKKLLEEVRKESKRVLKEVKDLTKEVDDKSKKVMRDIRELLKEVEELARTVDKKEIRDRIRKIIERNERMLEELKRDSEESLKRNEDALREVKRLIEEIIERLERALRRGDLDAEEVKKVLREIEETLRKLEEEHRRLSDRDREKLDELAKRHKKVSRDIEEKLKELER

SEQ ID NO: 6169 - protein, 178 aa, Artificial Sequence; identical to SEQ ID NO: 6168
  Synthetic

SEQ ID NO: 6170 - protein, 177 aa, Artificial Sequence
  Synthetic
KEVEDVLDKVKKALEEIRERNKRVNDEIRRLLDEVRRRNEDADREIEEILKRVADEVRDTDLERIIEELKKRVEEVIRRSRRLAEEIKKTIEEAVRRTRKLAEDLKREIDDVLKRVETEELRERIKAVVEEVERVMDELRRSNEKVVREVEDVMRRLEERNRRTLERIEEVLERLKR

SEQ ID NO: 6171 - protein, 177 aa, Artificial Sequence; identical to SEQ ID NO: 6170
  Synthetic

SEQ ID NO: 6172 - protein, 181 aa, Artificial Sequence
  Synthetic
EEVERLLTKVRELVRRIEEENKKANDDSRKSLKEIKDRVEKALDDSRKSLEEIEKIVRRDNIKEKVRELAKRDRDLNREVLKEVRELLKRDEDLNRRVIDKTKKLMEDVERKLKEVLDRVDKEELKRRIETVIKEVRETIEELKKSNEESVRDSERTIRELEEEIKRTVRESEKEIKRLED

SEQ ID NO: 6173 - protein, 181 aa, Artificial Sequence; identical to SEQ ID NO: 6172
  Synthetic

SEQ ID NO: 6174 - protein, 181 aa, Artificial Sequence
  Synthetic
EEVERMADEVRRLNEEVRRRNEESIEEVKRLNDEIRKTNEKSIEDVKELLKRVKEVRERNQDKRRIRELIKRILERDEALVRKSERLAREVNRRDKEVVEESEKLIRDINKRIDEAVKRVDGGDAREKMKRLVEENTKSVEELKKRNEETSRRNTKSVREVTRRNEKTSDDVRRLVREEEQ

SEQ ID NO: 6175 - protein, 181 aa, Artificial Sequence; identical to SEQ ID NO: 6174
  Synthetic

SEQ ID NO: 6176 - protein, 181 aa, Artificial Sequence
  Synthetic
DEVEEAKEKVRRLNKELRRVVKEVEDEVRRLNEEVRREVEKVRDDVRKLRETIREVKARNVDDREIRKLAEEVIRRIRTVIEKIRRLIEEINKRIRRVAEEVKRIAEEINEEIKRVLDRVKSGSLEREIEKISRENTKSLRDLLDRLRRLVEENTKSVEELVRRLEELLERVEEEMRRLET

SEQ ID NO: 6177 - protein, 181 aa, Artificial Sequence; identical to SEQ ID NO: 6176
  Synthetic

SEQ ID NO: 6178 - protein, 177 aa, Artificial Sequence
  Synthetic
SRVETMVKDIRRLLEEVKERVERALRDNERVLEDIRRRVDELLKTNEKINRDIERRVRRGLDRDEIRKLLKESEDSVRRALRDVEELLRKSRETVERVKRLIERLLEEVKRIVETVARESDVEEIKEVLRRVEEEAERLKREIEESLKRSEDLVRKLKERIKRSLEESRKRIKKLED

SEQ ID NO: 6179 - protein, 177 aa, Artificial Sequence; identical to SEQ ID NO: 6178
  Synthetic

SEQ ID NO: 6180 - protein, 177 aa, Artificial Sequence
  Synthetic
SEVEEAVKRIRKIVKEIEERVRRLLEENRRVIEEVERINKEMLKRNKEINKEVEELVRRGEPRKVIEDLVDRSRRSVEESERLNEELVDESRRTVEEIETEIERLREELKRVVDKVREKREVKEIEDILRRAEETVEDLKRRIRRSLEDSRRVVEELAEENRKSLRESKKKVDELKK

SEQ ID NO: 6181 - protein, 177 aa, Artificial Sequence; identical to SEQ ID NO: 6180
  Synthetic

SEQ ID NO: 6182 - protein, 177 aa, Artificial Sequence
  Synthetic
SRVEDFVRRIRDLLRKIEEIARKALKENKDVLREIKRINDEMLRRNEEILKRAEDLVREGRDRTVIERMLEESERSVRDSERLNRELLRKSEETVRKLKKLIDDLLREIEKIVREVARERDVEEIKRILEEAKKTIDELRKEIEKSLREVEKAIRELEERNRRSLERSEDLVRELKR

SEQ ID NO: 6183 - protein, 177 aa, Artificial Sequence; identical to SEQ ID NO: 6182
  Synthetic

SEQ ID NO: 6184 - protein, 177 aa, Artificial Sequence
  Synthetic
RRVEEAVKRIKEILERVTRRVEKVLRDNKRVLDDIRRINEEMLKRNKEINRKVEELVREGRPRKVIKDLLKRSRESVEESERLNRDLLRKSEETVRRALKEIEDALKRIEELVREVERESDVEKIKEILEEVRRTIEELKERIRKSLEEVKELIKRMDEENRKSLEESDERARRAEK

SEQ ID NO: 6185 - protein, 177 aa, Artificial Sequence; identical to SEQ ID NO: 6184
  Synthetic

SEQ ID NO: 6186 - protein, 181 aa, Artificial Sequence
  Synthetic
SELEEIRERVKRVEEELRKNLKDAERRVREAKRRSEESLKDIEKKVKEVRDELKELARRGADRKDIRRIVKEIEKRIRDAAKRNEDIVRRVEEEIKRLVESNRTLADDISRRVKELLDRVTDGSAREDIKRLLKELEELLKRSEDEARRLLKEVRDLVDTTKKRIDKLLKEIEDLLREIER

SEQ ID NO: 6187 - protein, 181 aa, Artificial Sequence; identical to SEQ ID NO: 6186
  Synthetic

SEQ ID NO: 6188 - protein, 180 aa, Artificial Sequence
  Synthetic
KIEEKVEKLVRELLKELETVDREVNERVKRSNEKLEKIDRDVNKLVEDSNRKLKEISDRVKSDEARELIKRVLEESRKLVKEAKDLTKKVLDESEELIRRVLKVSRDVLDKAKKLIEKVLEERDVEKIKRLLEEVKKLVEDSERNIRELLKESRKKVEDSKRNLDRLLKESDDRVDRERR

SEQ ID NO: 6189 - protein, 180 aa, Artificial Sequence; identical to SEQ ID NO: 6188
  Synthetic

SEQ ID NO: 6190 - protein, 180 aa, Artificial Sequence
  Synthetic
ETEKEVEELVKRVLDKDKRISDESEERIRRLMEKNKKILEDVKRLVDEVREKLEDIRRRVKSKEMKDLIERVLEEAKELVTRAKKLDEDSLREVDKLVKDVDRLNERSLEEAERLVREVLRKRDVEKIKKLLEDVRRLIKRSKEKNDELLEELKRLSEETRETLDRLLKDLEDKIREAKK

SEQ ID NO: 6191 - protein, 180 aa, Artificial Sequence; identical to SEQ ID NO: 6190
  Synthetic

SEQ ID NO: 6192 - protein, 173 aa, Artificial Sequence
  Synthetic
DEKEDVDRLLRELEELVERSERSIRKLLEDNRKLAEDLKRTVEKLLEDNRRKVEEVRRTGADERKVDEVLKHSEEVIRRVKEDIDRVLKHSEEVIDRADKLTKAVLKEARDIVREVDSEELRKLIKRVLKKLRDLNRRVKELSRRSAEELKRLLDEVRKLSEDSLRELDKLRK

SEQ ID NO: 6193 - protein, 173 aa, Artificial Sequence; identical to SEQ ID NO: 6192
  Synthetic

SEQ ID NO: 6194 - protein, 173 aa, Artificial Sequence
  Synthetic
DEEKRVRDLLEEVREEVERSDKSIEELLRELEKAVKDSERTIRKLLEDNERMVREVRRKGVDDELVRRVLEHSEKLIREAKRLTDEVLREAKRIITEAKKLTKEVEKKVREIVKKVKSKEAEDLIREILEELKRLNEDVKRLIREVLETLKELNERVKKLVKESNDELRELAR

SEQ ID NO: 6195 - protein, 173 aa, Artificial Sequence; identical to SEQ ID NO: 6194
  Synthetic

SEQ ID NO: 6196 - protein, 173 aa, Artificial Sequence
  Synthetic
REEEKLDKLRKDLEKRVEESKRSIDKLLEDNRRRVEESKKTIEKLLEDNKRRVDEIKKRGVDDELVRRALEHSKKLVDEAKELTKRVLEKSKRIIDRAKELTKRVERKVREIIKKVDSDEAEKLIRDVKKELDRLNEEVKKLSEDSLKELDDLNREVKELMERSNRKLDEDAK

SEQ ID NO: 6197 - protein, 173 aa, Artificial Sequence; identical to SEQ ID NO: 6196
  Synthetic

SEQ ID NO: 6198 - protein, 175 aa, Artificial Sequence
  Synthetic
KEVEDVLREIKKLIKEIHEKSKRALDETRELLERIHRTTRRVLEEIRRLLKEVEELAKAGMDKREVRRRVKEIIDRLREMLERSRKLWKDIEERDKRLLEEVERLWDEIRRELRERAGDKDRVEDLVRELERVVKEDKDRSKESEERIKKLVEDDTREAEKLIRELEKILEDTEK

SEQ ID NO: 6199 - protein, 175 aa, Artificial Sequence; identical to SEQ ID NO: 6198
  Synthetic

SEQ ID NO: 6200 - protein, 175 aa, Artificial Sequence
  Synthetic
SEVEEVLRDIDRLAKEIHKRSRDVLRDIDRLLKEIHERSRRMLERIKRLLDEVRRLVEAGVRKEEIKELIERILRDLKRVVDEVAREWEEVIKKLRKALEESRRLWEEIIKKLEREAGDRDRLRELVERLERLLETDKREIEKLIKKLEEMLEEDERRARELLEDIRRILEEIKK

SEQ ID NO: 6201 - protein, 175 aa, Artificial Sequence; identical to SEQ ID NO: 6200
  Synthetic

SEQ ID NO: 6202 - protein, 175 aa, Artificial Sequence
  Synthetic
SEVEEVTKEIKRLVEEIHKRSREALEETRRLVETIHRDSKRVLDEIERLLEEVRKLAEDGVDKRDIKRLAKEILKRLEDMMRRVTELWKEIIERDRRLLEESKKRWDEVIEELRRKVRDEKRVRDLLEKLREDAKRDEDASRKSEEDIRKVVEEDKREAEKLLKRIEDELRKTEK

SEQ ID NO: 6203 - protein, 175 aa, Artificial Sequence; identical to SEQ ID NO: 6202
  Synthetic

SEQ ID NO: 6204 - protein, 175 aa, Artificial Sequence
  Synthetic
SEVEKVLKDIRDLVKKIHDESKRVLDEIEELVRRINKRSRDALREIRELLRTVTELAKAGLDKREVEKLAKRILERLREVLEESRELWERVIRRLKEAMERVRELWERVIRELRKKVGDKDRVRKLVEDLERMLRRDEAEAEKLIKKLRELLEKDRDDIRRLLEDIKRILDEIRK

SEQ ID NO: 6205 - protein, 175 aa, Artificial Sequence; identical to SEQ ID NO: 6204
  Synthetic

SEQ ID NO: 6206 - protein, 175 aa, Artificial Sequence
  Synthetic
EEVERALDRARRLLERIHETSRDVLRRTEELLRRINEESRRVLKEAKELLDRVEKLVRDGLDKREVRRLIEEIVRRLEKVLKESEDLWREVIRTDKEMLDEVRKLWEEIIERLRREVGDKDRVEKLERELEKVVREDEEESKKSIRRAEEMLRKDREDIRRLLEEIKKILEDIDK

SEQ ID NO: 6207 - protein, 175 aa, Artificial Sequence; identical to SEQ ID NO: 6206
  Synthetic

SEQ ID NO: 6208 - protein, 175 aa, Artificial Sequence
  Synthetic
SEVEDVLRKAEELAKRIHDRSRKALKETEELLERINRDSERVLRESEKLLEDVRRLAEAGVRKEEIKKLAEEILREDKRVLDESKRLWEEILRRDRKLLDEVRRLWEEIIRRLRRELGDEKTVRRLVDKLRRLVEEDTDESRKSEERIKKMVEDDKRESEKSLKRIKDIMKEITD

SEQ ID NO: 6209 - protein, 175 aa, Artificial Sequence; identical to SEQ ID NO: 6208
  Synthetic

SEQ ID NO: 6210 - protein, 176 aa, Artificial Sequence
  Synthetic
SEVERVLEENERTLKRIEETAKKVLEEIEKLSKEVEDRAREVLDRVRRISEEVRRDVRSKEVERIIREIDKESERVLRELEELIKEISRKIEEVLREIERLARESKDRVRKAMKDIDEEMRDRVRKLIKRNDEVLDRVRREIEKLHRRNKKILDDLRREIERLNRENKRLLDELRK

SEQ ID NO: 6211 - protein, 176 aa, Artificial Sequence; identical to SEQ ID NO: 6210
  Synthetic

SEQ ID NO: 6212 - protein, 176 aa, Artificial Sequence
  Synthetic
SEVEEVLKRNEKTLKEIEERAREVEETVRELSERIRKRNEEVNRELEERSKRIRRDVRDKDVERLIRKVDEDSKRTLAETEKLIREVSEVIKRALEEIERLIRDSLEKVKEMMRDVDKEARDRADELLKRNREVLERLRKRIEDLHRDNKRVLDELRRSNEETNRRNRKLLEELRK

SEQ ID NO: 6213 - protein, 176 aa, Artificial Sequence; identical to SEQ ID NO: 6212
  Synthetic

SEQ ID NO: 6214 - protein, 176 aa, Artificial Sequence
  Synthetic
REVEEVLKENEKTLREIERRMEEVLKRVEDLSDEVRRRVDEVLRRVEETSKEIAKRVRGEDVKRLIEDVDRRSREALREVEELIKRIDEVSERALRELEELIKRSLDRLAEVMKDVDEEARKRAKDVLDRNRDVLRRLKDAIDKLNKRNKEILDRLRRKIEDLNRRNEELLRRLEK

SEQ ID NO: 6215 - protein, 176 aa, Artificial Sequence; identical to SEQ ID NO: 6214
  Synthetic

SEQ ID NO: 6216 - protein, 176 aa, Artificial Sequence
  Synthetic
REVEEVLDKNRKTLREIRKRAKEVLDRVEELSRRVREENERVNRELRKISEEIARKVRDKEVEKLIREVDERSKRTLETTERLIREIDERSKKVLDELRKLVKESLELVERAAKDVDEEMKKEADKLLKENRDVLRELERRIEELNERNRRVLKELEESNRRTNEENKRLLDELRR

SEQ ID NO: 6217 - protein, 176 aa, Artificial Sequence; identical to SEQ ID NO: 6216
  Synthetic

SEQ ID NO: 6218 - protein, 176 aa, Artificial Sequence
  Synthetic
DEVETVLDENRRTLKRIRERVDKVLKDVEKLSREVEDEIRRVLEEVEKELKDIERDVRDKDVERLIREIEEKIKRALEKIEELIRRIDERSREALEEVKKLIEDSLKRVEDAMRDVDEDAREKAKRLLEENKRVLKELEERVKRLNDKNRRILERIKKRIEDLRRRVKELLKKLRK

SEQ ID NO: 6219 - protein, 176 aa, Artificial Sequence; identical to SEQ ID NO: 6218
  Synthetic

SEQ ID NO: 6220 - protein, 176 aa, Artificial Sequence
  Synthetic
DEVERVLEENERTLRRVREIIREVLEEVRRLSEEVKRRIDEVLKENEDTLKKIKDEVRSEDVRRLIEESLELVKRVLEEVRRLIEAVDRESERVLKEVEDLARESERLVREVAKDVDKKARDRVREVEKRNRDVLEEVKDEIRKVNKDNRDILRRIKKDVEELLKRNEKVLRETEK

SEQ ID NO: 6221 - protein, 176 aa, Artificial Sequence; identical to SEQ ID NO: 6220
  Synthetic

SEQ ID NO: 6222 - protein, 176 aa, Artificial Sequence
  Synthetic
RELEELLKRNERTLRELAKRVKRLLEENKETVRRIEERLRRVLTEVEKISRDIRDRVDSEDLRRLLEELDKRSKEVVEEIEELLRRSLKRLKEVLDEIRKLVKESLEEIRRAAKDVDEEVRERVKKVEDENRKLLERAEREIKKVAEENRRLMEKMKDDVRKANKRNKELLERRTK

SEQ ID NO: 6223 - protein, 176 aa, Artificial Sequence; identical to SEQ ID NO: 6222
  Synthetic

SEQ ID NO: 6224 - protein, 176 aa, Artificial Sequence
  Synthetic
SEVEKVLRENEKTLREIEREIDRVLRDNERTLKEVRERNEEVNRRVEEDSKRVKDEVRSKKVEEVIKRIDERSKETLRETVERIEESLRRLKKALDDVRDLIRRSLKRVEEAAKDIDEKARERIKRILDENRKVLREIERKIREVLERNKKVLEEVRKSNEETNDRNRKLLEELRR

SEQ ID NO: 6225 - protein, 176 aa, Artificial Sequence; identical to SEQ ID NO: 6224
  Synthetic

SEQ ID NO: 6226 - protein, 183 aa, Artificial Sequence
  Synthetic
SVDERVEDLRRDVERVLRELRKSNEESIRRSEEIVTRLEEELKRNSKEVEEVLKRLEDELKDDEDKLREVRELIERVKKTNEDVLRRVRELIERDEEVNRRSLTETDDLIRRVRKVVEEARRLTSKDLEKALRDVEKLIREIRERNKEMLRRSEEILKEIEKRARDMSRESKRLIEDIERRTK

SEQ ID NO: 6227 - protein, 183 aa, Artificial Sequence; identical to SEQ ID NO: 6226
  Synthetic

SEQ ID NO: 6228 - protein, 183 aa, Artificial Sequence
  Synthetic
SVEEKVDRLKRRVEEVLKELKKSNEDNTREVREALKRLKKAIEESIDRSRKILEDLRRKLKDDEKKLREVEELIKRDEETNRRVLRRVEELIRRVEEFNEESLRRTERLIEEVKKVVDEARRLTDEDLERALKEVEELIRRIREENKEMSERSKKIIRKIEKDVKKALDDSERVLREIAERTK

SEQ ID NO: 6229 - protein, 183 aa, Artificial Sequence; identical to SEQ ID NO: 6228
  Synthetic

SEQ ID NO: 6230 - protein, 183 aa, Artificial Sequence
  Synthetic
DVEKKVKELLDEVRDALRRLRKSNKDNTDEVDRALRELEETNKKSIEDSRRIVEDLKRKLKDDEDVLREVEELIRRDEETNKRSLEEVKDLIKRVRDVNEESLRRTEDLIRRVEEKVKEIERLTDREADKVLKRVKEEIERIERENRRMSEKSERLIREIRKRNKEMLDRSKKLLEDIKRRVT

SEQ ID NO: 6231 - protein, 183 aa, Artificial Sequence; identical to SEQ ID NO: 6230
  Synthetic

SEQ ID NO: 6232 - protein, 180 aa, Artificial Sequence
  Synthetic
KEVEEILTESEDMNRKIDKLVKEILDESEEMNRRIRELVKRIVEELRELLREIRRLAEERDKDDVLRRLKELLKEIKEKARKVIDELRRLSEEIKKKIDDVLDELRRASEEVERKIREDKNEEVRDRLRRSHEKNKEVLDRIRKRVKESHEKNEKSLREIEETVKKLERDVERLLREIKR

SEQ ID NO: 6233 - protein, 180 aa, Artificial Sequence; identical to SEQ ID NO: 6232
  Synthetic

SEQ ID NO: 6234 - protein, 180 aa, Artificial Sequence
  Synthetic
EEVERILKESRDANERIKKLVEDILRRSKELNERIRDEVRKILAKSEEVNRRIRRLAKERDKEEVLRRLEEMSKKVKKEIDEVIEKLERLSEEIRRRIEEVLERLKRMSEEALEKIKEDKNEEVKEKAKESHKENKKVLDRIKRELEKSHEENKKSLDEIRDRVRRSHEKNRKVLEEIRK

SEQ ID NO: 6235 - protein, 180 aa, Artificial Sequence; identical to SEQ ID NO: 6234
  Synthetic

SEQ ID NO: 6236 - protein, 180 aa, Artificial Sequence
  Synthetic
EEVERILKESEDMNRRIRDLVRRIAEESDKVNREIRKLVDEIRRKLDRVLREIEDLIRKRDKEEVLRRLRKLLEEAKEEIERVLKRLEDASREVAKKIRDVLEELRKMSEEVLEKVKEDKNEEVKKRAEKSHRENEKSLREIRKELEELHRKNKKSLEEIRKTLRKLEEKVRKLLEDLRR

SEQ ID NO: 6237 - protein, 180 aa, Artificial Sequence; identical to SEQ ID NO: 6236
  Synthetic

SEQ ID NO: 6238 - protein, 180 aa, Artificial Sequence
  Synthetic
SRVEEILRESKRMNDEIREKVKKILKTSRDMNKRIEDRVREILKKSEDLNRKIRKLIDDRDKKEVVDTLRELSKEIEKEAREVIEELERISKEVHDRAREVIKELEEISDDVRRKAERDDKEEAKRELEKSHKTNEKVLRDIERRVEDSNRENEDSLRKIERAVTESHRRNEEVLERLER

SEQ ID NO: 6239 - protein, 180 aa, Artificial Sequence; identical to SEQ ID NO: 6238
  Synthetic

SEQ ID NO: 6240 - protein, 180 aa, Artificial Sequence
  Synthetic
EEVERILEESKRLNDEIRRKVDEILRKSEEINERVRRLVEKIRTDLERVLEEIRDLADKRDKDEVLKRLEDALKEALDRARKVIRELEEMSKEIEDEIRKVLEELERLSREVERKLREDDKEEVKRRLEESHKDNDRVLKEIERRVRESLRRNRESLRRIDEKVKELERRVEKLLREIKK

SEQ ID NO: 6241 - protein, 180 aa, Artificial Sequence; identical to SEQ ID NO: 6240
  Synthetic

SEQ ID NO: 6242 - protein, 180 aa, Artificial Sequence
  Synthetic
EEVERILDESKKMNDDIRRKVKEILDESEKLNEDIRRLVKEILEKSKRVNDRIRKLAKDRDKEDVLRELKKMSEDVLDDARKVLETLKKLSEDVRRKIREVLKELEKASREVERKVREDKNDEVRRRAEKSVRENDKSLKEIEDEVRRSVEKNEESLKRIEDEVRKSHEKNKKVLDEIKK

SEQ ID NO: 6243 - protein, 180 aa, Artificial Sequence; identical to SEQ ID NO: 6242
  Synthetic

SEQ ID NO: 6244 - protein, 180 aa, Artificial Sequence
  Synthetic
SKAEEVLKEIRERIERIRKRAEDVLRHDEESLKRAEEVNRKMEKESRRINEEIRDRVRKEGGRDKEKVDRLLEELHRVDEESIRIVERLLEHNRKSTEDIKDEVRKLLERLKEVIDEVRRAGVDEKDVRKVEDDIRRVIKKLKEELDRSADKSRDVVRRLRDSNKKLNDKNRRDIEEIKK

SEQ ID NO: 6245 - protein, 180 aa, Artificial Sequence; identical to SEQ ID NO: 6244
  Synthetic

SEQ ID NO: 6246 - protein, 180 aa, Artificial Sequence
  Synthetic
DSEEEVRERIRKIIEDVKRIIEEVLRRDDKILKEIEKRNRDMLKRSKEINKEARDRVREAGNRLKEEIRKLIKELHDVDRESIKRVEDLIREVRKSSDKAEEEVRRMLKRLKDVVDTVRKAGVDDRSVRELERRIKEVIDELRELVERSKRKVDKLLKDLTRSNEKVNRENREDLERLEK

SEQ ID NO: 6247 - protein, 180 aa, Artificial Sequence; identical to SEQ ID NO: 6246
  Synthetic

SEQ ID NO: 6248 - protein, 174 aa, Artificial Sequence
  Synthetic
DDERRAKKAAEDAAKRLKEIAEKAHRISEKALEELKRINDDANKISEDALRRLEKLKKEGAPEEAAERAARDSLRLIREAAERSREAAERSLRLIEEAAKEAEDAARDALEIIKTLAKSEEAKELAKKIKEIADEARKRAEDNARTNKEAAERSKENADRNAEENKKAAEKAKR

SEQ ID NO: 6249 - protein, 174 aa, Artificial Sequence; identical to SEQ ID NO: 6248
  Synthetic

SEQ ID NO: 6250 - protein, 174 aa, Artificial Sequence
  Synthetic
KDEDEVRRRVEELLKRNKELVEEIHKLSEDALRDLERINEEVNRISDEMRRRLDKLKKDGIPEEVLEDVVRRSLELIERLLRESRKVAEDSLRTIKEMLKRSEDIVRRVLEEIDRKIKSEEAKKLKERVDRSLKESEKEVRENLERNRKLLDESRRNAEENLRENKRVLDELRR

SEQ ID NO: 6251 - protein, 174 aa, Artificial Sequence; identical to SEQ ID NO: 6250
  Synthetic

SEQ ID NO: 6252 - protein, 174 aa, Artificial Sequence
  Synthetic
SEEDEVRERVKRVLDELRKINEDLNRISREMLERNKDILRRIHEISKRALDKLKKLKEDGVPEDDLRRVVEDSLRLIKEALERSERLVRTSLKLIKDMLRRSEEVARRILDDIRKRLKSEEVRKLLEEVKDSLRKSEENARRNLDENRRSLKKSEDEVRRNLEENEDTLRKLEK

SEQ ID NO: 6253 - protein, 174 aa, Artificial Sequence; identical to SEQ ID NO: 6252
  Synthetic

SEQ ID NO: 6254 - protein, 182 aa, Artificial Sequence
  Synthetic
DEMDEVRRTIKKLDKDSRDKVRTVEEKIRRLDEESRRENEEIVRKIEELLEEIERRVRSSTDERVLRELVRRLKEVLDRVEKDSRETIKKNKRALDKARREIEEILKENEKALDDAKKVVDELNIDEKEVKKIKEESDESLKEIEKLLREIEEESKRSLREMEKTLEDIERRVRRVLEEIKR

SEQ ID NO: 6255 - protein, 182 aa, Artificial Sequence; identical to SEQ ID NO: 6254
  Synthetic

SEQ ID NO: 6256 - protein, 181 aa, Artificial Sequence
  Synthetic
SIEELAKRNEEENEKAAEDVERLAEEVKERAERVARESEKLAREAEKEAERVAREIRRDRSDDKDAARLVEEAAKEARRAAEESARLIEEAAKKAEKAAEDVKREIKKTAEDLKRAADKAETEEAAKRASEENRKAVRDAREKARRAAEEAKKLLDEARKHSEEAAKRAKELLEEAKKRAD

SEQ ID NO: 6257 - protein, 181 aa, Artificial Sequence; identical to SEQ ID NO: 6256
  Synthetic

SEQ ID NO: 6258 - protein, 181 aa, Artificial Sequence
  Synthetic
KIEELMKRNEKENREVLERVKELADRNRRENEEVVKKSKKELDDLKRKIEEVLERIKRERKEMKEVEKLVREVLKRIEDLIRESVDRIRRTVEELEEVAKDVERKIRETIRRLRELAKRLETEEVVEKVSRENKKLVADIEDEVRRASTRNKKLVKDIEKHSEDVVRELEKLLKDIKDKVD

SEQ ID NO: 6259 - protein, 181 aa, Artificial Sequence; identical to SEQ ID NO: 6258
  Synthetic

SEQ ID NO: 6260 - protein, 181 aa, Artificial Sequence
  Synthetic
SIEDEARRNEKRNREVLKRSKDLLDEIARKIEEVEKRIRDLVKRVKEEIDEVLRRIKRERPDLKDVIELVKRVAKTARDMIEKLEDELRKILEEVTKLIEESEKRIKETVDRLKEAVKNIEDDELLRRVSKENEDLVREIEDHTRRVLETIERKLRRVEEKVETVVREIKRRLEDIERRVK

SEQ ID NO: 6261 - protein, 181 aa, Artificial Sequence; identical to SEQ ID NO: 6260
  Synthetic

SEQ ID NO: 6262 - protein, 174 aa, Artificial Sequence
  Synthetic
EEVDRVIERIKRLLEEVERKIRRASEKNRRLIEKSRKELEKVSKENKDLIDRVRELRDAGVDKREIKDLLRRISEEMKKVIDELKRSNEKVSEELRRMLKEIREDLKRIVDEARERVKGEKVKTVEKEIREVIERADEIIERNERENKKSVEEIEEILERNKRRNEEALREVDK

SEQ ID NO: 6263 - protein, 174 aa, Artificial Sequence; identical to SEQ ID NO: 6262
  Synthetic

SEQ ID NO: 6264 - protein, 170 aa, Artificial Sequence
  Synthetic
DELDRAIEEVKRLLDEIRRRLEKVVREVRKLNEEIREDLRRVVEEVRRTNKEIRDRVRSEEARRLAEESLRLLEEALERIRRLIERSLRRIRRLLEEIEKLARDILEEIRRIIDSDKVRRLEREVEELLKTVEELIRRLEEHTRRVLKEVDEEIKRLKEHTEKVLRDVEK

SEQ ID NO: 6265 - protein, 170 aa, Artificial Sequence; identical to SEQ ID NO: 6264
  Synthetic

SEQ ID NO: 6266 - protein, 187 aa, Artificial Sequence
  Synthetic
SAEELVKELERRIEELLKELEEIVRRNRKHSEDVLRKIKELVRDVLRRVKEALKDLTKKVRTREVRKLVEELIERLEELIERIDRTAERLITESRRTLEEIRRRIKELIDDLRRLLREIKKEVDRGLDEDVVRKLIKEIDDRLKEVKKEVEKLSDENRRLNEDVERRIKELLDDIERLLKEIRDTVT

SEQ ID NO: 6267 - protein, 187 aa, Artificial Sequence; identical to SEQ ID NO: 6266
  Synthetic

SEQ ID NO: 6268 - protein, 187 aa, Artificial Sequence
  Synthetic
DVEDIVRRIRERVKEALERLRKTNDDNRKHSEEVLRKLAESDKRTMERIERVLEELRRRSRTREVTKLVEDAIEKLRRRVRESHERVKRLFEDSKRTVDESLERVERAIEELKRVIDEVEELARRGLPKEVVREMKRKIEELLKRIEDENKRLSDENRELNKRVEEDNRRLNKEIEDELRKVEEDVK

SEQ ID NO: 6269 - protein, 187 aa, Artificial Sequence; identical to SEQ ID NO: 6268
  Synthetic

SEQ ID NO: 6270 - protein, 187 aa, Artificial Sequence
  Synthetic
DLEELVKELEKRIEDVLRTLRKTNKDNEKAVEESLRKLEDELRKLKEKIDRLLDKLTKESRTEEVEKLVRELIRELREVVRRIEELIRDMARRSKESVETSLELVERLIKKLEELLRRVLELVAKGLPEEVVRRIIEDIRRLLEEVKKVNEDLSEENERLNRDAERRVREAIKEVEDLLDEIEKTVR

SEQ ID NO: 6271 - protein, 187 aa, Artificial Sequence; identical to SEQ ID NO: 6270
  Synthetic

SEQ ID NO: 6272 - protein, 187 aa, Artificial Sequence
  Synthetic
SVEDELRKLEEKIRRLLEELRRTNDENRRHSEKVLEELRRELEKLKRRIEELLRKLREESRTREVTKLVEDLIRKLRELVERIEREVEKLVRDSRRTVEESDKLVKDVIKRLRELVREILKLAREGRPEEVVERLIRDVERKLREVKKENDRASKENEDLNREVKRRAEKLLRDVERLLREVEKTVK

SEQ ID NO: 6273 - protein, 187 aa, Artificial Sequence; identical to SEQ ID NO: 6272
  Synthetic

SEQ ID NO: 6274 - protein, 187 aa, Artificial Sequence
  Synthetic
SAEDRLRELEERIRRALKELEDTNRRNEEHSKKLLEELARSDRETEEEIKEALKRLTERKRDEEVEREIKEMIRDLERVVRESHRTVRELVKESERTVKESLERVKRAIDELRRIVEEIRKLIEEGLPEEVVDRLIREVEERLRDVRRLNEELSKRNKELNDRVREVNEELNRRIKKRLEEIKRRVE

SEQ ID NO: 6275 - protein, 187 aa, Artificial Sequence; identical to SEQ ID NO: 6274
  Synthetic

SEQ ID NO: 6276 - protein, 187 aa, Artificial Sequence
  Synthetic
SLEDLVRTIREEIERLMKEAEDTNRRNKEESEESLRRLKKLVEDIDREVKEVLDRAEKNTRTDEVREKVRRMIESLRRDIEEIRKRIEEAVKKSEDVVRKSLEEVRRAVKRLRDLVDKILELVEKGLPEKVVEELIRRIKDELKKIRERNKELSDRDKKLNEDVEREVRKLIDEIRKKLEDVERTVK

SEQ ID NO: 6277 - protein, 187 aa, Artificial Sequence; identical to SEQ ID NO: 6276
  Synthetic

SEQ ID NO: 6278 - protein, 180 aa, Artificial Sequence
  Synthetic
REVDKVREDVKRLIKEIEDRVRKVLKEDEDLIRELRERVKKVSKENKEVVKTLRELVRDLRGKRERIREVIKRADELLERAEKEVRKVIDDLRKTTEDALRDLERIIREAKKTVDDVLRRRGIREELVKELEKRIREVLERLRRLIERSKEEIDRVLREVEEDVRRNKEENKRLLEEAER

SEQ ID NO: 6279 - protein, 180 aa, Artificial Sequence; identical to SEQ ID NO: 6278
  Synthetic

SEQ ID NO: 6280 - protein, 178 aa, Artificial Sequence
  Synthetic
DEKDKVRKTVEDILREIEKIVEDLVRRNERVDREIRERVRELLRRDDEILKRMEEVKRRRAPEEVLEEIAERLRRSSEEVLKLIRELIRRLKETVKDAERLIRELIKRLAEVVDTARKEGVEEREVTKLKEDIDRLLEKLERDLDELRKRNDELLKELEDRVRKSKEKVEKILRDVRR

SEQ ID NO: 6281 - protein, 178 aa, Artificial Sequence; identical to SEQ ID NO: 6280
  Synthetic

SEQ ID NO: 6282 - protein, 181 aa, Artificial Sequence
  Synthetic
SIEDKLRELKERHKELSKRIKEELERLTEEHRRVSEKIRKSLEEDKRRADKVLERIRRERSDSEKLVRDLEKVLRDVERLYREVIKRNEEALDRVRRLVEEIIERNERMLRKVEELARRIKTEDVLRKVEEDSREVLKDSKRLLDEVATRSEEMLRRSEELLKRIHETSKKVLDEIKTKLK

SEQ ID NO: 6283 - protein, 181 aa, Artificial Sequence; identical to SEQ ID NO: 6282
  Synthetic

SEQ ID NO: 6284 - protein, 181 aa, Artificial Sequence
  Synthetic
SIEDLARDLERRHKELSEDDKRKLDELRKRHKDVSDEARRSLERDERRVEKVEREITKRRSDDKDVVTELRKVLEEIRRLYETVVRDNERVLRDIERLSRRTIEENKKVLDELRELARRIKTEKVLDDVRRRSDKMLEDSRRLTREVEETSKEMLERSRRLLEEIHKESDRVLREARERDR

SEQ ID NO: 6285 - protein, 181 aa, Artificial Sequence; identical to SEQ ID NO: 6284
  Synthetic

SEQ ID NO: 6286 - protein, 177 aa, Artificial Sequence
  Synthetic
RIEDILRRLEEHHRRLDKENKEILERLKKHHEEVLRKIKEILERLEREARDIERKIRELEEVLRKIREILERVKELADRLLEEVERSLREVEKLIRTSSDLIRRSLETVKRAAERLETDEVVEKVVREVEDTNEKIRRRSDEVRKEVEDTNRRIDKRLKEVEEEVRRLLDEVRKESE

SEQ ID NO: 6287 - protein, 177 aa, Artificial Sequence; identical to SEQ ID NO: 6286
  Synthetic

SEQ ID NO: 6288 - protein, 175 aa, Artificial Sequence
  Synthetic
SELEDVAKKAEDLLTKSAEILKEVVDRHRRLNERSEDEARRVEEEHRRTNKKLLDLARRGDRDKEEVKRIIERSLDRVREVFKRVKRLNDESLKEVERVIEEVRRLNEEILKTVERDVDSEELRKLKKRIEDISREHERILRELREHVERVSDKHRKILKELEEDVERILREVTK

SEQ ID NO: 6289 - protein, 175 aa, Artificial Sequence; identical to SEQ ID NO: 6288
  Synthetic

SEQ ID NO: 6290 - protein, 175 aa, Artificial Sequence
  Synthetic
SEIEKVVEDIKRLLEESKDRLRKAEEEVRDLSRRSREKLRRAEEDIKRLLDEIERMLRAGERDKKEVEDIIKEIVDKVRTVATDVERLNKEILERVDRLIEELRRLNEEILDRVRKDIDSDELRKLAEEIERVSEEHKRILDELRDHLRKNTKDVRDILRELEKEAERLLRELRR

SEQ ID NO: 6291 - protein, 175 aa, Artificial Sequence; identical to SEQ ID NO: 6290
  Synthetic

SEQ ID NO: 6292 - protein, 175 aa, Artificial Sequence
  Synthetic
KDVEDVLKRVKDVNREVEKRLEKVIRDDEKINEEINRRLDEMAERVKRVNETVEDIARKENIREKLEELIKESEDTIRKVLREVEELVRELRKTVDDALEEARDLVRKSEELIERIVRKEKLVEELRRESDTSKKRVEKLIRELKEKNKRSEERARRIIEKLKKESKDSLKRVKD

SEQ ID NO: 6293 - protein, 175 aa, Artificial Sequence; identical to SEQ ID NO: 6292
  Synthetic

SEQ ID NO: 6294 - protein, 174 aa, Artificial Sequence
  Synthetic
EEKEILDELEKEVRDLNRKNKEILRRLEETARDLHRRNEEILDRIRKRVEELKRRVREVRELLDEIRRILEEIKRLIEAVSRKIKKVLDDVRRLIKEVDDKSRDVLRRVERLIRQNVDKDTVAKEAKRLIRDLERLSREIEERVRRLIEEVKEESERIRERVTRLIKEVEDRRK

SEQ ID NO: 6295 - protein, 174 aa, Artificial Sequence; identical to SEQ ID NO: 6294
  Synthetic

SEQ ID NO: 6296 - protein, 174 aa, Artificial Sequence
  Synthetic
DDEEILKELEERVKKLHEKNKRILEKLKREVERLNDENRRILKEVKEDVDRLLKEVKEDKDLLEEIKRALERIERLMREVDKRSREALERVKDLIRKVSRRIEEALEEVRKLITQNVDSETVARRVEEMIKEVEELSKEIEERAKRLIDRLRELSKRILEELKRLLEEVREKRR

SEQ ID NO: 6297 - protein, 174 aa, Artificial Sequence; identical to SEQ ID NO: 6296
  Synthetic

SEQ ID NO: 6298 - protein, 174 aa, Artificial Sequence
  Synthetic
REEDEVLEDARRLSEESRKKLREVERRAKELSDRSRKRLRDVKRRVDDALRKIEDLRRRGVDKRDVLRVVEKVRDDVEKLIREVKDLNRRILEEVRRLIKEVEDLNKEVLDKVRRELKSEKLRELEEEIRRNSKDVKEVMKELDKHIKRNSEEVDKVLKELEERLKRLLDRVRK

SEQ ID NO: 6299 - protein, 174 aa, Artificial Sequence; identical to SEQ ID NO: 6298
  Synthetic

SEQ ID NO: 6300 - protein, 174 aa, Artificial Sequence
  Synthetic
SDEDRVKDKAEELSRRSREELERVKEEAKRLSDESKKRLEEVTRRIEKVLREIRELRERGVDKREVKRVVDEVVDTVRKLIKEVEDLNREVVERIKELIKEVERLNKEVLDEVERELKSEKLRRLREEIKKNSDEVKKVLRRLEENLRDNTRRVREVLERLEDEARKLLKDVKK

SEQ ID NO: 6301 - protein, 174 aa, Artificial Sequence; identical to SEQ ID NO: 6300
  Synthetic

SEQ ID NO: 6302 - protein, 174 aa, Artificial Sequence
  Synthetic
SEVDDVLRRLKELSERSEKTLEDIRDEAEKLSKESEDLLREVLRRSEKVNEDIRRLREKGVDKRDVAKVVEDALRESEDLIRKVEKRNEEVLRRVEELIKRVEDLNREILRRVDEELKSRRLEKLRREIEDNSRRVREVLKRLKENIKRNTDRVREALKRLEREHEEVLREVET

SEQ ID NO: 6303 - protein, 174 aa, Artificial Sequence; identical to SEQ ID NO: 6302
  Synthetic

SEQ ID NO: 6304 - protein, 183 aa, Artificial Sequence
  Synthetic
SIEEAITRLRKEVEDSNKRSEDVIRELHERDKESLEEVREIIKRLKDKVRTLLEEVDKRVKSERLERVRRLLERVDRVVDKVLRELKKLVEDSNELVKKVATESHKINEDIKKVVDDAARRIETEEILKEVLKRLRKLLEDNERVLDEARRRVEKTNEEIKEVLKRVAEEVDRLIKEVREEVE

SEQ ID NO: 6305 - protein, 183 aa, Artificial Sequence; identical to SEQ ID NO: 6304
  Synthetic

SEQ ID NO: 6306 - protein, 184 aa, Artificial Sequence
  Synthetic
SIDEIIEELRRRIEELRKEAEKIIRDSKKHLEDNKRDADRVIKESKEEVDKLLKEIEEAPISEELLRRVRDVIRRIEESTKKALEDIKRTIDEIKKSTDDALRTVREVIKRIRDLVDDVRKRIRTEELLEEVRKRIEDLLRELRDILRKLLERDKRLSKESERLVREMLREDRRLLDELRKEVK

SEQ ID NO: 6307 - protein, 184 aa, Artificial Sequence; identical to SEQ ID NO: 6306
  Synthetic

SEQ ID NO: 6308 - protein, 184 aa, Artificial Sequence
  Synthetic
SIEEIIRDLRRHIKENAEEAEKVIKESEDHLRENKKRAEDVIRRLEEELRKLAERVRRAPISEELLRRLEELIEELEKLVRDALRAIEKTIKDIEDSTRRVLEKIKETVKRLKELVDEASRRIRDEELLKRAVDAVRKLSEDSKRLVEEALRRDEELSKRSRDLVEEVRRRAEELLRRIEETVK

SEQ ID NO: 6309 - protein, 184 aa, Artificial Sequence; identical to SEQ ID NO: 6308
  Synthetic

SEQ ID NO: 6310 - protein, 178 aa, Artificial Sequence
  Synthetic
SSKDDVRRRMKEINERDKRLLDEVLRRLEKLIEELKRHTEEVERDADRIIEEIERMLRNGASEETAKRLLEELREKLEDVRRRDEKILEDIRRDVERALRESEKSLDELRRALEKVKDDGSVEERIIKEIRDLIRENEERNKEIVRRIEELLRELEKRSRDVIKRIREKLDRLRKRVE

SEQ ID NO: 6311 - protein, 178 aa, Artificial Sequence; identical to SEQ ID NO: 6310
  Synthetic

SEQ ID NO: 6312 - protein, 178 aa, Artificial Sequence
  Synthetic
SKVEEIERRIREEVTRSEKEDRDNVREIRKLVEELRRESKRILDESRRLVKRLIDEAKDLEELIRRIREMLKRSEENNKRIIDDLTRALEELEREHRENNKRLRELLRELEEKAKRIKDDEILKRIEEEVRKILEDSRRSTEESHEKVRRIITKIRKLLEDDERRNRKVVREAEEAMR

SEQ ID NO: 6313 - protein, 178 aa, Artificial Sequence; identical to SEQ ID NO: 6312
  Synthetic

SEQ ID NO: 6314 - protein, 178 aa, Artificial Sequence
  Synthetic
SKLEELLRRAREVARRLKEELERILKEVEDRVRKSEKEDEDNVKRITDEMRKLKERVPDLKELLDRIDEMLERLRKLHEDNNKRLRDEIKKLEDVVEEILRRLEKVLRELEEKVARVKEDRVIKRIEEDVRRVIEEIKRLLRELEEEIRRILDESRESTERSHRTARKIVEEVERAAK

SEQ ID NO: 6315 - protein, 178 aa, Artificial Sequence; identical to SEQ ID NO: 6314
  Synthetic

SEQ ID NO: 6316 - protein, 178 aa, Artificial Sequence
  Synthetic
SKMETIERRVEEAIRESEELNERDEERVKKVIDELKKLIDDIRRRLEEALRELKKVTDDGSPREDIDRKIKTVLRELEELIKRIRERIKEILRENEKTVRDDRRRNEELRAELKKLVDEGAVTEEILKKVRELIEETKRRTDDLHKKVKERVDDIKRRLDELLEEAKRALDEIRERVK

SEQ ID NO: 6317 - protein, 178 aa, Artificial Sequence; identical to SEQ ID NO: 6316
  Synthetic

SEQ ID NO: 6318 - protein, 178 aa, Artificial Sequence
  Synthetic
SAVEEIKRRLEEIIRDLERLIDDDRKRVEEMVKRIEDLIKKDEEDVREALKKLEEVVTRGEPREDIKRKIRELLARNRDTLRRIKEELEKILEENKESVREIEKKIEDAKRELRKLVEDGVLEEEILERADRLVKEIKEKLDRLVKTSEELIRRLEEELRRLHEKVKELMKRAEEKVR

SEQ ID NO: 6319 - protein, 178 aa, Artificial Sequence; identical to SEQ ID NO: 6318
  Synthetic

SEQ ID NO: 6320 - protein, 181 aa, Artificial Sequence
  Synthetic
SREDVLREIRRLVEETKKENEKILERLRRLVRTVERRNDEVVKKVRTLVKRLEEEIDKTVKDKDKVEKLRRELDKIRRKLEELARRSKEDLKRILEEVDRLSEEDKRKNDRVLEEAKKAIDNDVDLDELLRKLKEDLDRSKEELKEIEKRVRELLERNKRKTEEVEKEVKRDLDDIRRKLK

SEQ ID NO: 6321 - protein, 181 aa, Artificial Sequence; identical to SEQ ID NO: 6320
  Synthetic

SEQ ID NO: 6322 - protein, 181 aa, Artificial Sequence
  Synthetic
SEKEALDEVRKRVEDVRRDNKRILEESERLNRESRKRNRDILERLRKEAEDLKREIDETVKDKDKVKELDDRLKKVLKEVEDLVRESERDLERIHKRSRDLVRESERDLDRIEKEIKDAADRDVDLDKLLEDLERLLKENLDRLRKILEEDRRLNKENNDKLKEIEKRVRELLKDIKDKLK

SEQ ID NO: 6323 - protein, 181 aa, Artificial Sequence; identical to SEQ ID NO: 6322
  Synthetic

SEQ ID NO: 6324 - protein, 178 aa, Artificial Sequence
  Synthetic
KEVEDVLRKIRDLVRKNLEDAERVVEEAKRLIDENRERLREVLREDEELNREILKRLRELKDEDALRDLERKLKEVHDRTKKLIEDSERHLEEVLRKVEKVIKDSEKHLREVLDEVEKAGLDEEALKEVRRLIDELRKANKRILEEIRDLVRRLREENEEILRRLKRKNERTADEIRK

SEQ ID NO: 6325 - protein, 178 aa, Artificial Sequence; identical to SEQ ID NO: 6324
  Synthetic

SEQ ID NO: 6326 - protein, 178 aa, Artificial Sequence
  Synthetic
SEVEDVLRRIRELLEEIKRRLEDVRRRIKELLDRNRRESEDVLRRDKELNDEVRDKLRKRKDEKVLEELEREIKKIHDDTKRAVDRSREDNKRILDEVERAIEELERELERVLDEARKAGVEERMLKTVEDLVREVSKEVRRILEELRDEVRKSEEENRRILDKLEKENRKTAEDVKR

SEQ ID NO: 6327 - protein, 178 aa, Artificial Sequence; identical to SEQ ID NO: 6326
  Synthetic

SEQ ID NO: 6328 - protein, 178 aa, Artificial Sequence
  Synthetic
SEVEEVLRRIKELLDRNREELKKVRERIKRLLDRNREKSEEVRERDKRLNDEIKKRLDEDKDEKVLRKLKRLLEEVHKRTKEMADRSREDNKRILDEVEDVARRSKEDNERILKEAEEAGVEKRVLEEARRLVKKSEEDNRRILKELRELVKESERENEEILRELKKLNEDTKKRIED

SEQ ID NO: 6329 - protein, 178 aa, Artificial Sequence; identical to SEQ ID NO: 6328
  Synthetic

SEQ ID NO: 6330 - protein, 178 aa, Artificial Sequence
  Synthetic
DEVEEVLRKIEELIRENIKRAREVLEEDKRLNERNKRESEKVLEEDERLNREIEKELRKLKDEEVLRRLKEKIDEVHKRTREMFERSRDDNRRIHEKTRRAIEKSREDNKRILDEVRKAGLDEEVLRRIKKLIEESMEDNERILRDAERLNRESKERNERILKRLKKRNDETRKEVEK

SEQ ID NO: 6331 - protein, 178 aa, Artificial Sequence; identical to SEQ ID NO: 6330
  Synthetic

SEQ ID NO: 6332 - protein, 179 aa, Artificial Sequence
  Synthetic
SSAEEVKERSKRINEEIEKTLEKMLRESRRTNEEIKKTLKRLAEEAEKLLRDVERLVRAGVPKEDLKRLLKEIKERVEKLLRELEELIKRDNDRVEKALKDLRDLIKDDTDKVEDVRRRGDLDEDIIREIRELNKRTRDKIEEIIERIRKLNKETRDRIRKIMREIEKKIRDLAEEIRR

SEQ ID NO: 6333 - protein, 179 aa, Artificial Sequence; identical to SEQ ID NO: 6332
  Synthetic

SEQ ID NO: 6334 - protein, 179 aa, Artificial Sequence
  Synthetic
KSMEEARKKSKEINDRILDRLKKVLEESRKINKDIKDTVERLRERSEDINRRIKELVDSGRDKKDLRRLIEDDNTKVRKALEDLRELIRRDNERVKKVLRELRELIKRDTEEVEDVLRRGDLSEEIIKEIRKLNEETRKEIERIAREAEELNKRTADKIETIIREIEKLNKKLKDDIEK

SEQ ID NO: 6335 - protein, 179 aa, Artificial Sequence; identical to SEQ ID NO: 6334
  Synthetic

SEQ ID NO: 6336 - protein, 176 aa, Artificial Sequence
  Synthetic
DEVRELVKEIEELIERIERTLRKMTKDSRDLNRKINEKLKKVLEDSRRLNEEIKRTIDSNPEKKERARELLERDEELIRRVREELKRLLEEDNERIKEAEDRLARLLEEIERRIREIDVDESILRRLEKLLEELRKRVEDIIRELEKLNKESREEIDKIIREAERLTEETERRARK

SEQ ID NO: 6337 - protein, 176 aa, Artificial Sequence; identical to SEQ ID NO: 6336
  Synthetic

SEQ ID NO: 6338 - protein, 178 aa, Artificial Sequence
  Synthetic
DEMEELLERIRRLIREIDERLKEMLKRSRELNRELNERNKDVLRRIKELIDRIRRLIERDNDKKLVERLLEELERVIREDHKRVRKLLDENRKLSKELEDEARRLLKELEEVIDRVRRAGADERILRELKKLVDDLRRRIKKILDESKELLERSEKKADESNKELRKLVEELRKEADD

SEQ ID NO: 6339 - protein, 178 aa, Artificial Sequence; identical to SEQ ID NO: 6338
  Synthetic

SEQ ID NO: 6340 - protein, 178 aa, Artificial Sequence
  Synthetic
SRVEEIERRIRELIKRIEDRNRKMLETSRRLNEDINRRLRELLERIRKLIEEIEELIKRDNDKDTARKLLKEIEDLIRRLSEEAKELLDENRRLSEKDHREARRLLKEIEDLIRRAEEDGVDEKILRDLEELLKELARRLERSNEESRRLLEDSRRKMEKIIRELEKLLDDLRRKIEK

SEQ ID NO: 6341 - protein, 178 aa, Artificial Sequence; identical to SEQ ID NO: 6340
  Synthetic

SEQ ID NO: 6342 - protein, 177 aa, Artificial Sequence
  Synthetic
DEKEIDEEIERLVRDSKRRSRKVLRDIEELAKRVKEENDRVLEKLRKLIEDLKRKIDETIEDKDTVKRLTEKLETALRELEELSKENRRRLEEITKRVRELVRRDEEKNRDVERRVKEIPVSERLKEEVDRVIADSRRLNKEILDEVKRELDKLRKHLEDVLRRAEKMIRDIDEELR

SEQ ID NO: 6343 - protein, 177 aa, Artificial Sequence; identical to SEQ ID NO: 6342
  Synthetic

SEQ ID NO: 6344 - protein, 175 aa, Artificial Sequence
  Synthetic
SEVDKVREDVERLSARSEEKVREVLERVKRLLDKSKRDNEDVKRRVRELAERLRDLRRKGVPKEELKKRLEDIRREVEDLARRDKEKNKKILDEAEDLVKKLRDDNRRVEREVERAGIDKEVLDRIRRRIEENSKKIDDMVKKVRTLVKRSEEESERVLKELRDLMRDVERRIRE

SEQ ID NO: 6345 - protein, 175 aa, Artificial Sequence; identical to SEQ ID NO: 6344
  Synthetic

SEQ ID NO: 6346 - protein, 177 aa, Artificial Sequence
  Synthetic
SEVERVEKEIRDLSRKSNEDLKRILDEARELSKKSNEDTKRVLKETRDLLKEIADRLREVRDKRLKDRLREDLRRILERHKKLSEEDKRKNDEVLRDLRRKLEELKRRNEKVRDDVEKKGLDEEVKKRVEESLRENEKLLRTIAKEIEDLVRENRKVNEDVNREVEKLVRELEERIK

SEQ ID NO: 6347 - protein, 177 aa, Artificial Sequence; identical to SEQ ID NO: 6346
  Synthetic

SEQ ID NO: 6348 - protein, 183 aa, Artificial Sequence
  Synthetic
REVEELLKRIRELVKRNNEKTKRLLDESRRLNEEANRRLDKVLKELRDLAKRIKEELDEKGGEDERAKKRVEDMLRRLEELLREATKDSERMLKENRELVDRIREEDKRVLEELDKLVKEILERNKEDEDLEREVKKLLDENRESSERVIRESEKSLRDHAERTRKVREEIRKLLEELKRAVE

SEQ ID NO: 6349 - protein, 183 aa, Artificial Sequence; identical to SEQ ID NO: 6348
  Synthetic

SEQ ID NO: 6350 - protein, 174 aa, Artificial Sequence
  Synthetic
SEKEDIKRKLDDLLRRHREVSRESNRELKRLLEEHRRTSKRLDDEIKRLLREIEEAGASEELRRELEEIVTEVKKLIEEINRRLEDAVRKVHENNRKLDRELEEVVKTLRDLLRRNVDTETVRKEIEDIARRSKEKLEKNTRDVKRMVDRSKEELKRILKELEDAIREIKKKVD

SEQ ID NO: 6351 - protein, 174 aa, Artificial Sequence; identical to SEQ ID NO: 6350
  Synthetic

SEQ ID NO: 6352 - protein, 177 aa, Artificial Sequence
  Synthetic
SEKERILERLKELVERSNEKLERILRRSEKLFTDSNKELKDILDRARKLIEEIDDRIRKVKEKELKDELRKRLEEILKEARDLSEEDKEKSERVHRESRELSERDEEESRKVLEEVRSRDLDKKIRDDAERLITENKERNERVNKRDEDLLRRNRKENEELNRELERLVKEIREKLK

SEQ ID NO: 6353 - protein, 177 aa, Artificial Sequence; identical to SEQ ID NO: 6352
  Synthetic

SEQ ID NO: 6354 - protein, 177 aa, Artificial Sequence
  Synthetic
EEKERILETAKKLAEEIKRRAEEILKRSEELVRDSNKKLREVLEEARRLIKKIEDEIREIREDELKRRVREKLERILRRLRELSKEDLKRSEEVHRRSRRLLEELLEKLEEILRRLKSKPLDKEIEDEVRRLVREIEELLRDIERRDKELLDENRKLNEEVNRDAERLVRKIRKALE

SEQ ID NO: 6355 - protein, 177 aa, Artificial Sequence; identical to SEQ ID NO: 6354
  Synthetic

SEQ ID NO: 6356 - protein, 177 aa, Artificial Sequence
  Synthetic
SEVEELLRRIRELSKRSKDEIKRMLKEIRELSEKSKRDIERMLRRNEDLARKIKELIDRDNNDELVKRLNEESEKLAREARKRVERSIREIERLLEEIRRRVEESLRTLKEVLKEVEKNGVTEEIKREVEKLLEENRKLLEDLEEDVKRLIEENKRALEEVERESKRLNDESRERTK

SEQ ID NO: 6357 - protein, 177 aa, Artificial Sequence; identical to SEQ ID NO: 6356
  Synthetic

SEQ ID NO: 6358 - protein, 178 aa, Artificial Sequence
  Synthetic
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 6359 - protein, 178 aa, Artificial Sequence; identical to SEQ ID NO: 6358
  Synthetic

SEQ ID NO: 6360 - protein, 187 aa, Artificial Sequence
  Synthetic
SEIEEILERIKKISEDSKRRLEDILRKAKKISDESRETNKKTLEDVRRIADEIRKRLEEAGGRDERDLRRLMKEVKERLEEMLKRDDELAKESIKILKDVLKELRELVKRSETELRRVIEELRRRVRDKDKLERVEREIRRLIKENKDIVERIERAIEELVRRNEKSVEDSKKDIKRLVDELDREAR

SEQ ID NO: 6361 - protein, 187 aa, Artificial Sequence; identical to SEQ ID NO: 6360
  Synthetic

SEQ ID NO: 6362 - protein, 180 aa, Artificial Sequence
  Synthetic
SEVERIKERIDKLVEENRKLVEEIEEEDRRLLEENREIVKRIEEEIEKLLRDLERRVKSEKAKEIRKKIKKARDELREVLKRSEEISKETIDRLKRLLEESKKELERLKRTLDEMAKRNEPEDVLRDILREIERLSKESKDRLKDLLRKSEELSKESKKLLKDILKKVEDLIREAREEAR

SEQ ID NO: 6363 - protein, 180 aa, Artificial Sequence; identical to SEQ ID NO: 6362
  Synthetic

SEQ ID NO: 6364 - protein, 184 aa, Artificial Sequence
  Synthetic
EEKERLKKSLEDLAKRIRDILRKHEEDSRRLSKEIRDVLRRHREASRKLVEEIKELIKSVRDEELVKELEKLLRELEKRSEDLLRELEKRLKELEDRSRDILRRLEELLRRLEERVKKALREVDGEEMLKRVLEELERIVRDIERRIKEASERIRKIVEDIKKRIKEADDRIKDIVREIAERIR

SEQ ID NO: 6365 - protein, 184 aa, Artificial Sequence; identical to SEQ ID NO: 6364
  Synthetic

SEQ ID NO: 6366 - protein, 177 aa, Artificial Sequence
  Synthetic
DEEEEALKDVERLLRRNEKLIEEHERRSEKLLRELEDVVRRHEERSKELLERIRERIKRLTDEDRVRDIERLMRELEEESRRTAKTARELLEELRRRSKETVERIEKSLEDLRRTVEREGVDEEVLKKLRKLSKESEDDIRKMSEEVEEIVRRIKRLLEEATRKLEELVKRIEERID

SEQ ID NO: 6367 - protein, 177 aa, Artificial Sequence; identical to SEQ ID NO: 6366
  Synthetic

SEQ ID NO: 6368 - protein, 177 aa, Artificial Sequence
  Synthetic
DEDEEAKREVERLLRENEKLIEDHKRLSEELVRRLEDLIRRHEETSERLLRELREIIKRQTDEKRVREIEDLLRRLKKRSDDTVRDIKRLIKELKDKSERIVREAEKSLKKLKEVVDRKGVDEDVLRELRDLSRRSKEEIKKMSEEIEKLARDILKRIREMTEEAKRIVKEIKDRIR

SEQ ID NO: 6369 - protein, 177 aa, Artificial Sequence; identical to SEQ ID NO: 6368
  Synthetic

SEQ ID NO: 6370 - protein, 186 aa, Artificial Sequence
  Synthetic
SEIERVLKELDEVSKKSLEEIRRMSEESRRLSKESIDRIREMLERAREKADRIRETIKREGGESEEARDRIKKLIDELRELLREVDERIKKSIEDLERLARETEERIKTSIRDLEEKVKEIAKRITDKDKLRRLRERVEELKKRNEDLLKEHRDENKRLIDENRDLVDKLRKTIKRLIDDLERRVR

SEQ ID NO: 6371 - protein, 186 aa, Artificial Sequence; identical to SEQ ID NO: 6370
  Synthetic

SEQ ID NO: 6372 - protein, 179 aa, Artificial Sequence
  Synthetic
SKVDELRKTVEKLLRELRDSLRRYEEESKRLLEELDDSLRRSKKTVEDLLREIKEILKRVRDEEVRKTVERVLRELKEILDRDKERVDRVKEENKRLLEKDRKTVEDVLRELEDLLEKIRKRPDDRAKERLERLVRKIKEDNKRSLTENERLVRKIKKENEDAIRRLKDVAKKIKEELT

SEQ ID NO: 6373 - protein, 179 aa, Artificial Sequence; identical to SEQ ID NO: 6372
  Synthetic

SEQ ID NO: 6374 - protein, 176 aa, Artificial Sequence
  Synthetic
SEKEELKKEIRRNLEENKDVLRRHEEENRRLKKRIKELLERHARTNKRLKEEIDRTIRDKDTAERVKRELDKLHKEAEELIREVLRRLDELHKTAEDIVRTSEKLLKEVEEELKDLDSRLLEELLRKLEKLSRDSKEKLKEISKRSKELVKRIERELEKMTKKSRDLVKKIKEEEK

SEQ ID NO: 6375 - protein, 176 aa, Artificial Sequence; identical to SEQ ID NO: 6374
  Synthetic

SEQ ID NO: 6376 - protein, 178 aa, Artificial Sequence
  Synthetic
SEVEELRKELERIVKETKDVAEELSRESEEVLKKSEENLRRLTEKSDDVLRRVAELIRSNRDTDTVVTEARDLLRRSDEHLEENLRRTDKELRDSDEKLKRLEEEHRKLSEEIKRRLDERGGVKELKERIERVNREVREEARKHHDKNRDIRRRVTELHKRHKERNEEIRRKVEEDAK

SEQ ID NO: 6377 - protein, 178 aa, Artificial Sequence; identical to SEQ ID NO: 6376
  Synthetic

SEQ ID NO: 6378 - protein, 178 aa, Artificial Sequence
  Synthetic
DEIEDLRRKVEKVVRDAEKVLRDLSRKSRKVHEDSRENVDRLLKEVEDVVKRVADLIRSNQDRDTVVKEAREVAKRIKEHLDRNLERVKKMMRDSDKELRDLLETIKRVVEEIKKRLEDKGGVEELKRTLEELLKRVEDLVRRHHEENKKLTDDNRRLHRRLRERLKEVLREVERRRD

SEQ ID NO: 6379 - protein, 178 aa, Artificial Sequence; identical to SEQ ID NO: 6378
  Synthetic

SEQ ID NO: 6380 - protein, 182 aa, Artificial Sequence
  Synthetic
SDVERIEEELRKLTEENRKLTETLKTELRKIRREVEKILKELEDRLRELSERVKDLIRKRNVPEDLKRKVDEIRKTIKTLLEEIERRVRKVEEEIKELLKDSNRKTERVIREIKRLLKDLGDKKEVLDDIRRKLKKLHDESKKTHRDILERLKEALKRLLELAERVLEELERRAEELRREIK

SEQ ID NO: 6381 - protein, 182 aa, Artificial Sequence; identical to SEQ ID NO: 6380
  Synthetic

SEQ ID NO: 6382 - protein, 182 aa, Artificial Sequence
  Synthetic
DDVERLEERLKELDKRNKELTKDLEDKLRKLTRDNRELLKKIEKRLEEVRREVKRLITERNVPERLEDKVREIEKEIRDLLDELRKRSDKVIRDIERLLEESNEKTERVIERIRRLLEKLGSLKEVAERIREELERLHEESKRLHEKILEDLERAHDETRRIVEDILRRLEKVARELKEEIR

SEQ ID NO: 6383 - protein, 182 aa, Artificial Sequence; identical to SEQ ID NO: 6382
  Synthetic

SEQ ID NO: 6384 - protein, 177 aa, Artificial Sequence
  Synthetic
DELRELIKTLREILERLLDRSRRLNDKLKEILERIERASKKMNDDDRRRVRRLEEEVRTEDLAREAEKTNKKTLEESEELIRRVEDELERVLDRSRTLIKEAKRIIEKLLDEIRKTVDSRRLEDVERVVEEAKRALERSLRENEKSVEDIKKRIRESVEENKKSVRDTLERLKRTLE

SEQ ID NO: 6385 - protein, 177 aa, Artificial Sequence; identical to SEQ ID NO: 6384
  Synthetic

SEQ ID NO: 6386 - protein, 179 aa, Artificial Sequence
  Synthetic
STEEEVRKRVEEIERTLRESLERNRETVERSEERLEELLRRARRVVEESKKRLDKEIKDERLLREVTDLNRKSLERIEELIKEADERNKRSLERSERIIRRAEELLRDVLRKAEELSDVTDEVMRDLIRKLEDILRRLKEESDRLNEEHKEILKELVRRLEEIIKEHREIVERILKKTR

SEQ ID NO: 6387 - protein, 179 aa, Artificial Sequence; identical to SEQ ID NO: 6386
  Synthetic

SEQ ID NO: 6388 - protein, 174 aa, Artificial Sequence
  Synthetic
DEEEEVKRLLDRIREEVKRLHDENKKRLDELRRTVDKLLRESERENKRVNDEVRKDGIPKEVLDELKEMSDRDREENERIVRDARKKIDDIERRSKKLLDDVEDALRRLEELLRRNTDVETLKRRIEDVLRRVEEESRRLNKELEDVLRRAKELVDRSKKKLEEVLRRVKEKAK

SEQ ID NO: 6389 - protein, 174 aa, Artificial Sequence; identical to SEQ ID NO: 6388
  Synthetic

SEQ ID NO: 6390 - protein, 174 aa, Artificial Sequence
  Synthetic
DEEREIEELLRTLTREVKRLLDESRKLNEEILRKVKRLHDENRKRIREVLEDVKRRGLPEEVVREVKRVLEEILRKSEKLLRDVERLSEEDKKRNEEIVDRAREVLKRVEELLRRNTDVETLKEEVKRALEEVEKRVRDSKRDLKRVAEEVEETSRRLNDELRKVREDVRRRAT

SEQ ID NO: 6391 - protein, 174 aa, Artificial Sequence; identical to SEQ ID NO: 6390
  Synthetic

SEQ ID NO: 6392 - protein, 188 aa, Artificial Sequence
  Synthetic
EEAERIADEARKVEEDVRRMVEESKRKLKKVLDDSKRLIDELKRRLEDIRRKVAEMAKRLRDDRDVVREVVRRVEELLDDIRRRLEDIHRRSRELSERDKEENRRVLERVERVLRELRKKLEDVKDRIDERVLRDIERLLEEIRRELERLARESEKVNERVNREDRRLLEEIRELLERIRKELEERTR

SEQ ID NO: 6393 - protein, 188 aa, Artificial Sequence; identical to SEQ ID NO: 6392
  Synthetic

SEQ ID NO: 6394 - protein, 179 aa, Artificial Sequence
  Synthetic
SLKEEVDELLRRIEEEIRRLADKSRRTNERVKEEIDRLARESEETNKKLKKKIEDIDVDEEIVRDARRLLEESHRRNRKLLEDAKKLLRESHEKNKKILKDAERLLDEIRKRAEANKDKDAKIVKKLLEDLKRLLKEVKELMERINKETKELLERVAREVKRLNTDTERLLKEVEDRVR

SEQ ID NO: 6395 - protein, 179 aa, Artificial Sequence; identical to SEQ ID NO: 6394
  Synthetic

SEQ ID NO: 6396 - protein, 176 aa, Artificial Sequence
  Synthetic
SEREEIEELSRRSRRSLEELKKEIRKVNERNKRLLEELEREIRRVSKESRDRLRELRRRLSEELAKRVDEVNRRVKREVEELVRRNEEVDKRSKEVVEKLAREVEKMNKDAKDLVDRNVDTKDLIRRLRELTRTIERRATELIKRLEEVSREIAERVRKLIKELRDMTRKIDEDAR

SEQ ID NO: 6397 - protein, 176 aa, Artificial Sequence; identical to SEQ ID NO: 6396
  Synthetic

SEQ ID NO: 6398 - protein, 182 aa, Artificial Sequence
  Synthetic
SEVEKLLERLKKILEEIARLVDRSNTEDDKILRKAEEDVRRLLDKLKKILERAAELLARNEEKERLIEEIERRLREVLKEVRRLLKKLKEDNKKSLEDNKKLLDDVRKTLDDLLRDAERTVRDEKLRREIRKLVKELKETIKRLEKKSRDTVKRTEDELRRLEEEAERLITELKERLDELRK

SEQ ID NO: 6399 - protein, 182 aa, Artificial Sequence; identical to SEQ ID NO: 6398
  Synthetic

SEQ ID NO: 6400 - protein, 175 aa, Artificial Sequence
  Synthetic
REDEEMLKDLKRVLEDAERVSRDTLRELEDAVRRLHELSEDTLDKLRKVLEEADRLIRSNQDKDEVVKRLEDILRKILEETKRIIDEARKILKKVEDDTRKLIKDVERLIERIKKDLEGNEDVRRILERVRKELKRLLEENEKLLRRVEKELEENERRNEEEIRRVKKTVEERAK

SEQ ID NO: 6401 - protein, 175 aa, Artificial Sequence; identical to SEQ ID NO: 6400
  Synthetic

SEQ ID NO: 6402 - protein, 181 aa, Artificial Sequence
  Synthetic
SRVEEVLKENRDTNEELKDTVRKILETNRRTLERAEEEVRKILEDLRDIARKIEEMVENGASEKTLKDLLDELRRTVEEVLRKLEKLLRKDEEDVRRALEKLEKLLRDDERRVKEVEDEIKDKEMLERLRRSLEESKETVKRLLEELRKSLEKSKRDVERLLKELEDLLRELEKKVDDRRR

SEQ ID NO: 6403 - protein, 181 aa, Artificial Sequence; identical to SEQ ID NO: 6402
  Synthetic

SEQ ID NO: 6404 - protein, 178 aa, Artificial Sequence
  Synthetic
DEAREILTRIRKLLEEIRKEAEEVSERHKRLVDELDKEVKDINKRAEDLLRELAEIVKRGDVDKRRIEEEVRKINEEHKDRVRRIADRVKKINKELEDIVRELKKKVEDVLRELARLIKDVDEKEVRKVLEEIKRVLEELKRHAEDNLRRAREVLKKLADEAKRVNERSEELLRELKK

SEQ ID NO: 6405 - protein, 178 aa, Artificial Sequence; identical to SEQ ID NO: 6404
  Synthetic

SEQ ID NO: 6406 - protein, 178 aa, Artificial Sequence
  Synthetic
SMADEILRELKELTEEIERRVREASREHRERLEKLRREVREINKELKRRLDELREIVERGEVDKEEITRTVEEINKEHKELLKRIEERVKKINEDLRRLLEKLTDESRRVLERLKRLLKDVDKDRVEKILRENKERTDRLRRHIEKNLEDARDLLRKLKEEVKRVNEESEKSLRDLRK

SEQ ID NO: 6407 - protein, 178 aa, Artificial Sequence; identical to SEQ ID NO: 6406
  Synthetic

SEQ ID NO: 6408 - protein, 181 aa, Artificial Sequence
  Synthetic
SLEEDIRRILDENRRSTERIKEEIREINERDKRSLEDIERRIRKVLEDLRKLLEDLAREGLDEEIRRRVKEILDEIRRLLEELKRRVEEINKRTTDLLKTLERESEKILRRIEDLLRKLKDIEEAVRKILKEVRDVNEELKRRVEKILEDIRDANRRLRETVEEIIRRAKEAVDKLRDEVR

SEQ ID NO: 6409 - protein, 181 aa, Artificial Sequence; identical to SEQ ID NO: 6408
  Synthetic

SEQ ID NO: 6410 - protein, 179 aa, Artificial Sequence
  Synthetic
SEKERVDDLLRRVDELLKRSKREVEKLLEDNKRLLERIERENRRLTKELEDKVRRLKEKGLVDDEVLKEAEKLLEENNRKSKEILEENKRLLEELKKEVEEIHRKTKKVLDELADIVRRGERDVEEIAKEIRDVLREHKELIDEIRKKAKKISDKSRKLMEELERHLRRVIKELDEKAR

SEQ ID NO: 6411 - protein, 179 aa, Artificial Sequence; identical to SEQ ID NO: 6410
  Synthetic

SEQ ID NO: 6412 - protein, 179 aa, Artificial Sequence
  Synthetic
SEEEEVEELLRRNRKKAEEVDREIDRLLKEVEKLVKDSRKRIEDLLRRAREKVEDLRRKGDVSEEVLKRAEDLLREIEEKVERIHETTKKVLEDLKRRVEEVLRDNERLIRELEKIVRAGKRDVREISEEIERITRETEDRIRKIAEEIRRVLKRHKELIEELEKEIRDVLKKLDDDVR

SEQ ID NO: 6413 - protein, 179 aa, Artificial Sequence; identical to SEQ ID NO: 6412
  Synthetic

SEQ ID NO: 6414 - protein, 178 aa, Artificial Sequence
  Synthetic
SEIEKLLKDLRDLLKKSEETVREMLKRLEEIVRRAEEDHKRLLEKLKRLLEKLRRDVRTDEVIKRAREDIERVLREIRKLNKEVEDEIRKIIEDLEDILRRSHETIERILREIRRRSRREEVRKRLEDLADEVDKRNRDIERKIRELMKRAKEVSERLNKELEDLAREAEKLLRELKK

SEQ ID NO: 6415 - protein, 178 aa, Artificial Sequence; identical to SEQ ID NO: 6414
  Synthetic

SEQ ID NO: 6416 - protein, 178 aa, Artificial Sequence
  Synthetic
DEIEELLKRLRDIVRKIREDHERLSRESERINKDARRRHDEMLRRLEELLRKVEKEVRTEELIKRVEEEIRRIIEEARRINEEVDKRSEDVVRTMKELNDRVDKDIDRVIDELRKRIRDEKVKRDIERIRKEVKEESKRLNDHIRDNERRNKESSEELNRRIKKIADEVRELLEKLKT

SEQ ID NO: 6417 - protein, 178 aa, Artificial Sequence; identical to SEQ ID NO: 6416
  Synthetic

SEQ ID NO: 6418 - protein, 175 aa, Artificial Sequence
  Synthetic
REEERLRELMDESRKRIEAVEKRARDLKRKSDRLIEDAARKIKTILDKIRKLIEDLRTDERVLEKIRKLLEELEKEARDVLERWKKLLEDSLRELEELLKKWRELTERLKEELDAGEKDLKDVEKKIREVNKTVKEEVDRLVEKNERLNDEARRVVKELLDKVERMLEEVEREAR

SEQ ID NO: 6419 - protein, 175 aa, Artificial Sequence; identical to SEQ ID NO: 6418
  Synthetic

SEQ ID NO: 6420 - protein, 174 aa, Artificial Sequence
  Synthetic
SEKEDMARKIKELIDRDRERIERVIREIEKLIKELRDHNKRVLETDKRLLDDLKRVADDGIDRSELERLAEEIIRHTERVTERDKRIVDEIRKKIKEILEDNERTNREIRDELEKAPKDEDLRRLKEEVDRVAEETRRLLEEIKKKVDKVVREVETSNRRSEEEVRRLLDEIRR

SEQ ID NO: 6421 - protein, 174 aa, Artificial Sequence; identical to SEQ ID NO: 6420
  Synthetic

SEQ ID NO: 6422 - protein, 174 aa, Artificial Sequence
  Synthetic
DEKEEAARRVEKLITELRKHNEDVLRDIKRLIDELRRHNEEVLKRDRELLERLRKVAEEGVDKDTLDELAKRIKDHTDEVTKRDRKILKDIKKKIEEVSRRDEKIFREIERVLAELPKDKELDDLRKRAEDVLRDLRRTNRKILEDVRRVIEELERSNERSLTEVERLLREVRK

SEQ ID NO: 6423 - protein, 174 aa, Artificial Sequence; identical to SEQ ID NO: 6422
  Synthetic

SEQ ID NO: 6424 - protein, 174 aa, Artificial Sequence
  Synthetic
SEKERVLTELEKILEELRRRVEEILKEIEKLIEELRRHNERALERDKKLLEELKEVRERGVPEKEIEKLLKELEKHTRDVTRRDREIMKRIEKRIEDVKDEIRRMIKKARDRVRSLPKDRELEKVKEKLDRLMKDIKEKLDRVKEKVRRVLKELEESNRKSEKDAKELIDRIRK

SEQ ID NO: 6425 - protein, 174 aa, Artificial Sequence; identical to SEQ ID NO: 6424
  Synthetic

SEQ ID NO: 6426 - protein, 178 aa, Artificial Sequence
  Synthetic
SEVEDLLRDIERLIEESRRLVERLLERLEELIRRHTRLVEELIRELERMLKKVADEVDKRELIERAEEEIRKLVKDLRRINDEANKRVEKLVRELEKILKESHDKVDEIRKRVEKDIRRDEIRTEIKKVVDKAREVNKRIKELIDKIKREAEENSKRANELIERITREIRRLLEDLRR

SEQ ID NO: 6427 - protein, 178 aa, Artificial Sequence; identical to SEQ ID NO: 6426
  Synthetic

SEQ ID NO: 6428 - protein, 186 aa, Artificial Sequence
  Synthetic
SELEELRKRVKDLIRETKKLVEEVAEKVERLNKETKKLLEDVARIVEELIRRAEEVAERIREDEKLKRALERLEEEIRRLVEEAERLLRESHEKNERLVREAKELLDRSHELAKELIEDAKRKLKDLEEVLRDIERLAREIEKVNREAEERIRRLKKKSEETNERVKRAIDKLAEELRRVLEEIRR

SEQ ID NO: 6429 - protein, 186 aa, Artificial Sequence; identical to SEQ ID NO: 6428
  Synthetic

SEQ ID NO: 6430 - protein, 186 aa, Artificial Sequence
  Synthetic
SELEELAKAVEKLLEDLRRMTREVEEKVKEINERTKKLLKDVAERVKTLLREIEELAKKIKEDKKLDDALRRLEEKIRKLVEELKRLLDESHKRNRDLVREARKILDDIRRRAEKLIRDAEEKLKELREVLKAIKELMERIKKTLDEIRKRIKELEDESEKTNRELKKKIEDLKRELEELLREIKR

SEQ ID NO: 6431 - protein, 186 aa, Artificial Sequence; identical to SEQ ID NO: 6430
  Synthetic

SEQ ID NO: 6432 - protein, 182 aa, Artificial Sequence
  Synthetic
SEIDEVIKTLEKLLEDLRRELEELSRRNKKVLEDILRRVKRLSDENRRLLERIKRTVDKRGTTEEILEELKRAVEKTRRDAEKLLDEIRRATKKLRDDIEKLKEDIERIERDAKDKIDKLSRDEKIEKKVKEVRERVKEVLERIERLVDENRRENKEVVDRIKKLLKENEEEVREVLKRIRD

SEQ ID NO: 6433 - protein, 182 aa, Artificial Sequence; identical to SEQ ID NO: 6432
  Synthetic

SEQ ID NO: 6434 - protein, 182 aa, Artificial Sequence
  Synthetic
SEIDDLVKKNKELVKKIREDVERLSEENKEVLKDIERKVRKVSEENDRLLEEIKDTVRKRGTTEDILRKLKRALERTTEEIKKILRELEEADKRLDKAIEELKDRIRRVSEDMRDKIEKIRRDRKVEKKVRENKKENEDVLRDIERLVKENKDRNREVLKRIEDLLRKNAERVKRVADEIRR

SEQ ID NO: 6435 - protein, 182 aa, Artificial Sequence; identical to SEQ ID NO: 6434
  Synthetic

SEQ ID NO: 6436 - protein, 176 aa, Artificial Sequence
  Synthetic
KEVEDIVDDVRRVIEELKRKVEEVSKKNEKLVREIEERVERISRRNKKLIKELKEIVDRGDRDKREIREELKRISKEMRDLARKLVKELKDVNRELDEDIREIDREIEEVLRELAKKLGKEELLRKIARDLEKVREEIKELVKENRKTNEEVVRRIEKLAKENDDENRKVLKEIED

SEQ ID NO: 6437 - protein, 176 aa, Artificial Sequence; identical to SEQ ID NO: 6436
  Synthetic

SEQ ID NO: 6438 - protein, 176 aa, Artificial Sequence
  Synthetic
DEVERIVEDIRRLLDEVRREVEKVSRENKELVDRVREKVKEISKRNKKLAKDLTDLVREGSRDKRELERDLERINEEMRKLIRDLERELREIDKRMDDLVREIEEKLRRIIEKLERELGDKELLDRIKEEIERVIKEIRELVEENKRTNEEVLRRIRELARRNEEENKRVLEDIRR

SEQ ID NO: 6439 - protein, 176 aa, Artificial Sequence; identical to SEQ ID NO: 6438
  Synthetic

SEQ ID NO: 6440 - protein, 183 aa, Artificial Sequence
  Synthetic
SVEELIKEVKDRLRKVLREIEELIRENEEENRKNVEDVKRTADKLRRDLEKVVDEIDKRVDSDKLERLRKKAEEIIRTLDRMLEESKKINREIDERLKRAADRLRRRVEKVIREVDRVAREVKEKEVIDKVVKRVEDLVREIKEEVDKISEENKELVKRDTRRVEEVRERIRKLVEELRREVT

SEQ ID NO: 6441 - protein, 183 aa, Artificial Sequence; identical to SEQ ID NO: 6440
  Synthetic

SEQ ID NO: 6442 - protein, 175 aa, Artificial Sequence
  Synthetic
SEIDRVIEKSDKTNEEIKRDVDRAVRRSEETLKRIRETVEEIVKTVEKLIRDLRRRVEDKGQDKEIEEIVKKIKKDIDDAKEELRKLAEEDKERVKAVKKKVEDLVREDKEEIDRRLTDKDKAKELRDRLERSLREIAKKIKKVLDDTDRVLRDIERTIEELKKRLREVLERVRK

SEQ ID NO: 6443 - protein, 175 aa, Artificial Sequence; identical to SEQ ID NO: 6442
  Synthetic

SEQ ID NO: 6444 - protein, 175 aa, Artificial Sequence
  Synthetic
SEIDDVIKKLKDLIEELEREVKEMSDENKRLLEEIEERVKEAIKRSKDTLEEIADRVRKKGPDKEIEELIREDKKRIKDVLKELRELVARTKKRVDDVTKKLREEARKIEEEIRRRLSDKDKATKIEKDLRDVLRKIEKTMEDNRRENEELLKKVEEEVRRLEEETEKVLRDLRR

SEQ ID NO: 6445 - protein, 175 aa, Artificial Sequence; identical to SEQ ID NO: 6444
  Synthetic

SEQ ID NO: 6446 - protein, 179 aa, Artificial Sequence
  Synthetic
SEVDEILKRIEELIRRIEDEVEKMIRESEDTIRRDEKEVKDAVRELADLIRRIEKRVRERKDSREEVEKLITDIADALRRFLERNEKSVTDDLDKNRRLLEKVERLIERIERVIREARKRNIDEKKVREIDKRLKDALREIRKLIERSKEESRRALKRSRELMKRLEEELRRVLKEIRD

SEQ ID NO: 6447 - protein, 179 aa, Artificial Sequence; identical to SEQ ID NO: 6446
  Synthetic

SEQ ID NO: 6448 - protein, 179 aa, Artificial Sequence
  Synthetic
DEVDKVLKRIKELIDEDKKEVEKVIRDSKRTLREDEERVRRAAKEVEDRIRDIEDIVRRRKEAREDVEKLVDDLRKKIKRLLDENEKSFKDDERKNEEVVRRNEKSITDIKRVIKEAEDRNLDKKKLEDIDRELDRVLEESKKEIEKSKRESEEVLKKSRDLVKRLAEELKRVLDEIRR

SEQ ID NO: 6449 - protein, 179 aa, Artificial Sequence; identical to SEQ ID NO: 6448
  Synthetic

SEQ ID NO: 6450 - protein, 179 aa, Artificial Sequence
  Synthetic
SRVEEVLKEIDKLIKEIKERVKRLIEESKRLNREDEERVRKVIEESKKTLEEIREVMERNKESREELEKLIEDDKEKNRKAKKDNDDSLRDDKRKNDEVEKEVRKRAKDIERAIKEIAKRNVDKDLLREIERRLREMLKEIEERIRRSKREVEESAERSERLIRKSEEDSERVLRELRR

SEQ ID NO: 6451 - protein, 179 aa, Artificial Sequence; identical to SEQ ID NO: 6450
  Synthetic

SEQ ID NO: 6452 - protein, 179 aa, Artificial Sequence
  Synthetic
DEVERILERIEELLRKIRKDVEEAIKDSERLNKDDLKRVRDAVETLRELIRRIEEEVRRRRESREEVEKLIREIEERLRRLLEENEKSVREDKERNRKLLKEVEELVKTVKDLIEEAKKRNIDKDLARDIDEKVRRLLEDIRRLVEESEKKVDESTEESRRLVTELERELREVLKRIRD

SEQ ID NO: 6453 - protein, 179 aa, Artificial Sequence; identical to SEQ ID NO: 6452
  Synthetic

SEQ ID NO: 6454 - protein, 178 aa, Artificial Sequence
  Synthetic
SRVDELVKEAEDLLEEAKKANAESIRRIEELLKRVAEEIRRLSEEDKKLVEEVRKRVKDKDAIDEVRERSRESLDRIRRIIDEIRRRAEKLLREDEELIRRLAEELRKLLEKLKRELRDKRAEDKLRRVEEDARRVLEDLKRTLKRLEEEVRRVLEEARDILRKNAEENRKVLEDLRR

SEQ ID NO: 6455 - protein, 178 aa, Artificial Sequence; identical to SEQ ID NO: 6454
  Synthetic

SEQ ID NO: 6456 - protein, 178 aa, Artificial Sequence
  Synthetic
SRVEELVEELKRLLRTVEKENEDSIREIERLLREVKRRNEESSREDEKTIRTVRREVRGEELIEEVRDRSRKSLDDDRKLIEDIKRRLEKLLREDEELIKEIRDRARRILEKIKRELREKRAEEILERLRKEAEEVLKKLEDTLRELRKRAEKVLRDMEETLKKNKKDNEKVLRDLRK

SEQ ID NO: 6457 - protein, 178 aa, Artificial Sequence; identical to SEQ ID NO: 6456
  Synthetic

SEQ ID NO: 6458 - protein, 178 aa, Artificial Sequence
  Synthetic
SEVDKIIKEIEDLLDEARKTNEKSSRDDKRLVEEVKELNKESSERNKRLVKEAREKIRGDEMIEKVRRDSEELLKDDRRLIEEVKRRSEKTLKEDKELIEDLARKLKKLLDDLRKDLKDKRAEDKIRRIAKDAEDVLRTMEKTLRDNERENREVLKELEKTLRENEKENEKVLRDLKR

SEQ ID NO: 6459 - protein, 178 aa, Artificial Sequence; identical to SEQ ID NO: 6458
  Synthetic

SEQ ID NO: 6460 - protein, 172 aa, Artificial Sequence
  Synthetic
EEIERVEEKVRRLIKELEDELRKIEERIERLLRRSRERNKEISDRNRRLLEEMRRSDRDKDVLRKRLEDIDRELRKLLKDDEDLMREIKRELRELLERLRKVAEDIRDEIRKDLSSEEKARELEEELRRAVERVDRKIEELEERLDRVLKESRDTVDENEKRNEKVLRELET

SEQ ID NO: 6461 - protein, 172 aa, Artificial Sequence; identical to SEQ ID NO: 6460
  Synthetic

SEQ ID NO: 6462 - protein, 172 aa, Artificial Sequence
  Synthetic
KEIEDVVETVRRLLRTSEELNERISRDNEKLLRDSEKLNREISERNRKLLKDLKDSDRDKRVLEEEARRIDEILRELLRRDEELAKRVNDRLKDLLRKDEELNRRVLDRIRKDLSMEEAARDLARKLKEVHDRSRETIKRNEDKNRRVLEESKKTARENEERNKRVLDELRK

SEQ ID NO: 6463 - protein, 172 aa, Artificial Sequence; identical to SEQ ID NO: 6462
  Synthetic

SEQ ID NO: 6464 - protein, 177 aa, Artificial Sequence
  Synthetic
SEEDRVLEDVERLLRELKKETDRIAEKNKKLNEDVTRETEEIVRRVRELLERLLDLVRKVRDDRLRKELEERLKEVVDRVRELSKTTKRKLDEITKDTRRASRETEERLKKIVDEARKRIDSEKAREVEREVRRIREEDERILRELEERNRENKKRDEDILKELEDRAERVLEEIKR

SEQ ID NO: 6465 - protein, 177 aa, Artificial Sequence; identical to SEQ ID NO: 6464
  Synthetic

SEQ ID NO: 6466 - protein, 177 aa, Artificial Sequence
  Synthetic
SEEDRVLKEAKDLLEEIERELDEVAERNKELNKRLTDETRKIERRVRELLRELKDKVRKVKEDRMRERLEEELEKIVRELEEASKETEKKLEEITRETRELIKRLEDKLRKVEKELREKIDSRKLEKLEKEVREVEKRIRDILKKLEDDNRANRKRDEDIIDELRKEADRVREEIKR

SEQ ID NO: 6467 - protein, 177 aa, Artificial Sequence; identical to SEQ ID NO: 6466
  Synthetic

SEQ ID NO: 6468 - protein, 175 aa, Artificial Sequence
  Synthetic
SEVEELVRRVEKSNRDIEEMVKKIDKRNRDLLRKIEKDLREADRRNEELLREIDDLVRRGTDKRDLERLIRRVTRELEDMVEKLERLIEEVSKELEDAARELEERIRDSLRRVKEAGIDEKLLKEVEDRNRESAKEVKRLADENRKANEELKRRVEKLVRDNRRKNEELKKKVKD

SEQ ID NO: 6469 - protein, 175 aa, Artificial Sequence; identical to SEQ ID NO: 6468
  Synthetic

SEQ ID NO: 6470 - protein, 175 aa, Artificial Sequence
  Synthetic
REVEELLKEIRKRIEDVRRRVEEIDRRNRKLLKEVEERLEKVRREVEKSNTDIKELAERGTDKRELAKEIKKSRERVERLVRELRRRLKRISDELEKVARDLKRKLEEILDRAEKAGIDEDLLRRVREEIERVIREVKRLLEENKKRNDEVRKRVEDIVRRLEEHHRELKRRVEK

SEQ ID NO: 6471 - protein, 175 aa, Artificial Sequence; identical to SEQ ID NO: 6470
  Synthetic

SEQ ID NO: 6472 - protein, 172 aa, Artificial Sequence
  Synthetic
KDIEDILKESEKTNREILKRAEDASEENERINKRITDRVDRVRKEIERLLEELTRRDEDREELDRVLKKIEDDLKKAMEELRKLIKELDERLEKVLEELERLIRRDREEIERRLRVKKLVDELRRRVEETLKRLRKLIADNREKNKDNLRRIEEEVKKLEEEIKKIKDEMKR

SEQ ID NO: 6473 - protein, 172 aa, Artificial Sequence; identical to SEQ ID NO: 6472
  Synthetic

SEQ ID NO: 6474 - protein, 172 aa, Artificial Sequence
  Synthetic
KELEDIARESEKTNRDIKRRVDEVRKTIEDLLRRIDEEVKRAAEESKDTNRRIREEDRRKEEVEKLLRDDNKRIDDMLERLRKLLEEVERRLDKALKDLEKLIRDDKERIDRLLRSEDLMRKLKREVEETDKEIKDIIRRLKEEIEKIKRKIEEIIKKLKKENEDTRREADK

SEQ ID NO: 6475 - protein, 172 aa, Artificial Sequence; identical to SEQ ID NO: 6474
  Synthetic

SEQ ID NO: 6476 - protein, 172 aa, Artificial Sequence
  Synthetic
SDIDDILRESRKINKEINDTVTEMMKRSKKTNDEIREKVKEVREESEKTNEEIRREPRRKEEVRELIKRDKERIDKALRELRELIKKDEEEIKRALRDLERLIRENRERIKKLLKDEKLVKELEDELRKSEERARRIIERLKEELKKTRKEIEDIIRELRKKLEDTLRDVEK

SEQ ID NO: 6477 - protein, 172 aa, Artificial Sequence; identical to SEQ ID NO: 6476
  Synthetic

SEQ ID NO: 6478 - protein, 172 aa, Artificial Sequence
  Synthetic
SDIEKILRESKDINRRINERVDRVVERSKKTNEDILKKVKDAAEESKKTNDDIRKSPDSEEDVKRKLDDDNRKIRKAMEELKKLLEDDERDVRRALEELRKLIEDNADDIRRKLKVEELVRELRRLVEESLKRIEKIIKDLEELIKETKRRLEEIIERLEKKNEDTEREARK

SEQ ID NO: 6479 - protein, 172 aa, Artificial Sequence; identical to SEQ ID NO: 6478
  Synthetic

SEQ ID NO: 6480 - protein, 172 aa, Artificial Sequence
  Synthetic
DEIREIVKESKRINEEINRKVEEVVRRSEKTNEDIRDTVRRLVRESDETNRRIEESPQDREEVKKAIKDDERRIEEALEELRKLLKEDNDLIEKAARELEELIRRNKKRIEDLLKDEDLVRELRKEVKRSEDRIRKIIRDLDELNRRSKEDIKRKIDELRKRVEETKRRVTK

SEQ ID NO: 6481 - protein, 172 aa, Artificial Sequence; identical to SEQ ID NO: 6480
  Synthetic

SEQ ID NO: 6482 - protein, 172 aa, Artificial Sequence
  Synthetic
DDIEEILKDVKRLLDEILAKVKKASDDNKRILDEIERKVEEMVRRSEKTNEDIRRSDRRREEVRKLLDEDNRRIEEAFKELDELIKRLDKTLTDLMRDLERLIKEVKDEIDKKLKVEELVRELKKRVDEIKERARRLIEENRERNKEIKERAERIIERLRKINEDTKREAEK

SEQ ID NO: 6483 - protein, 172 aa, Artificial Sequence; identical to SEQ ID NO: 6482
  Synthetic

SEQ ID NO: 6484 - protein, 172 aa, Artificial Sequence
  Synthetic
DEIEDIVRRVKKLIRDLEERVKKLEEDSDRTNERIRREAEKASKRNKEILDKLRKSDRRKEEVREVIKTLDEELKRVAKKLRELLKKDNEEIDRAAEELKRIADEIKEAIDRLLKVEELVKELRKELEEVKEEIRKIIEELKRRNDKSRRDLERLIRDNEDKNRRLKKEAED

SEQ ID NO: 6485 - protein, 172 aa, Artificial Sequence; identical to SEQ ID NO: 6484
  Synthetic

SEQ ID NO: 6486 - protein, 172 aa, Artificial Sequence
  Synthetic
EEIERIIRESEKINKEINRTVKEVEKRSEETNRRIREELKRISKRNKEILDRLRKEPRDKEVVEREIRKLDEELKRALEELKRLLEDDNRKIEEAMRRLEKLIRENEDRIRRLLRDEKEVEKLKRKVEKSEEDIRRIIEKLREENKRSEEEVRRLITENEKRNRKLLEEAKK

SEQ ID NO: 6487 - protein, 172 aa, Artificial Sequence; identical to SEQ ID NO: 6486
  Synthetic

SEQ ID NO: 6488 - protein, 172 aa, Artificial Sequence
  Synthetic
SELEKIAEDSERINKEINERVKRISDENKRILEEIEKAVEEASRDNKRILDELRKSPRRREEVKRVIEELDKRLEDALRRLRELIKELDDRLRKALEDLRKLIEDNEREIRKLLKAEELVRELERRVDESRKRAEDLIRDNKKKNDEARRRVEELIRRNREENRRIAEEARK

SEQ ID NO: 6489 - protein, 172 aa, Artificial Sequence; identical to SEQ ID NO: 6488
  Synthetic

SEQ ID NO: 6490 - protein, 179 aa, Artificial Sequence
  Synthetic
SDAERIMRESEELNERINDVVRRVAEESKRLNDRINDVLREVSKRNKDLIKRIKEVVDRNPEKKEEIKRLIDKLDKVLEDVERRIRKLIEDDKRRIEEVKRRLERLIKEDKRKIDEARKEGVEERIIERLDRLTKKSLEELKRIIEDLKRRTKESEDRARELIKRNREENKRLLEEAEK

SEQ ID NO: 6491 - protein, 179 aa, Artificial Sequence; identical to SEQ ID NO: 6490
  Synthetic

SEQ ID NO: 6492 - protein, 179 aa, Artificial Sequence
  Synthetic
DEAERIREESEELNERINREVDKMIDEDRKLNEDIRRTVEEMVREIKELLDRIRKVLEENPEKKEEIEKLIRRVKEKIRKAKEDLERLLRELEDRNRKVKKKLEDLIREDEERIRRAEEAGVDKEIIKELRETTERSRKRLEELIRDSEEKNRRTEDELEKIIRELDERLRRLEEEARK

SEQ ID NO: 6493 - protein, 179 aa, Artificial Sequence; identical to SEQ ID NO: 6492
  Synthetic

SEQ ID NO: 6494 - protein, 179 aa, Artificial Sequence
  Synthetic
DEAEDIARKSRELNERILRRVKEMIDEDRDLNREIEKTLRRVSERNRELVEEIKREVERNREKREEVEKLIKRLDDELRRILEELTRRLRELEKKNEEVRREMEKLLKEDRDRIRRAEEAGVEERIIEELRRLTEDTKRRADKLIKDSEDENRKTLRRARELIEENRDRNRKLEEDVRR

SEQ ID NO: 6495 - protein, 179 aa, Artificial Sequence; identical to SEQ ID NO: 6494
  Synthetic

SEQ ID NO: 6496 - protein, 179 aa, Artificial Sequence
  Synthetic
DEVREIVKRSDDLNDTIREVLKRVADDSRRLNEEIRRKVTEASRENEELIKEIEDRARKNPEKKEDLRRLVRELDEKLKEVKRDLERLIEEDKRKIERVLEELRRLVEEDRKRIDEAREAGVDEEIIKRLRDRTKKTLDEVRKIIEDLKDESRKTSEELRELIKRNKEKNDELLERLER

SEQ ID NO: 6497 - protein, 179 aa, Artificial Sequence; identical to SEQ ID NO: 6496
  Synthetic

SEQ ID NO: 6498 - protein, 179 aa, Artificial Sequence
  Synthetic
SEAEKIERESRDLNRRIREVVERASEDNERLIREIRKRLEEVVRTIEKLIRDILERVRKNPEKKEEVKKLIDDIRREIDRIKKELEELVREADKRLEEVLERLERLLEEDKRRIDEARRAGVDEEIIKELKKITDKTRRELERLIDENRKRNEELLKRVEDIIRELKRRLEKLDEEVKR

SEQ ID NO: 6499 - protein, 179 aa, Artificial Sequence; identical to SEQ ID NO: 6498
  Synthetic

SEQ ID NO: 6500 - protein, 179 aa, Artificial Sequence
  Synthetic
SEVERIEKESRDLNREIKEEAKRASEDNRRLLEDIRRKLEKVSEENKDLLRKIEEEMRRNSEKKEELRRLVKELDDKLTEILKDLTRLVEELDELLKEVLKRLKDLLREDREEIDRARKEGVDEEIIKKLKRLTDETEKELEKLIRKNEKENRDLEREIRRLIKENRDRNRELKKRAED

SEQ ID NO: 6501 - protein, 179 aa, Artificial Sequence; identical to SEQ ID NO: 6500
  Synthetic

SEQ ID NO: 6502 - protein, 179 aa, Artificial Sequence
  Synthetic
SEVEKAVREIEELIKRIEDRLREMARRVEETNKTLLRDVERLSKENEELVREIKERVRENPEKKEEVEKLIRELDKKLKEAEEEVRRLATEDAEDIKRAMKEITDLIEELRERLKRIRERGLREELVRELERKIKTVLDRVEEIIRRLDKKTKDTVRRVRELIEDNKRKNKKILDEVRK

SEQ ID NO: 6503 - protein, 179 aa, Artificial Sequence; identical to SEQ ID NO: 6502
  Synthetic

SEQ ID NO: 6504 - protein, 179 aa, Artificial Sequence
  Synthetic
SEVERIVKESEELNEKITRDLEEAEKEVRKTNDEIRRVVEEMSRRNEKLIRDIDDEVRKRPEKKEDVDELIKRVDELLERALRELEKLIRDDRELIEEVSRRIEKLVRDDEEKIRRAKEAGVDDEIIKELEKKTRDNLDKVRKIIERLRRETDKTEKELRDIIRKNEDENRKLEEKVRR

SEQ ID NO: 6505 - protein, 179 aa, Artificial Sequence; identical to SEQ ID NO: 6504
  Synthetic

SEQ ID NO: 6506 - protein, 179 aa, Artificial Sequence
  Synthetic
SKVEKLAKEVEETNRRILDEVRRASEENKDLVRRIEETVKRAVEEIKRLIEKIDDVVTKNPEKKERVKELVEEIRERIKRILRELERLIEEADRRLEEVLRKLKKLIDDDRRKIDRVEEAGVDEEIIKELRKRSEDSEREARKLIRRNEEENEKLRKKLKEIIDRLREELEKVLDRVRK

SEQ ID NO: 6507 - protein, 179 aa, Artificial Sequence; identical to SEQ ID NO: 6506
  Synthetic

SEQ ID NO: 6508 - protein, 181 aa, Artificial Sequence
  Synthetic
SEVERAAEESKRLNKTIRDENREVLREIRDLIRRMKEENRRMVKRVDEVLKEIRELFRRDKIDKLVEELLRRVRDIIRRDHERVRRVLERIERLIRKDHERVRRVLKEDERLIRELEKKRTDEKVREILERLERESRKTAKELDESNREAEELLKRVADEAKKSNETLRERLERLAREAEK

SEQ ID NO: 6509 - protein, 181 aa, Artificial Sequence; identical to SEQ ID NO: 6508
  Synthetic

SEQ ID NO: 6510 - protein, 181 aa, Artificial Sequence
  Synthetic
SELEELIRKIEELIRRIEEENKEMVRRSRKLNEDLERRLDEVRRRVEKLIREIEELLKRDKIDELIKKLVRELEEVIKRIEEEIRKLLEEDKRLIDADHERVKKVVEDLDRELKRIADERRDERAKRLLDELKRLIKELEDKLRESNEELKRRSDDSARKAEKILRELKKKVDEMADRARK

SEQ ID NO: 6511 - protein, 181 aa, Artificial Sequence; identical to SEQ ID NO: 6510
  Synthetic

SEQ ID NO: 6512 - protein, 181 aa, Artificial Sequence
  Synthetic
DEAEKLAEDVRRVIKRIREDNKRLSDRNKELLEEVEKDNKKSEEDVKRVIEDIERRVRELRDDRGVDELIKRVLEELEKLSDDDRRRLKRMIEESRRSLEEDRERIERVTTELRELLERLKEKVSRELLDELRRRIEELRKRLEDSNRENEEELRKIADKVRKTNKRLNEEVEDMFRRAKT

SEQ ID NO: 6513 - protein, 181 aa, Artificial Sequence; identical to SEQ ID NO: 6512
  Synthetic

SEQ ID NO: 6514 - protein, 175 aa, Artificial Sequence
  Synthetic
DEARELLRDDERLNRELNDLDRDSSKKDEDLNRKLNEDDKESVERADTLLERIKREVRTEDVVREVRRRLREMLEENRKLTKKAKDDVKRSLDENRELTKKMEEDVRRTLRRIEKDGVDRELIRELEERNRDSVRKSRKSNEDNERTNRESIERSRRSNEELRRRAEELIKDLRR

SEQ ID NO: 6515 - protein, 175 aa, Artificial Sequence; identical to SEQ ID NO: 6514
  Synthetic

SEQ ID NO: 6516 - protein, 175 aa, Artificial Sequence
  Synthetic
SEVEELLERDKDLNRRVNELNEKTSREDEKLNDEINKRIDRLVERARELLERIRREVRTEDMVRKVLEELKRLLEELRRLIETADKEVEDSLRDDERLLKKIKEDAERTLKEARDRGLDERLIRELEERNRESVERVRRSLKENEDRNRESKKRLEDLLREVKRLMDKLEEDLRK

SEQ ID NO: 6517 - protein, 175 aa, Artificial Sequence; identical to SEQ ID NO: 6516
  Synthetic

SEQ ID NO: 6518 - protein, 175 aa, Artificial Sequence
  Synthetic
SEVEELLERDKRLNDEANRLNRELVERDKRLNEELNKELKRMADEIKRLLEEIRRKVRTEEVVEKVTRELRELLERLRRLLEEMSKEARKSLETDKKLLKELKRRAEETLREIRERGLDERLIEKLERENRESEKRARDSNKELEKRNRESEDRARRILKKLEDDVRRLKKELET

SEQ ID NO: 6519 - protein, 175 aa, Artificial Sequence; identical to SEQ ID NO: 6518
  Synthetic

SEQ ID NO: 6520 - protein, 174 aa, Artificial Sequence
  Synthetic
SELEKVRTDVERVIRELEKELKEIDEENKKVNKDVEEEVKRIEEENKEMNDRLDDLRRRGLDKKDLLREIEKAHRESRKKIEDIKKKIEDALRETEKKIKELEKKIRDVLREAEKRIKSKEMEEVREELERLLRRIKKILEELRDENRKSLERLEDVLRRLEKRNRDTLEEVKR

SEQ ID NO: 6521 - protein, 174 aa, Artificial Sequence; identical to SEQ ID NO: 6520
  Synthetic

SEQ ID NO: 6522 - protein, 174 aa, Artificial Sequence
  Synthetic
KETEDVERDVERVIREIDTKLKEIEKKNDKANKELEEKLKKIEEDNKRVNERLKRLREEGLDKRDLERELRDVLRRTRDLIRELEEELERIVRDTRRLAEEIERELKRIVEELDKKIKSEEMRRVREEAKRLLDKVKKILRDLERRNEEVLKKIKDIMRRLEKRNRDTLEEIRT

SEQ ID NO: 6523 - protein, 174 aa, Artificial Sequence; identical to SEQ ID NO: 6522
  Synthetic

SEQ ID NO: 6524 - protein, 174 aa, Artificial Sequence
  Synthetic
SEEEKVLEEVKRAIDELKKELEEVEERNKRVNDDIRRLTDEIRKENKTANDRLRKLLEEGLDKKDLLKEIKEILERTERLSEETREKLKDVLRKTEKLIKEIKDKIDEIKKRADEKIKSKKLEEVRKEVKRLKDEVEKILKDLRKRNKDLLEEDKRVLDRLRETNEKTLDDVRR

SEQ ID NO: 6525 - protein, 174 aa, Artificial Sequence; identical to SEQ ID NO: 6524
  Synthetic

SEQ ID NO: 6526 - protein, 178 aa, Artificial Sequence
  Synthetic
KEEEDITRRIDKILRDLREKLRDVNRRVEELSKRLHDKLEKVLKRIKDEAERLRKEIREKLRDERRVREIEREVREIVERVEEVVRRLKEENKEIEKENRRNSTRLKEEMDRVKEDIDRKRVTKELEDKVEKDARDVERHIRKDLTDVRRRHEDLDRKIKELLDRVRKAIRDVEEKIK

SEQ ID NO: 6527 - protein, 178 aa, Artificial Sequence; identical to SEQ ID NO: 6526
  Synthetic

SEQ ID NO: 6528 - protein, 178 aa, Artificial Sequence
  Synthetic
SKAEELLRRVEELLKRVKDKVDDIVRKIEKSNRDLERRDEEVLREVEETNRRLEEELRRRGSDEDKLRELKEESDRSKERLDDAIRKSRKLSEESERELREITKELRKELDKIREELDRDGADEEVLRRLEELIRRAERKLEKMLEDLTRLNKEWEDRTRKLLEDLRRINEEIKRKIK

SEQ ID NO: 6529 - protein, 178 aa, Artificial Sequence; identical to SEQ ID NO: 6528
  Synthetic

SEQ ID NO: 6530 - protein, 178 aa, Artificial Sequence
  Synthetic
SEKDELLRDVRRLLKEVEKELEEIRRRVTESNRELEKLVREVLEESKRSDDKLREDLERAGLEKERLDKLEEDLKRHNEKLKKAVEDLKRTSEDSRKKLEDLARDVKRLLEDVERKLRKDGADKDLLERLKELIKRLKDKLKEIADRLRRINEDIERKIREILEDSRRFNEEIKKKID

SEQ ID NO: 6531 - protein, 178 aa, Artificial Sequence; identical to SEQ ID NO: 6530
  Synthetic

SEQ ID NO: 6532 - protein, 184 aa, Artificial Sequence
  Synthetic
STLETLEDEVRKIVTDIERVIRESNKHLKKSIDDVERVIEEIERRAREIVKKVRDVISEDRSEDDVRDLKRELEELLKRLEELVRDLERKAEEDLDRLRKEYEKLKEDLERLLKELKDKADRDGTDEKLERILREIKRIVEDLKKKVEDSLKRYEEELERLKEDLRRLLKRIRDEVEELKKESD

SEQ ID NO: 6533 - protein, 184 aa, Artificial Sequence; identical to SEQ ID NO: 6532
  Synthetic

SEQ ID NO: 6534 - protein, 184 aa, Artificial Sequence
  Synthetic
DEEEKLRDEVEKIVKKIEKAIEDLRRHAEKSVTDIRKVLKELEDHIRESVKDAERFISEDRSEESVERLVRKLERNLDELRRRAEELKKRIDEDLERLKELVRRLKEELEKMLRDLREKVRRLGTSEKLEKILREIERIVEKLKEDLDRLLKRYEDELRRLKEELERILDTYRRLLEELERRLR

SEQ ID NO: 6535 - protein, 184 aa, Artificial Sequence; identical to SEQ ID NO: 6534
  Synthetic

SEQ ID NO: 6536 - protein, 184 aa, Artificial Sequence
  Synthetic
DTARELEREVKKIVDEIEDVIRRLRRHIEESVKRAEKVLREIEKHARESAKRIADVVSKDTSEETVEKLKEEIRRDFKRLEDEVRRLKKELEDNLERLREIVKELEDRLREALKKLREKVRRDGTTEELKEILERIEEIVKRLEEELRRLLEEYKKRIEELAKRIKEVLDEYRKILKRLEDETK

SEQ ID NO: 6537 - protein, 184 aa, Artificial Sequence; identical to SEQ ID NO: 6536
  Synthetic

SEQ ID NO: 6538 - protein, 176 aa, Artificial Sequence
  Synthetic
DEAEELRKDVKRVLDEIKKRHEELLRKVREDLDRIRRKLEELAKRHRELLKEVKKIVDRDGTTEKLKRELDELNKETEKRLRDLKRELEELLRELKKRLKDSNDELKREVERLRRENLVDDKIRREIDELIKKLEEESRRIEEEIKKLVEDLKREADKIMEELERETDKLKKELDK

SEQ ID NO: 6539 - protein, 176 aa, Artificial Sequence; identical to SEQ ID NO: 6538
  Synthetic

SEQ ID NO: 6540 - protein, 172 aa, Artificial Sequence
  Synthetic
SEKEKILEEIREVLKRILDRLKKELEDDKKSLDDNKRRTEEALREDKKSLEEIRRANVREDEVKKLLEDNKRRNEEVRKRSEDDLKKNKERNERLAEELKKEVDKLREDIERANLDDKILRDLEKALDKLRRDIEEILKRSRDLNKKLEDDNREALRRSEELNRELEERERK

SEQ ID NO: 6541 - protein, 172 aa, Artificial Sequence; identical to SEQ ID NO: 6540
  Synthetic

SEQ ID NO: 6542 - protein, 172 aa, Artificial Sequence
  Synthetic
SEEERIRREIKKILDDIKEEAERRLEEDKKSLDENRKKTEEVLKKIRDDLKRIEEAKIPREEIKDELDRLRREIEKIARESEKDLRRNKEENKRLAEDLKRKLDKLKEDLDRANLDDEILRRIEKLIEDLKRTIDKILEDSERLNRKLEKENREALKELRDLLRELEERLKK

SEQ ID NO: 6543 - protein, 172 aa, Artificial Sequence; identical to SEQ ID NO: 6542
  Synthetic

SEQ ID NO: 6544 - protein, 172 aa, Artificial Sequence
  Synthetic
EELERILRKITEMLREIARKLKKLLEDDKESLDRNKEKTEDDLRRDKESLDRLRKSNIPEEEVRKRLKENKDRLRKRSKESKEDLERNEDENDKAAKDLKRLLDELREEIERRNLDDKILRDLEELLKDLERKIRRILDESRKLNDELRKENKKAEDTSRRLNEELEERLRT

SEQ ID NO: 6545 - protein, 172 aa, Artificial Sequence; identical to SEQ ID NO: 6544
  Synthetic

SEQ ID NO: 6546 - protein, 172 aa, Artificial Sequence
  Synthetic
SELEEILKRVEDVLRDILRKLKEVLDRAEKVIRDNKRKTKKMLDDDKRSLDEIRKAKIPRDEIKDVLRRNKDRNRKLAEESDRDLERLREELERIAKELEDLADELRKEIEKANLDDKILRELEKRLEDLRKRIKDILDDLKRKLEELKRENEKFLRRSKKLNEDLERELET

SEQ ID NO: 6547 - protein, 172 aa, Artificial Sequence; identical to SEQ ID NO: 6546
  Synthetic

SEQ ID NO: 6548 - protein, 172 aa, Artificial Sequence
  Synthetic
DELEEIRDRIKRKLEKLKEETKRTLEEDRKSLDDNRRKTEEALRRDRESLERIERAKIPSDKIREVLERNKTELRKIFERSREDLRRNKERLKKANEDAKKKIEDLREEIKKNNLDRDILEELTRLLDKLRRDHERVSEESKRRNDELEEENRRVLKESEDRNRELEERLRQ

SEQ ID NO: 6549 - protein, 172 aa, Artificial Sequence; identical to SEQ ID NO: 6548
  Synthetic

SEQ ID NO: 6550 - protein, 175 aa, Artificial Sequence
  Synthetic
SELEKLLDDVKKDLKRIEEHLRRDEEDSKRRIEELERHLERDKKEVEKAIRELDKKPRDDDLKRELEEILDRNKKNLDELRRELEKIDRDNKKNLDELKRELEEIEKKIREIVKRDKVDEKVVRTIEKLLTDLERKIREIEKRSKELLTRLEEKIKKAERESRKLLRELTERIDR

SEQ ID NO: 6551 - protein, 175 aa, Artificial Sequence; identical to SEQ ID NO: 6550
  Synthetic

SEQ ID NO: 6552 - protein, 174 aa, Artificial Sequence
  Synthetic
DELKKLLDDVREVSKRLNDELRKIMEEIRKVSEDLNKELDDIVRKIKKVIDDISEKIKRDGPREEVKEELKRLEEELRRLLKRLRDEHRRLRERLERLLKELEEKHEELADRVRKANVDEEIEKEIRELLKENRRRADEIRRRAEKSLKDNERRVEKVEREAERLLREIEKELK

SEQ ID NO: 6553 - protein, 174 aa, Artificial Sequence; identical to SEQ ID NO: 6552
  Synthetic

SEQ ID NO: 6554 - protein, 174 aa, Artificial Sequence
  Synthetic
SELEKLAEDVKRKLTEIREKIKKLLKETRDVSRELNKELEDLLRRTTEVIDEIRKKIEKEGPREEVRELLKKLEKDHRKASEEVERKHEDLRRRHDKASKEVEKELRDLKDEVDKANVDEDIKKEIEDLLRDLERLLRDVNREVEELLKENRKRLEEINRTVERLLEEIEKRLR

SEQ ID NO: 6555 - protein, 174 aa, Artificial Sequence; identical to SEQ ID NO: 6554
  Synthetic

SEQ ID NO: 6556 - protein, 174 aa, Artificial Sequence
  Synthetic
SELEELVRRLREVSKRLNEELDRILDRTRRLAERISEDIKRLADETKEVIERIKEEIKKKGPDERVKRKLEELKRRHDEASKTVRKKIEDLLKEHRDLSKELEDKHRDLEDKLRKANVDEEIEKEARELLRDNRRRIEEINREVEELIRRLEKLLKEVNETVKRLLEEIRKDLD

SEQ ID NO: 6557 - protein, 174 aa, Artificial Sequence; identical to SEQ ID NO: 6556
  Synthetic

SEQ ID NO: 6558 - protein, 174 aa, Artificial Sequence
  Synthetic
SELEKLMKDVKEVIDEIRKKLRKILEDTTRVAKRNEEKLKRIADEAEKVIREIRDEIEKKGPRDEVERRLRRLETELRRLLDESRKENERLRREHEKLSKELRDLLDDLRRRVEEANVDEEIKKRIDDLLRRIEKEIEEINRRVEELHKRLEDLHKEIEDKVRELLTRIEERLK

SEQ ID NO: 6559 - protein, 174 aa, Artificial Sequence; identical to SEQ ID NO: 6558
  Synthetic

SEQ ID NO: 6560 - protein, 171 aa, Artificial Sequence
  Synthetic
SEVEEILERIERLIRDDNRKLKDVERRNRENIKEDNERLKRMMEELKKIADEIRKADVDKDTLEKLLRDLRRKVEKIKRDNERHNDEDRKTLKRIHEDNKRILEEIKDRIDKAPVDDSIRRTVEKLLEDNRRRNEEILKESEDLLRKNREKTKEIVERAERLLDKLRRERK

SEQ ID NO: 6561 - protein, 171 aa, Artificial Sequence; identical to SEQ ID NO: 6560
  Synthetic

SEQ ID NO: 6562 - protein, 174 aa, Artificial Sequence
  Synthetic
DEAEELKERIERLSRRIDEEYRRLLEDYERLLRELEKKIEDLKRELEKLVEELRREGTDEKLDRRLEEMLRELERELRELVERLRRDLEEIRKHIKRSRDRHERANRELERELKETGVTEELKEKVKEIVKRSEEDIRRLKKHLDESIRTAEEVIRRLREKIKRIIDTVRDAKR

SEQ ID NO: 6563 - protein, 174 aa, Artificial Sequence; identical to SEQ ID NO: 6562
  Synthetic

SEQ ID NO: 6564 - protein, 174 aa, Artificial Sequence
  Synthetic
SELEELEKRIRRLSEEIKKLLDDLRREYEELVKELRRRLEELRKEIERLSEELKAEGRREELDRELRKLEKELEDKLRELKKRLDEDKERVEKMIRDLEERHRRANKELEDELRRDGVTDEMREKVDEIVKRSRDVIKELREHIEESIRRAEKVLRDLEREVRKIIEDARERTR

SEQ ID NO: 6565 - protein, 174 aa, Artificial Sequence; identical to SEQ ID NO: 6564
  Synthetic

SEQ ID NO: 6566 - protein, 174 aa, Artificial Sequence
  Synthetic
REVDELRKEIERLSRKIEDDLKKLEDRYEELLEKLERDLEKLKEDYDRLLRKLEEDGDDEKLKRELDKDREKIERDLEDLKRKLRTDEKEVRDRVKELRDRHREMNERLKTRLRRDGVTEKAEEDVRRTVTESKKVIDELREHIKKSIREVEEAIKRLREHVERSIRRAEEATK

SEQ ID NO: 6567 - protein, 174 aa, Artificial Sequence; identical to SEQ ID NO: 6566
  Synthetic

SEQ ID NO: 6568 - protein, 177 aa, Artificial Sequence
  Synthetic
SEEEKLDEDLERLREEIRELHRELEELIKKLREEVRRIIEKVRTHLKRDRDRAKEVIEKVRGEKDLTKVDEENERNTRDLERKLEEVKKEIKKLADDLKRRNEEIKKELKRKAEELKKRIKDERMREKLEKIKKDVDKLSKELHDKLDKVLKEIEELLRDVKRAIKKVNDDIKERLR

SEQ ID NO: 6569 - protein, 177 aa, Artificial Sequence; identical to SEQ ID NO: 6568
  Synthetic

SEQ ID NO: 6570 - protein, 182 aa, Artificial Sequence
  Synthetic
DEIRELVRRFEELVRRNVEHLKKLLRDAEKLVKENEKHLEDLLREIEETVKRLLDKIRREGPTEELKREAEKKAKELEERLKKNKEDHEERDKRIRDALKRNEDEHRKRSERLKEELDRDIKDKDKARDVEKRIEDLNREIKEIIRRVEERLKELNKRIEKLLEEVRDTLRRLKEELDRAMT

SEQ ID NO: 6571 - protein, 182 aa, Artificial Sequence; identical to SEQ ID NO: 6570
  Synthetic

SEQ ID NO: 6572 - protein, 182 aa, Artificial Sequence
  Synthetic
SEIEELLKEVERRVRENKKHLKRLLEDIKRLVERNAEDLERILRDAERIVRELIKKIRRDGTDKKLRDEAKEASDRIREKLEENERRHREESERLKEKLERNKRTHDDEDRRVRRRLERDIKDKDKLRRIEKALEDLNREIEEILRRVKEEIERLNREIEELLKRVEEELKRLEKELEEELK

SEQ ID NO: 6573 - protein, 182 aa, Artificial Sequence; identical to SEQ ID NO: 6572
  Synthetic

SEQ ID NO: 6574 - protein, 182 aa, Artificial Sequence
  Synthetic
SEIEELLKEVRKRVKENAEDLKRLLDEAKKLADDNVKHIEDLIREVEDIIRRLKERIKRTGNTEELRKEIKDKADEVREKLERNKRRHDELDKRLKDELRRNKKEHEEESKEIEDRLRRDIKDKDKARRLREELRKLNEDIERLLKRVEDELRKLNKKIKDILEEVEEVLERLLRELREEER

SEQ ID NO: 6575 - protein, 182 aa, Artificial Sequence; identical to SEQ ID NO: 6574
  Synthetic

SEQ ID NO: 6576 - protein, 187 aa, Artificial Sequence
  Synthetic
REKEELKKELKKLIEELKRSHDELKEELKRLLKRIEDILRENRKTTEDLSRELKKLLEELRKKVSEEELKRLRDELERLKKEDEEMNRRIEEKLRRLSKRVKDYLDTSRKRLEDLVRRVDEAASQDRRREELKRLLEELRRMIKELKDRNRKALEELEKVIREIEEEIKDINRRLREEIRRLEEEAR

SEQ ID NO: 6577 - protein, 187 aa, Artificial Sequence; identical to SEQ ID NO: 6576
  Synthetic

SEQ ID NO: 6578 - protein, 187 aa, Artificial Sequence
  Synthetic
SKEEELRETLKRLVDEIRRMLEEDRRSDEELVRRIERVLEEDKREDDRLHKRLRDELRRLRKDVDEKTLKEIEEKIRELNKRNEDSLKKIEDDLRRLNEENRKSLEELEKKLEKLARDAEEVLKRDKREDELRRLLRELEEMAKKLEKELRDNNRDLRRVAEELKELIDDNTRKLKEVIEKLEREIK

SEQ ID NO: 6579 - protein, 187 aa, Artificial Sequence; identical to SEQ ID NO: 6578
  Synthetic

SEQ ID NO: 6580 - protein, 187 aa, Artificial Sequence
  Synthetic
SEKETVRDELRKLVETIRKLLEEDKESDKRLADRIRELNEENKEDTERLIRELEKVLEELRKKVSEDELRKLRKRIEDLRRRDEELNKRSREKLEDLNERNKDSLRRIEDELRKLVEEAREVEKRDNDEERLRKLLERLERVIRDLLRKIEENNKRLRKAIKELLDELRKINKELREVIKKLLDDAR

SEQ ID NO: 6581 - protein, 187 aa, Artificial Sequence; identical to SEQ ID NO: 6580
  Synthetic

SEQ ID NO: 6582 - protein, 187 aa, Artificial Sequence
  Synthetic
SEKERLKEELEKLSKEIEDILRDDKRSDDELRRRLRELLEKDRREDERLNEELKRMLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 6583 - protein, 187 aa, Artificial Sequence; identical to SEQ ID NO: 6582
  Synthetic

SEQ ID NO: 6584 - protein, 187 aa, Artificial Sequence
  Synthetic
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 6585 - protein, 187 aa, Artificial Sequence; identical to SEQ ID NO: 6584
  Synthetic

SEQ ID NO: 6586 - protein, 181 aa, Artificial Sequence
  Synthetic
EKSERLRERLRDLLRKHKELLDRNEKTLEEAERRVEKLLEDNERELKKIEDEVRELLKRLEDDETLRRLLEEAKEVLERIRRKNKKLREDLKRVLERIKEENDRHHEKVKEDLKRIEDRIRKDGVTKEILREIEERFKRLAEDLKRSNDKVRELVDKAEKDIRKSNEELRKLARDVRERVR

SEQ ID NO: 6587 - protein, 181 aa, Artificial Sequence; identical to SEQ ID NO: 6586
  Synthetic

SEQ ID NO: 6588 - protein, 181 aa, Artificial Sequence
  Synthetic
SDEDRLRELLRKLREDHERIVRELRKRLEEVLREIERLLKKNEEDLERIRREVEELLKRISDDEELRRLEKRAEEALRKIREENKKLRKEVRDTLRDILRRIEEHHREVDERLRRIEDRIRKEGATEDIEREIRDTLRRLREDLERIKEDVERLRREIKKRIEDSNRKVRDLLRRVKEAVR

SEQ ID NO: 6589 - protein, 181 aa, Artificial Sequence; identical to SEQ ID NO: 6588
  Synthetic

SEQ ID NO: 6590 - protein, 181 aa, Artificial Sequence
  Synthetic
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGADEKILREVEDLLRKVAEDLKRSNDEVKELAERLEETIRDLLRRIEEILKEIEERVR

SEQ ID NO: 6591 - protein, 181 aa, Artificial Sequence; identical to SEQ ID NO: 6590
  Synthetic

SEQ ID NO: 6592 - protein, 181 aa, Artificial Sequence
  Synthetic
KDEERLKRFLEDIRRRHRELLERNERALDEIRRRHEELLRRNEEAIKDIERRVRELLKRLEDDDTLRKLEKKVRDDARRSRKRNEEHHREVKEELDRSRKRNEDHHREAEREMRRIEEKIKKDGATEEILKEIEELLRRLEENLRRNHKEVRELLEKVRRNIEENHREVRRLLEEVERRAR

SEQ ID NO: 6593 - protein, 181 aa, Artificial Sequence; identical to SEQ ID NO: 6592
  Synthetic

SEQ ID NO: 6594 - protein, 181 aa, Artificial Sequence
  Synthetic
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRKDGATDEILRKIEELLRRAEEVIRDLERKVRKLERDIRENIKKNHREVREILRKIEEDVR

SEQ ID NO: 6595 - protein, 181 aa, Artificial Sequence; identical to SEQ ID NO: 6594
  Synthetic

SEQ ID NO: 6596 - protein, 175 aa, Artificial Sequence
  Synthetic
KDEERLRELIKRINTEVKKSLDENKERLDKVEEDIRRSLKENEDRMERVRREVEKANVDEKVKKEAEDALRELKRKHDELRKEVEKLVKELEDKHKELEERHREASKDVERVLDKEIDKIEEIKKRLEDILEETRDMSRRLNEELRRILERVKEVSKELNRELEEILKRVEDARR

SEQ ID NO: 6597 - protein, 175 aa, Artificial Sequence; identical to SEQ ID NO: 6596
  Synthetic

SEQ ID NO: 6598 - protein, 175 aa, Artificial Sequence
  Synthetic
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 6599 - protein, 175 aa, Artificial Sequence; identical to SEQ ID NO: 6598
  Synthetic

SEQ ID NO: 6600 - protein, 175 aa, Artificial Sequence
  Synthetic
KDEERLDEELKRVNDEVRRLLARNEETLERIEREVKRLLDENEKRAEDIRKEVEDSNVDERVKTEAKKALDELRERHRELKKELEKLAEELRRKHEELEKRHRDKSRRIKEMLDKETDKIEEIEKTIREELKETRKVSEELNRELERILRELRKVSEELNKDLEKILRRVKKERK

SEQ ID NO: 6601 - protein, 175 aa, Artificial Sequence; identical to SEQ ID NO: 6600
  Synthetic

SEQ ID NO: 6602 - protein, 175 aa, Artificial Sequence
  Synthetic
SEEERLREILKDINRRVEELLKENEERMERIREELEELLERLKEELERIRKRVEEENVDEEVKRRFDEVAEEIKRRLEELKKEAEDKLRRLREEHKKLKEEHERASERIEEVLDKESDKVEEIEKDIRRLLRETERVSEELNKKLEEIARELREMIKEIKERLKRILEEVEKRRR

SEQ ID NO: 6603 - protein, 175 aa, Artificial Sequence; identical to SEQ ID NO: 6602
  Synthetic

SEQ ID NO: 6604 - protein, 175 aa, Artificial Sequence
  Synthetic
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 6605 - protein, 175 aa, Artificial Sequence; identical to SEQ ID NO: 6604
  Synthetic

SEQ ID NO: 6606 - protein, 182 aa, Artificial Sequence
  Synthetic
REIEKLIRDYRRILRELSEKIRRLAEEHEDIVRKLIETLKRLIDEIRKIMEDLSRLLRRDGSTEELRKRARKSLEDLRRKIREIKKRLEEEHKKTRKKVKELEDEAREKTKELEKRLKDANVPKKLMDELRRVSEEVNTRLEKLLRDLEKKLRDSEERAKELIRRIEKTLEDIDRRLKEEEK

SEQ ID NO: 6607 - protein, 182 aa, Artificial Sequence; identical to SEQ ID NO: 6606
  Synthetic

SEQ ID NO: 6608 - protein, 184 aa, Artificial Sequence
  Synthetic
RELEKLMEDAERYAKRSMEAFEDLIRKHDELLKRLEKKLRDLIKRIEKLLREIKEKIERTGTTEDLEREVREIVKRIREFLERLDRDAKRIEKENRDVDERLKRENEKVSRRLREVLEELRKDVSEELLKRAKELIETIEERSKRVVDENKRVVERSRRRLKKLLEDIERVLERIERRLTEAKK

SEQ ID NO: 6609 - protein, 184 aa, Artificial Sequence; identical to SEQ ID NO: 6608
  Synthetic

SEQ ID NO: 6610 - protein, 184 aa, Artificial Sequence
  Synthetic
SELEKLLEDIERYVKRSKEKARELIKRHKEYVRRSEERLRRLIEKLEKLAEKLKELIRRTGTTEELEKELKDIAREVREVLKKIKEDNKRAEDKNREEDERLKRENEKMKEDVRKILADLKKDVDDSLLKEVEDLLRKVEEESRRVIEENKRVVEESRKRSERLLREIEKELRRVEKEFRDEKR

SEQ ID NO: 6611 - protein, 184 aa, Artificial Sequence; identical to SEQ ID NO: 6610
  Synthetic

SEQ ID NO: 6612 - protein, 184 aa, Artificial Sequence
  Synthetic
SELEDLMRDVKRYADESARRIEEIIKRHRKLVREISKKIEELIRELRKLIERILELIRRDGDTEELKKEVEKIREEVEEMLERIKREVDKVKDENRRLDEKVRRDNERKKRDLERLLRELRDKVDEELLDRARKLIREIEERSKELSKRNKEEVDRSEERIRRLLKRAEEELRRVREELKEASR

SEQ ID NO: 6613 - protein, 184 aa, Artificial Sequence; identical to SEQ ID NO: 6612
  Synthetic

SEQ ID NO: 6614 - protein, 181 aa, Artificial Sequence
  Synthetic
SREEEIRELLKRSKESLEKLLRELDKEHKESEKSARELLKRNEKRLREIREEIRRLNITEDLLKEIEDLLKRLEDKNRKVAKEYEDLLRESKRHLDELRKEYERLLKELEDKLEDLRRRRKSEEVMKRLLKEIRDVNKEITERLEEHRKRLEEINRDVERIIRELNEEHKEVLKRIREKAK

SEQ ID NO: 6615 - protein, 181 aa, Artificial Sequence; identical to SEQ ID NO: 6614
  Synthetic

SEQ ID NO: 6616 - protein, 182 aa, Artificial Sequence
  Synthetic
SEREELRKLLRRIEEEAKRLLEELKRTTDDTRRENEELLRRLEELSKETKKRVEDLLRELDRDKTVKDRLRTELERLERRDRELLERNKKHNKDLEDTDRDLIRKLKKLLDELKERAERVEKTGEDVKDVLKKLEDVLRELKKAVEKIKRDNKRAVDENRELVERIMKENKDAMKKLEEDVR

SEQ ID NO: 6617 - protein, 182 aa, Artificial Sequence; identical to SEQ ID NO: 6616
  Synthetic

SEQ ID NO: 6618 - protein, 182 aa, Artificial Sequence
  Synthetic
SEREELRDLLRRIKEDAERLLKEHRDLLEEVRKEVEKLLRELRKLSKETEDEAERLLRELRRDETVKEKLKRRLDELRKRDEDVERRLKEELDELRRRNKKIEDDLRKKLEDLEREMREVDRRGEDIKDVLKKLKEVLKKLRDDVEKSKRDTKRVLDRLRDTVRKIMEENRRALKEIADEVK

SEQ ID NO: 6619 - protein, 182 aa, Artificial Sequence; identical to SEQ ID NO: 6618
  Synthetic

SEQ ID NO: 6620 - protein, 182 aa, Artificial Sequence
  Synthetic
DDEERLREEVERVERTVRDLLRRLRELTKKTDEDNRKLLKEHEDLLREVVKRVTDLLKDLQRDEEVKRKLKEDLDRLREKNKEILERNKRHNDELRKKDEKLLRELEELLERLKKRIKEVEETGKDVKDVLKEIKEVLREVTERAKEIADDNRRALEENEREVKRSKEDTKRALRKLEEEVK

SEQ ID NO: 6621 - protein, 182 aa, Artificial Sequence; identical to SEQ ID NO: 6620
  Synthetic

SEQ ID NO: 6622 - protein, 181 aa, Artificial Sequence
  Synthetic
SSSEELEKLLEEVRRELRRLAEEVKRLNEEIDKDIDRLAEENDRLHKEVKKDLDRLNLPDESLRRIEEELRRNLERTREILEDLKRRLDESRKEAEKILDELRRTLEKLKRDIDDSDTKGNTEEVVKRILDEIRRTLEEIKEIARRYLEKNKKEMREIRETMKRDNDHLEDLLRKIRETAR

SEQ ID NO: 6623 - protein, 181 aa, Artificial Sequence; identical to SEQ ID NO: 6622
  Synthetic

SEQ ID NO: 6624 - protein, 174 aa, Artificial Sequence
  Synthetic
SDEERIRKKLREIEERHKKLSEELKELLRRSEESVRRLLEKNRKDLDEVRKRIEDLNLTEDILKKLREELDRHRRELERLAREYEKLLRELEREVREVNKRVEETMREIKRRLRETKVDEEVERRLDRLLDESRRLAEELKERIKRVNKRARELVRESEEHLRELLEKVERDAT

SEQ ID NO: 6625 - protein, 174 aa, Artificial Sequence; identical to SEQ ID NO: 6624
  Synthetic

SEQ ID NO: 6626 - protein, 178 aa, Artificial Sequence
  Synthetic
SDKDELKTRLDRVREIIERLARESEELHKELKKRLEDLKRDSERLHRKNLEDIRRSNLPREKLERLEESNRRNLRRSEDTLRKLEEEIRRNEERTKKLLDDLRRLVEELRDKIRRVGDEKEVTDRIREDIKRVIEEVRRLAEEDKESVKEILKKIEKLADEDRRSVEKNHKEVEDTRR

SEQ ID NO: 6627 - protein, 178 aa, Artificial Sequence; identical to SEQ ID NO: 6626
  Synthetic

SEQ ID NO: 6628 - protein, 175 aa, Artificial Sequence
  Synthetic
RDEERAEELLKEIKDTVDELKKEVEKVLDESRKRDKKLNDELRKLLEDSRRTIERDVREDDDLRKEVEEKNRETEKRLKEINDDNERLNKESEDKLRELKKEAEEKLKRIRKIIKDGDRGDKLLEELRKILEELRKKVKDLIEEHRRLVKTSADRVKRLLDEHRRILKELKDRRK

SEQ ID NO: 6629 - protein, 175 aa, Artificial Sequence; identical to SEQ ID NO: 6628
  Synthetic

SEQ ID NO: 6630 - protein, 182 aa, Artificial Sequence
  Synthetic
DEAEELIKRIEDLLRELARRMEEILRRHEEYVKKSAEDVKRLLEEVEKLADDLRREVERDGTTDELRKKVKKIADELRKVLEDLKRANKKVEDENRKLDDDIRKTVEKIEKDVRDALKDLNLPEEVARKIEEVLRRVKEELTKLVEENERKLRESRERSKKLAKEVEDLLREIKRRVEELER

SEQ ID NO: 6631 - protein, 182 aa, Artificial Sequence; identical to SEQ ID NO: 6630
  Synthetic

SEQ ID NO: 6632 - protein, 174 aa, Artificial Sequence
  Synthetic
SERETLEELLERVERLLEKLKRELDEAHKKNKEDLDRLRDKNRKRLEDIKRTIDRIDVREELKKEADRLLKELEELTREIVRRDEDLNRRLAEKVERLKREVERRLEEIRRRVDKDGVTEELLKELKEVLERIRKEVEKLLRTLEEINKTTRKLVEETNEKADRILEKVKRDAK

SEQ ID NO: 6633 - protein, 174 aa, Artificial Sequence; identical to SEQ ID NO: 6632
  Synthetic

SEQ ID NO: 6634 - protein, 174 aa, Artificial Sequence
  Synthetic
SEDEKMEELIKRSEDKLRKLEEDVRRLLEEIRRRAEDNTRRNERTLREIERTLREIPNDKELADRLRELLERLRRRNEELKRELDKLLRDLERKLEELKRRHKEKLDRLRDRVRKTGVTEELVRELEKIDRETTEVVKKLLEELKDIMRRVHERSEESLREAKKILREVEERAR

SEQ ID NO: 6635 - protein, 174 aa, Artificial Sequence; identical to SEQ ID NO: 6634
  Synthetic

SEQ ID NO: 6636 - protein, 179 aa, Artificial Sequence
  Synthetic
SEEEELDKLLKEVREKDERLKREVEELLRRIKKRLEELKRENDELLKEVREVLKKLAKETDVSDEIIKRIEELLRRLEKTSEELRKDVERKRKELEEEARRLHEESEELLKELRRILERGDLPVEDVLRRIEEVARRIERLYEELLKKLRDVVREIEKRVREHNEDVKRVVREIEKRIK

SEQ ID NO: 6637 - protein, 179 aa, Artificial Sequence; identical to SEQ ID NO: 6636
  Synthetic

SEQ ID NO: 6638 - protein, 178 aa, Artificial Sequence
  Synthetic
DEVEKVKEEIKRLNEDVRRLVEEYRKRLEKLNRDHRDYVKKSEKRIRDLIREVRRRPVTDEVVKRVEEELEKIERENREKSKEDEEKNKELEDELRRRKKESEDVLRELKDRVRKAGLDEDATREIDKALEDHRESVERLVRELERLNEENRKSVKKSEEDSRRLLEEVRRELRRKRK

SEQ ID NO: 6639 - protein, 178 aa, Artificial Sequence; identical to SEQ ID NO: 6638
  Synthetic

SEQ ID NO: 6640 - protein, 175 aa, Artificial Sequence
  Synthetic
DEEERVEELLRRDRESDKELRERLRKLNEENRDETEKLIRELEDSLRRLKEELEKKGKDIEELLRDVERYLRESRKRVEDLKREDEKLNKESEDKLDELNKRNEKSLRELREKLRRDGATKELEKELRDNNRRLEEVIRRLEEELKRISEELRKVIKKLKRDNEEKLRRLDEATR

SEQ ID NO: 6641 - protein, 175 aa, Artificial Sequence; identical to SEQ ID NO: 6640
  Synthetic

SEQ ID NO: 6642 - protein, 175 aa, Artificial Sequence
  Synthetic
DEEERVKDINRRNEEDSRRLERRIRELNRENRKSSKELADRVRELLKRAEERLRTEGKDKKELLEEAEDLLRKLTDDLRKLEEDDERMNRDIERKLRELKKEDKDRNDRTKEELERDGVTEELVKKLEDINRRLREAIKRLEDTIREINKELRKKIKELLDRLKEIVKRLEDRAR

SEQ ID NO: 6643 - protein, 175 aa, Artificial Sequence; identical to SEQ ID NO: 6642
  Synthetic

SEQ ID NO: 6644 - protein, 175 aa, Artificial Sequence
  Synthetic
SAEERIKRINKKNRDDSEKLKRRIEESNRENKRSSDELVKRLEELLRKLEEDLKRKGKDDEDLLREVKKRAEEIRERIKRLEDDDRRYNKKSKEDLDDLRREDERLNEETKRELDRDGVDKELEKKLRKINEDLKRAIRKLEEDNKRANEELKKRAEDLLREIEEIIRRLEERTR

SEQ ID NO: 6645 - protein, 175 aa, Artificial Sequence; identical to SEQ ID NO: 6644
  Synthetic

SEQ ID NO: 6646 - protein, 175 aa, Artificial Sequence
  Synthetic
DEERRAEEINRRNKKDSDRLAETIEKILKEDEDRDKELHDRLEEILKELRKRLEEEGKDIRELREEAERLIREIREEIKRLNEENKKSLERIRKKLEDLRRKDEKLNRETRRKLERDGVTEELVKELEKINEELRRDIKRLIDEIRENTERLERMIRELEKKIRKILKELDDRAK

SEQ ID NO: 6647 - protein, 175 aa, Artificial Sequence; identical to SEQ ID NO: 6646
  Synthetic

SEQ ID NO: 6648 - protein, 176 aa, Artificial Sequence
  Synthetic
DLEKELTDLMKKHAEENDRLRRRLEELLKRHAEENDRLRDRVRRINEEVEEILRRAPRSEELEKLKRDHERRVKEAEDRLRELHRLVEERVREIKDELRKLHEKVKKILEDLKDIKEEDVIREALERIKRISDESKRTIDEVVKEIEKITKESRDLITKYERDVERSIEEAERRAT

SEQ ID NO: 6649 - protein, 176 aa, Artificial Sequence; identical to SEQ ID NO: 6648
  Synthetic

SEQ ID NO: 6650 - protein, 184 aa, Artificial Sequence
  Synthetic
SLEERIRELLKRHEDLTRKLKKENDESLRRHRELTKKLRKELEELLKRAEDVLRDLEREGLREEDKEEIERRLKELREKAERLARKDEELLRRAEEKSERLRTEDERLLKELEDEARDLRRKGSDAREVDDLLRKIEDISKKSADRNRELNEELEDISRRSKEEMKKLLDELRRDVEEIKKRTK

SEQ ID NO: 6651 - protein, 184 aa, Artificial Sequence; identical to SEQ ID NO: 6650
  Synthetic

SEQ ID NO: 6652 - protein, 184 aa, Artificial Sequence
  Synthetic
DLEDRIRRLLEESKKNLDELKRRNEESLKRSEDLLKDLKRKLDDLLRKAEEVLRELRKRGLDEDLATKIKKELEDLKREIEELVERYKDLNREIKERSDKLVKEYEDLLKELTERAKDLTDKGSDARDVDRLLEDVKRISDTVHKRNEELNRRLREISERAREAVEDLLRRLEEIVRRIKTRTE

SEQ ID NO: 6653 - protein, 184 aa, Artificial Sequence; identical to SEQ ID NO: 6652
  Synthetic

SEQ ID NO: 6654 - protein, 174 aa, Artificial Sequence
  Synthetic
EEIERILEKLRRDLEEVRKKVKKVLDELRELTEELKRKVEKVLRELKRLSEEIARRVEKGLSEEELKRLDEEVEERVERIKRELEEDNRRVEEKVREVKERLDDEAREIEERIKKAPETRELRTVAREIREELKKLREELDKLLREHRETSKELEKRLKEVLDRHRELSDRLRR

SEQ ID NO: 6655 - protein, 174 aa, Artificial Sequence; identical to SEQ ID NO: 6654
  Synthetic

SEQ ID NO: 6656 - protein, 181 aa, Artificial Sequence
  Synthetic
DELREMIRKVREINERSKDEIRKILEAIKKIVEDHRRVVEKLLRDLKDIVRRARETRSRPTPEELIKTIEKLLEELKRELERLERENKRLLEEIKRRVKELEDRNRELDKELRKEVEKLRTSEEARKRLEDLSRENKRSLDELRKRIDDILDENRRAVEESRERAKRVLDEVRETLKRDEK

SEQ ID NO: 6657 - protein, 181 aa, Artificial Sequence; identical to SEQ ID NO: 6656
  Synthetic

SEQ ID NO: 6658 - protein, 183 aa, Artificial Sequence
  Synthetic
SEVDEVEKRIREAIKRHRDRVKKIIDEIKKLLDDHRRRVKKLEDDLKKRADDVRKETKDGDRDKRTLVERVREELERARREIEEDLKRSREELKKIEKKAREVHKKSRDDLERLREEIERKVKGKEARDRIRELLKKYEDDLRRSEKEIEDILRRYERELRESEKRMREVLKRLEDELRRAEK

SEQ ID NO: 6659 - protein, 183 aa, Artificial Sequence; identical to SEQ ID NO: 6658
  Synthetic

SEQ ID NO: 6660 - protein, 183 aa, Artificial Sequence
  Synthetic
DEVKEVEKKIRKVLREHKKLVEELIRKIKEMIDRHKEIVERIIRTIRRELKRAEELARKGDKDKKTLLEEIRRRLRELAERAKEKHDKSREDLKELKRDAERKLRESEKRLKELEDEARRKVRGEEMEKRIEDLLREYREELERSRRELERLLEEYEKVVDESRKRIKTILDEVEKLLRDLDR

SEQ ID NO: 6661 - protein, 183 aa, Artificial Sequence; identical to SEQ ID NO: 6660
  Synthetic

SEQ ID NO: 6662 - protein, 174 aa, Artificial Sequence
  Synthetic
SSRERFKELSDRNKEVVERSRRRLEKLLEENKREVEKSKKRIEDMLRKADDLLRKLPVSEELLRRAKEMLRRIKEEVDKVEEDNERVDRELRKEVKKIEDDNRREDKRLADEVRRDGVTERLSEEIKRLIETHEKLLRELEKKIRDLIRKHREDVERIIKEIDKLLKKIDEDTR

SEQ ID NO: 6663 - protein, 174 aa, Artificial Sequence; identical to SEQ ID NO: 6662
  Synthetic

SEQ ID NO: 6664 - protein, 171 aa, Artificial Sequence
  Synthetic
SEEETLDELNRENEELLRRSKERLDRSHEKLKKILDDISERVKELLKRAEKLLRDENVDEKLKKEFDRRLKELRDKLRRLEEEVKKYLEESKREVRKLEETNRRMDEETRRRRDDKDRVSDRIRRLLEEHERVVRELLESNDRMAERLRRVAEELVKEIKKELDDLRRRTT

SEQ ID NO: 6665 - protein, 171 aa, Artificial Sequence; identical to SEQ ID NO: 6664
  Synthetic

SEQ ID NO: 6666 - protein, 171 aa, Artificial Sequence
  Synthetic
SEEETLERLLRKNEEELKKSKERLKELNRTNRKELRDSERRIKRALEEVEDLIRREKVDEDLLRELKRLLEELRRLVEKLKEENERADEETRKKVKELEDRNRKANEDLRRRRDDKDEVTKTIERIIEEHRRMIEELIKEIRKLIKEHRDKVRELLKRIKDILRRLKEERR

SEQ ID NO: 6667 - protein, 171 aa, Artificial Sequence; identical to SEQ ID NO: 6666
  Synthetic

SEQ ID NO: 6668 - protein, 188 aa, Artificial Sequence
  Synthetic
SLDERIDELRRTLEEMLDRIRRSNEEVLRDSRRVLEEIDERARRVVEEAEKLLREIDKRKGKNEDAERLLREIKKRIEDLRRRIEKLKKEYEEEDDRLEKELRDLHREIDRLKRELETEADRLKKENVSEEDIKRLLEKVREIIEELKRRNDELNKRIKDLSEEMRRRVKKLLDEIKEDLERIKRRAD

SEQ ID NO: 6669 - protein, 188 aa, Artificial Sequence; identical to SEQ ID NO: 6668
  Synthetic

SEQ ID NO: 6670 - protein, 188 aa, Artificial Sequence
  Synthetic
SLEEEIKELIKRAEEVLERLARSNKEVLDRSRKVLKELRETNKRLLEELKRALDKIRKDKGDDEDLRRELTKIREKSERLRKKSKDLEDDYRRLDEELRKRIKELHDKIKRLLEELKEKADDLRRRNVSEEDIKRLLEEVERIIRKLAEENKKLNKEIEDLSRRARERNERLLREVEKIIRDIRERAR

SEQ ID NO: 6671 - protein, 188 aa, Artificial Sequence; identical to SEQ ID NO: 6670
  Synthetic

SEQ ID NO: 6672 - protein, 181 aa, Artificial Sequence
  Synthetic
SEVEELTKKAKKIIEDHRRYVEKSARDVERLIREHERYVEESAKKVEKLLREIKELDKRDLREEDRKRVDETIKRILDKLREENERAKEENKKMLDKLRRDNEKVERENRKLLDDLRREVKDIRDKDKIRELERENEEVIKESRERSERLARKNKKVLEDSERRSRELSERVERLLDESRR

SEQ ID NO: 6673 - protein, 181 aa, Artificial Sequence; identical to SEQ ID NO: 6672
  Synthetic

SEQ ID NO: 6674 - protein, 171 aa, Artificial Sequence
  Synthetic
REEDVLRKLEKEIRDLLERIKRKSEELIERNKRTNDDIRRRSKETIDELRELTKRVDIDDSVRRRVEKVEEELERENEKLSRDDKRSIEENKKKDDELARRVEKVIEDLRRANVPDEDIRREAERLLREMEKRAKENEEDVRRNLKRLRDALKEHKEKVEKLLEEIKKDAK

SEQ ID NO: 6675 - protein, 171 aa, Artificial Sequence; identical to SEQ ID NO: 6674
  Synthetic

SEQ ID NO: 6676 - protein, 175 aa, Artificial Sequence
  Synthetic
SETDDIIRRIRRLIEELLRNSKRTSDDNRRTLEELERNSERAIKKIKDVLEKLSRDRVPEDELKKRLDELREEIKEVEERHEELLERDRRKLEEVEKEHERRLEEIKRRIEKVLRDTSSDEKAEKIRKELEDMARESRKLMRENKREVDRVEKKSRKLLKDILDEIDKVDEDEKR

SEQ ID NO: 6677 - protein, 175 aa, Artificial Sequence; identical to SEQ ID NO: 6676
  Synthetic

SEQ ID NO: 6678 - protein, 176 aa, Artificial Sequence
  Synthetic
SEAERIAREVERVLREIEEEVKRLSEENRELVERIERESRKSIEDIERRLEEVKRKVKREELLKEVEKELRDLDRRHKEKHDEVERESRELLKRIEEVLDRARKELEELEKRAREENRLDRRLLEALRREVEEVLKRIRETLEENRRRNEEVLRRDKELLERIRDKIRRVLEELKR

SEQ ID NO: 6679 - protein, 176 aa, Artificial Sequence; identical to SEQ ID NO: 6678
  Synthetic

SEQ ID NO: 6680 - protein, 177 aa, Artificial Sequence
  Synthetic
DEERELRKLERELEDVVRKDRKILEDLRRTLDTVRREDERILRELEETLKEVVKRVREKGTTEDVDRKVDENRKELEKAKRKSEEETERNKERLDDILRRSERRLEDIKRRLDELERRGEDIRRISEEAKELLKRWEDESRKVEEEHRRSLEEWRERSERIAREHKKSLEKLEKDVE

SEQ ID NO: 6681 - protein, 177 aa, Artificial Sequence; identical to SEQ ID NO: 6680
  Synthetic

SEQ ID NO: 6682 - protein, 181 aa, Artificial Sequence
  Synthetic
SIEELLKKLEEDIERVLRKSEELLKRNEEENKKVLDESKRLLDELKKRAEKVLRELKDEKRRLEDAERKIREMEKEARKVLEDSKRTSEKLKKKAEDVLKRSKEEVEELKRRVKKVREDGTTEEVLKEIVKRVRDDIERHDRESKKLSDENKRVVDEHRKRSEELARKLEELLREIRERVT

SEQ ID NO: 6683 - protein, 181 aa, Artificial Sequence; identical to SEQ ID NO: 6682
  Synthetic

SEQ ID NO: 6684 - protein, 183 aa, Artificial Sequence
  Synthetic
SDIEKLAEEVDRLNKELTDRLERLREEHKRTLDEIRKTLEKLKREVDKELEEVKKIVKDGDNRERLEEDLRRRLEELEKRMKELKDRNRRKAEESERKLRELLKDNKDKLEKIKDDARKADSRDERVKKILDDLKRKNEENDERVERIMRELRERNRKLNEEIDKIVEDIRREVEKVSREARR

SEQ ID NO: 6685 - protein, 183 aa, Artificial Sequence; identical to SEQ ID NO: 6684
  Synthetic

SEQ ID NO: 6686 - protein, 180 aa, Artificial Sequence
  Synthetic
DAVDRVREENKKDSERNKKRVEDVKRRAEERSRRNKKKVKELRDRNREEIKRIKELKDRGEVTEEERKKIRDRYKKDEDRVRKEDEETKRRLEEETKEDDRRNEREEREYEKKAEELERRNIVDRKVEEESRRSFKRNKEENKKVRDEIKKTIEENEAENRKAHEDSKRSFEELEDELRK

SEQ ID NO: 6687 - protein, 180 aa, Artificial Sequence; identical to SEQ ID NO: 6686
  Synthetic

SEQ ID NO: 6688 - protein, 182 aa, Artificial Sequence
  Synthetic
DKEREATRRLRELEKENTKLVKEIRDADREIEKRLREIHKKLEDENRKLEEEIKDMVRRKGDTSEEEKKKLDDLRRRLREAHRELDEERKKSEKKLEDDHRREETRLRRNREETKKTEDDLRREGVDDRIVEEVKKHHERNERRLREYLDESRKYLEDHIRRLEKYLEDSRRLATRIKEETK

SEQ ID NO: 6689 - protein, 182 aa, Artificial Sequence; identical to SEQ ID NO: 6688
  Synthetic

SEQ ID NO: 6690 - protein, 178 aa, Artificial Sequence
  Synthetic
SSVEEVKRKNEKSLREIERASEEHLERLKRELEKSEDEARKHNKKLDDDLERLERKGGGDEDAERELRKLREDSERERKEHKEKLDRARRRSEKMKEDLKRRLEKLDREHREDRRREPDDERVKDLERTHEESKRRVEELMKENDDLLKRIEEESKRLNEENERKVEDIEKKVEDLKR

SEQ ID NO: 6691 - protein, 178 aa, Artificial Sequence; identical to SEQ ID NO: 6690
  Synthetic

SEQ ID NO: 6692 - protein, 182 aa, Artificial Sequence
  Synthetic
SEIERVAKELKDEADRLRKEVEKHRRRSKEELDRLREESKKVNEDLKRMLERIREIAAQGNLEEDILRTMKEEIERRREEYEERLKAVEERLRREHERTKKKLDDDRRRIEKKRKDLTDKLEPNEEFKKLRDLIEDIKRRLEELVKALEETNKKIEDDVRDSVRKNRETLERIKKEIEDTAT

SEQ ID NO: 6693 - protein, 182 aa, Artificial Sequence; identical to SEQ ID NO: 6692
  Synthetic

SEQ ID NO: 6694 - protein, 183 aa, Artificial Sequence
  Synthetic
KDVERILREIRETLRRVEEEAKRSNDEIRKLNEEAERIVREILKEIEKELREVRKRLTEKGPRERLEEELKRRLEKIRERIERAREEYERKVREEEKKHREKEERDRERKERTEDRIRRRQSENDELLRRLKEELDRVERTIRELIRRNEEVLERSDESVEKLLRELEELLRRVEEEIKKAAT

SEQ ID NO: 6695 - protein, 183 aa, Artificial Sequence; identical to SEQ ID NO: 6694
  Synthetic

SEQ ID NO: 6696 - protein, 176 aa, Artificial Sequence
  Synthetic
SEREERAKRLRKILEDLKRESEEHLRRLKTRLDKLREDSKKHLEDVRRKLEDLKRIVEENKVSREELEKRREDIERRVRESEKRTDEREKRDEERHREFRKDLERKVRTMRDETRRGGETDDELRKLVRKVEEDLKRLDEENKKLLEKVKRDLDRLKKENKDLLKRVEEELRREAT

SEQ ID NO: 6697 - protein, 176 aa, Artificial Sequence; identical to SEQ ID NO: 6696
  Synthetic

SEQ ID NO: 6698 - protein, 176 aa, Artificial Sequence
  Synthetic
SEEEERKRRLEEKLERLEEKSRRHLKEVKRTLEELEERSRRHLDENRRLLKRLKEIVDRNEDSEEVIERREEEIDKRNEEEERETRKRAEETDRRVEKSEEKLKRDEDRMDKETKDGGDTSEEIKKLVKDIKEELKRLLEENKRLLEEAKKTLKKLLEDNRRLIEKIKKELDEARK

SEQ ID NO: 6699 - protein, 176 aa, Artificial Sequence; identical to SEQ ID NO: 6698
  Synthetic

SEQ ID NO: 6700 - protein, 174 aa, Artificial Sequence
  Synthetic
REEERLKRELEKDLERIKKLSDEHKKRLEEENRDLRRKSREHKEKLERDLRRVEEIRRREKIREEIEERIRRRDEELERDNERVKEEYDRRREDRRRENEEIKERLKERKEETRKKDTSDEVERLLKEIEDRVRKLEKENEEIARRSTETLEKLLKENRETLKEIRDRVREAKR

SEQ ID NO: 6701 - protein, 174 aa, Artificial Sequence; identical to SEQ ID NO: 6700
  Synthetic

SEQ ID NO: 6702 - protein, 174 aa, Artificial Sequence
  Synthetic
SEEEELKRRLKEILRELKELSERHKKRLRELNEKLKRLSEEHKRKLEEITEDLRRIATREPIREEIDKRYREKVERAKEENKEIEEDYKRAEKELREDNRRIEEEVRKKEEDTRRTPNSEEVKRLLDEIRRELERLKEENRKIVEDSTRTLKELLEENKRILEESSRDLERLKR

SEQ ID NO: 6703 - protein, 174 aa, Artificial Sequence; identical to SEQ ID NO: 6702
  Synthetic

SEQ ID NO: 6704 - protein, 174 aa, Artificial Sequence
  Synthetic
SEEEKIKEEIKRDLEDLRRLSKEHKDRLRKLLEDIKKLSEEHKDKLRRITKELRDVVRREEIREELDEEYKEKAERARRENEEIRKKLEEDVERLRKENERIKREAERRDKETEDTDTSEEVKRLLEKVKEDLKRLLDENKRIIERIEREVERLKRENEEILKESSRDLERAKK

SEQ ID NO: 6705 - protein, 174 aa, Artificial Sequence; identical to SEQ ID NO: 6704
  Synthetic

SEQ ID NO: 6706 - protein, 174 aa, Artificial Sequence
  Synthetic
SKEEKLKEDLKRTLDDARRLAEETKRRLEEILEKLKRLSEKSKEDVKRTTDELRDIVRKRKIDEEIDERYKDKKRKHERRMTEIDKEVRELDEDTRRKIEKIDKELEDRDDRTRKEDTSEEIKDLLRRIREELKRLKDELRRIIEEIRKELERLKRENEELNRRSSEELKKAKK

SEQ ID NO: 6707 - protein, 174 aa, Artificial Sequence; identical to SEQ ID NO: 6706
  Synthetic

SEQ ID NO: 6708 - protein, 179 aa, Artificial Sequence
  Synthetic
SEVEELLERHKRALDKAKKVSEDHKRDLKEKLDDVKRKVEELERRLKRALDELTKEGGGSTDVERKLREVDEKTERDRRRLDEEVKRVEDESREKTERLREEVKRLHDESRDRKEKLRLEEDLVRTLDELHKDIERRLRKLEEENRDILRRIREEIERLKRKLDEIARRIKEEVKKLKK

SEQ ID NO: 6709 - protein, 179 aa, Artificial Sequence; identical to SEQ ID NO: 6708
  Synthetic

SEQ ID NO: 6710 - protein, 179 aa, Artificial Sequence
  Synthetic
SEVEELKKEHKKVLDEVRRASKKHKEELEEMLRDLKRKADELARRLEDALRRLEEEGGGGDRVEKDLRRIEERLKEDEKRDRDKVDELRRRSEEKLKRIKRRMEEVSKKSEDDERKLRLDKKAVDELRELHKEIKRRIEKLLKENEEILRKIEEDIERLLEDLRRKAEEIKRRVDETRR

SEQ ID NO: 6711 - protein, 179 aa, Artificial Sequence; identical to SEQ ID NO: 6710
  Synthetic

SEQ ID NO: 6712 - protein, 179 aa, Artificial Sequence
  Synthetic
SEVEEIEKENKDAVRRMREKSRRHKEELKDALREAEEISRRHKEELKRKLEELTKRGGGDEKLDEDLKRIRDKSKKTTEDLKRKVEELRKRSEETLKELEDDLKRLHEKHKDTEDKMDLEEELVRKLRRLDKRTHEDVRRLLDENRRTLEKIEEDIRRLIKENEDTLREIEKRVEDKKR

SEQ ID NO: 6713 - protein, 179 aa, Artificial Sequence; identical to SEQ ID NO: 6712
  Synthetic

SEQ ID NO: 6714 - protein, 177 aa, Artificial Sequence
  Synthetic
SEDEELKKEIEKLLRELRKRSTESKKEIEDLLDELRRKSERSRKEIEDTLRELEERAKGERSEEEDKRTREDTEEKEKEHRKKLRKEDEELREREKEHERKLREVEKRLREREEETKSRETSEEIKELLERLRRDAERLKKENEDLNRRLREEVEKNKEDNKRLNEELRKKVEEDRR

SEQ ID NO: 6715 - protein, 177 aa, Artificial Sequence; identical to SEQ ID NO: 6714
  Synthetic

SEQ ID NO: 6716 - protein, 185 aa, Artificial Sequence
  Synthetic
SLEETLDKILEDIRRRIRENEERNRRLKEEIDKAIKRNEEENRKTNEDIKRKIDDLERKRGDRSKEVEDTKREVEEEEDRSRKKEDEDRERVKRAKEESERRREEDKKRVEDMERRAEEKKDKEQDKKEVEELIRELEDELRKLEERSKEHLDRLREELKELDERSKKHLDELRKLEEKLRRDAD

SEQ ID NO: 6717 - protein, 185 aa, Artificial Sequence; identical to SEQ ID NO: 6716
  Synthetic

SEQ ID NO: 6718 - protein, 175 aa, Artificial Sequence
  Synthetic
SETEKLLERIRRNVEENEKYAREHLKKLDKNLKDNKEYIDRHVKKLKERLDTLREIAREKDPSRELDKALEETRRDSRRSEENRRRHEKRTRDEAKKSEERLRKHRKDSEKETKDGGDREERIEKLLRELERTHRELKEELDKLHKRLEEEHRRLEKKLRDIHRKVEKDLRDLKR

SEQ ID NO: 6719 - protein, 175 aa, Artificial Sequence; identical to SEQ ID NO: 6718
  Synthetic

SEQ ID NO: 6720 - protein, 175 aa, Artificial Sequence
  Synthetic
EEKERLKKRIRDNVEENKKYAEEHLKRLKEKLEEVRKYIEDHKDRLRRKIEELKKDAERKPDDRELEEKEKKDREEAERSKRRRDEKRRKIEEDSRESRKRRDRHRRESEKEIRDGGDNDEEIRRILEELRRTHKKLEEELEELHKRVEDELRRLEDELREIHERLEETLRRLRK

SEQ ID NO: 6721 - protein, 175 aa, Artificial Sequence; identical to SEQ ID NO: 6720
  Synthetic

SEQ ID NO: 6722 - protein, 175 aa, Artificial Sequence
  Synthetic
SEKEKLKEEIKRNVEENRRYVEEHKRDLERNAEENEKYIREHLKRLKEEAEEVRDRVAKEPPDRKMEKTEKETDKRAKESRDRAERHKEETRKKAEESKRREDRHREESEDRAKKGGDRDKEIERLLRELERTHRELRKDLKRIHDELKKKHDDLRRTLEEVHKRVKEELDRARR

SEQ ID NO: 6723 - protein, 175 aa, Artificial Sequence; identical to SEQ ID NO: 6722
  Synthetic

SEQ ID NO: 6724 - protein, 175 aa, Artificial Sequence
  Synthetic
SEKEELIERIRRNLEENRRYIERHLEELEKKLDDVRRKAKRHLEKLREELEKLKDDARKKPPDREVEKRKEEKDRESERSKRELDRTREEIERETRESEDRERRHAEESEKRIKDGGDNDEEIRKLLEELRKTHEKLKRDLERLHKKVRDTLKKLEDELKELHKRVDDELRKLRK

SEQ ID NO: 6725 - protein, 175 aa, Artificial Sequence; identical to SEQ ID NO: 6724
  Synthetic

SEQ ID NO: 6726 - protein, 179 aa, Artificial Sequence
  Synthetic
DEERKLEELEKENDKLLEDAKRTLEKLLKDNRDLVKRVEDELRRLEEENKKLADDVRRDGKSDEKIERDIDKSRRDTRDEARRARERIKRSEDELRREMEELDKRHKEFKEDERRKRKEKRRSSKELEDRSREHLERLKARLKELEDKSRKHLEEVKKELRELEEKSKKHLKRLEDARR

SEQ ID NO: 6727 - protein, 179 aa, Artificial Sequence; identical to SEQ ID NO: 6726
  Synthetic

SEQ ID NO: 6728 - protein, 179 aa, Artificial Sequence
  Synthetic
DEEETLKRLDEENDKLLEEVKKTLEDSLRRLEELHKRTEEELRKSRRELRELVKDVERKGSLREEIKKELDDYDRRTKEELDKTRDEHEKYKRKVREELKRTDEKVRRSKEDDERVRREKRRSKEELRDKSRRHLEDVKRRLEELKKSNEEALRRDEKKLEDLRRSNEKVLRELKEKAR

SEQ ID NO: 6729 - protein, 179 aa, Artificial Sequence; identical to SEQ ID NO: 6728
  Synthetic

SEQ ID NO: 6730 - protein, 179 aa, Artificial Sequence
  Synthetic
SEEEEVRRLEEELKKLHDDIKRRLEELLRENEKILRDIDREIKKLLEELRKTIDKADKDGVLSEELKKELEKLLKDIEDTLKRLKDESKEDRERLEKELRELSKRSREEDEKRRKATKDGDRDKDELRKIVEELKRDHEKDLRKVEKLSEEHKEKLRRALEELKRLAEEVKKRLDDERR

SEQ ID NO: 6731 - protein, 179 aa, Artificial Sequence; identical to SEQ ID NO: 6730
  Synthetic

SEQ ID NO: 6732 - protein, 189 aa, Artificial Sequence
  Synthetic
SVEERLEEMERRNKDLIRRVEEDLERLLKENRDLIRRIKEELKRLKEELKELVERISREGDRPEEEKERVKERLKKEEKETDEKAERDDRRHRKTEKETRDRVREDRKRHEDEERRRREKARRLKDSGSKEEVLKELEEENRKHEKRLRDALERLRRRSKKHKDEARKILEELKERAKTIKRRLEEDRR

SEQ ID NO: 6733 - protein, 189 aa, Artificial Sequence; identical to SEQ ID NO: 6732
  Synthetic

SEQ ID NO: 6734 - protein, 189 aa, Artificial Sequence
  Synthetic
SVKEDLRKAKEENKRLIEKAEDDLRKLLRENKELLKRIDEELKRLKKELDDIVRRIEDKGDRPKEDRDRVKKEADEIREETDREVEEERRDVKRTEEETKKRAEDSKRRHKKFEDDLDEKARELERSGSKEEVLEKLKRDNEDHKRRLKEDLRRLREESKKHKKKLEDRLKKLEERARRIKEKLKEEER

SEQ ID NO: 6735 - protein, 189 aa, Artificial Sequence; identical to SEQ ID NO: 6734
  Synthetic

SEQ ID NO: 6736 - protein, 184 aa, Artificial Sequence
  Synthetic
DDEERIRKIAEDIKRKLKETLERLRDESRKNKRKLEDLLRKSEEKAKRLKDKLRKMEEEKERKRDEELKREIERLRREKEELHKEFRKRVEDTRRENERRREEVKKRLDTMRKETEDTEEKIRRDGVDNEDVKRLLRELKEITDRIDEEVKRLREENERITRRIEEEHKRLNKELERILREIER

SEQ ID NO: 6737 - protein, 184 aa, Artificial Sequence; identical to SEQ ID NO: 6736
  Synthetic

SEQ ID NO: 6738 - protein, 175 aa, Artificial Sequence
  Synthetic
SSEEKAKELRKRLRETHKRVKDEIKRLKEELEESHKRLEERSRETLRKLEELIKELNVSEEVLDELRRKLERLEEEHKKYKEKSKRELEKIDEDVERYERDSRREEEETEKKLRKDGVVDTELEKDVRRVEEKNRRALEDVRRKVEEVKESNKRALEKNERIVREVERRLREEKK

SEQ ID NO: 6739 - protein, 175 aa, Artificial Sequence; identical to SEQ ID NO: 6738
  Synthetic

SEQ ID NO: 6740 - protein, 175 aa, Artificial Sequence
  Synthetic
SSEERFEKLDRELKRTHEELERAIRELKKDYERSLKRVEEELKRLLDELEELARRVGVDEKVLKEEEDERRRLREEVEKYKKDAKEELKRTDDKVRKYKEKSDRDRERAEDEVRKTGVVDTKVTETVRRVREENKRMLEDVKRDVDRLRTSNEKVLRDIRRTVKRAKERLKELKE

SEQ ID NO: 6741 - protein, 175 aa, Artificial Sequence; identical to SEQ ID NO: 6740
  Synthetic

SEQ ID NO: 6742 - protein, 179 aa, Artificial Sequence
  Synthetic
SAEDELRRLRRELEKSHEELKRRIDELLKRLRELVKRVKDRSKELLDELRKLLEDVKRKGRVSERLEEDIRKHMKRHRERLEREERELKKKLKEMEDRVREYEDRSRREAKKDEEDIRREGVKDTRVRERVKETRRRNEEVLREVERIAKEVEDDLKRILEELEDNVRRVKKKIKDVER

SEQ ID NO: 6743 - protein, 179 aa, Artificial Sequence; identical to SEQ ID NO: 6742
  Synthetic

SEQ ID NO: 6744 - protein, 179 aa, Artificial Sequence
  Synthetic
SSEEELKKLEKELEETHRKLKEDVERLLRDLDRKVKKVEDDSKKLLDELRKLLEEAKRRGVVSEEVEKRVRDHMKRHEEELKRIREELEREKEERREELRRYEEEVKKKREEDRDDIRRRGVKERDVRKRVKEMKEDNRRALEDIRRKTEEVAKKLREILKKLRENVRRVAEEIKRVAD

SEQ ID NO: 6745 - protein, 179 aa, Artificial Sequence; identical to SEQ ID NO: 6744
  Synthetic

SEQ ID NO: 6746 - protein, 179 aa, Artificial Sequence
  Synthetic
STEEELERLRRELERTHERLREESEKLVRELRKLVEEVREALERLRRDLKRLLKEVREKGRASEDVERELKKEDERIEDKARKDKEEADKHERRHREDLKRYEKKSEEDDRRREKKIRDKGVKETEVREEVKRTKEENKRVEEKLRRNVDEMRKKLEEILRRIKEEIDKMRRKIEEIER

SEQ ID NO: 6747 - protein, 179 aa, Artificial Sequence; identical to SEQ ID NO: 6746
  Synthetic

SEQ ID NO: 6748 - protein, 178 aa, Artificial Sequence
  Synthetic
DVEEDLKRLEKKNRDLNKRMEDSNRKLEEDDERVNRKIRKDHKKAEDDLRRVIKEVEEENRSDERDKKRLKKRTDDNRREDKRRDDENKKTNKDYKRRFEKKRRENEDTDRKTKDEVRRRGVTEKTIEDIERHLDRLRKENDKLRKELEDHIRRLEEEVRKNLDRIREEIERARERVR

SEQ ID NO: 6749 - protein, 178 aa, Artificial Sequence; identical to SEQ ID NO: 6748
  Synthetic

SEQ ID NO: 6750 - protein, 179 aa, Artificial Sequence
  Synthetic
RAEDEVRKIKKEIDELIRRLEKLNEDIKREIDELVRRLEELNKRVKEEIKRLIEELKKENRVDERKVRKLEEDLERHDREVREDKERIERTAKRHREDVERNKEETTRRREKTKREIDRDGVGDRELKERLDRMRDHARKHEEKLKESLKRVREHVKRHAERVEESLRRLKRDVDELRK

SEQ ID NO: 6751 - protein, 179 aa, Artificial Sequence; identical to SEQ ID NO: 6750
  Synthetic

SEQ ID NO: 6752 - protein, 174 aa, Artificial Sequence
  Synthetic
SSDEKLEEIERHHRKVEEESRRLDEDIKRHHKEVEDESRELLERIKKKLEDVTRALGREDREMKELKRELDKRREEVKRRDDREREKSKKREDEIEKKDRERRKESEEKRRRLREEGLRDEILEKLERDNRRYKEESEEEVERAKEENRRYLEESRREVEEFDRKLKEIADRAR

SEQ ID NO: 6753 - protein, 174 aa, Artificial Sequence; identical to SEQ ID NO: 6752
  Synthetic

SEQ ID NO: 6754 - protein, 182 aa, Artificial Sequence
  Synthetic
SELEERVKKVEKVNEDLKRRVEEHERRVKRTLERLEEEVRRHAEKVKKRLEELRRLAKDVERETLEREIREDEKRSRDDAERLAREIERVRKESEEDAKRKKEDNERKNRERKDSARRQGRSEERIEDLLRRLDDRNRETEREIEERHKRLKEELDKVEERIRREHEKLKRELEEVERRTRK

SEQ ID NO: 6755 - protein, 182 aa, Artificial Sequence; identical to SEQ ID NO: 6754
  Synthetic

SEQ ID NO: 6756 - protein, 185 aa, Artificial Sequence
  Synthetic
DVVDELRRIAKEVRDRLREIVERLDRIAKEVVKENEEVVRHNDELAKRVVTTAKRIVDEVKDKETVKRRIDRIAEKVEEDTKEHEDRSKRSEEDVERVVKKIREEVKEIVDRVEKFVKEVRDSGTDSEEVKRVVETVRKLLRDAEKEIEEVVKKVRDLLRRVNKELKESVERVRRLLEEVRERAR

SEQ ID NO: 6757 - protein, 185 aa, Artificial Sequence; identical to SEQ ID NO: 6756
  Synthetic

SEQ ID NO: 6758 - protein, 186 aa, Artificial Sequence
  Synthetic
SDLDRVLRKIEELVREIEKESERTNRKSERDTEEVARRSEDSDRDIERLVREIRDRLRKAGVDSREVERVDRELEELLRRLRKENEDSLRESERLNRENKRRSEDSVKKLRDILARVEEKVRKREDLKDVVRELEEIVKELEERAKENVKRSEKSVKEDLDVLADNVRRSKEIVEEIKKRADEVVT

SEQ ID NO: 6759 - protein, 186 aa, Artificial Sequence; identical to SEQ ID NO: 6758
  Synthetic

SEQ ID NO: 6760 - protein, 171 aa, Artificial Sequence
  Synthetic
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 6761 - protein, 171 aa, Artificial Sequence; identical to SEQ ID NO: 6760
  Synthetic

SEQ ID NO: 6762 - protein, 171 aa, Artificial Sequence
  Synthetic
DEDEKVLRKIEELVRRLHEKNRKVLEESKRTLEKVEERLRRVLKEIEDLVRDAARRVDKREVIEELKKDLDRVRRKLEKVRKENADLNDRVRRELEEIDKRLKKKLDDVRRSDRDVSELDKIIKELKREADESVKKLKEIVKRSLDHLEEVVKELKKRLDDLKREIDTKAK

SEQ ID NO: 6763 - protein, 171 aa, Artificial Sequence; identical to SEQ ID NO: 6762
  Synthetic

SEQ ID NO: 6764 - protein, 175 aa, Artificial Sequence
  Synthetic
SLEEEVKKVVEEIKRRIEDDVRRIRELVERIKKLIEKDVTDLKRVVDENRDLAEKAKRIPKEDVDRVVREVERSNDELRRHSEEVLRRVERLIRELERHSREVIKRIEDTIRELRRRKVSEELLRELRRVLEEAREDSRRLLEEIRKVLEEAEEKSRRVLEESKRVNDELRERLR

SEQ ID NO: 6765 - protein, 175 aa, Artificial Sequence; identical to SEQ ID NO: 6764
  Synthetic

SEQ ID NO: 6766 - protein, 176 aa, Artificial Sequence
  Synthetic
SLDESAKRVLEEIKRLAKEDLDELKRVLDEIKEILREVLEANRDSVRRIEEEVEKLARVDDERTVKRLEDEAKRILDDNRRKSERVARELERLLEELKRHSEDVLKKLKDLLRELKEEGVDDRVLEEIERVIRKIEEDSRRLLKEIADVIKKVREESKRLLDDLKRVIDELRERAR

SEQ ID NO: 6767 - protein, 176 aa, Artificial Sequence; identical to SEQ ID NO: 6766
  Synthetic

SEQ ID NO: 6768 - protein, 185 aa, Artificial Sequence
  Synthetic
SLEEVLDRVRRESDKVRKTLERVKEEVERVSREVVEDLKRVEEEVRRLIERVKDILRRSNIPEEDLRRLERRLEELERKIKKVVKDNEDRNRDLNRRIDEVIKENERRNRELLKKAEEDIRRKKDKEELIRDVLREAERLVKESLDDIRRLLDEVRRLVEESRRNIERLLEEVRRLVEEIERAAE

SEQ ID NO: 6769 - protein, 185 aa, Artificial Sequence; identical to SEQ ID NO: 6768
  Synthetic

SEQ ID NO: 6770 - protein, 178 aa, Artificial Sequence
  Synthetic
DKVDEVLKRVKRVVEEIEDRVRKLNKEVRDVVKRIEELAREVLDHSRKVVEEIKKTAEDRKDERVLEEIKRKSDEDEKRLEDVLRRIKELLDRLDDKHKRILEEIEKKIRELRERIKKTGIEEEVVRTVKEELDKALEKAERVLEHSRRMLERVLKEAKRVLDEVKELNKRVIDEVRR

SEQ ID NO: 6771 - protein, 178 aa, Artificial Sequence; identical to SEQ ID NO: 6770
  Synthetic

SEQ ID NO: 6772 - protein, 175 aa, Artificial Sequence
  Synthetic
SVEDVAREVDKLLKRANEESKRVLEEVERLLRTVSRELEKVIRDVKKLIDDVEKRVPLKESLEEVKRRIEKLVEDVKRVNDESRRRIEELIKELKDMDRRSKEEIEKLRREVRTSGSETAEKVLRDVERIVRRNEELVREVLRRVKKIVDENRKIAEDALRKVEELVKELEERAR

SEQ ID NO: 6773 - protein, 175 aa, Artificial Sequence; identical to SEQ ID NO: 6772
  Synthetic

SEQ ID NO: 6774 - protein, 178 aa, Artificial Sequence
  Synthetic
SEAEEALERVKELVKRSEELAEESLRRARKSVEEVARRAEEALERVKKSVEEVKEVRKEGQPKEELDKILEKNKRDTERLRRDLERILRENKRKTEKLAEDNKRAIDEIRKRIDDLERKVDGKEVLDKVRDLVRRVDEENRRVIEEAKKLSEDVARRVDKVIKDVERLSKRVEDEVRR

SEQ ID NO: 6775 - protein, 178 aa, Artificial Sequence; identical to SEQ ID NO: 6774
  Synthetic

SEQ ID NO: 6776 - protein, 178 aa, Artificial Sequence
  Synthetic
DEDRRAVEELRRVVEEVNKLNEDTLRELERIVRENIRRVRELLKEAEDVVREVEKEVRRITDKEKVERILRKLEKILDRIRRESERLDRETEEVLRKLHEENKEILKELEKKLRDVKEKVKEAEEVLREAKDLIDHVRKTIEEVNDTVRDLVRKVHEVNKEVLDRIRKLVEEVRKTVE

SEQ ID NO: 6777 - protein, 178 aa, Artificial Sequence; identical to SEQ ID NO: 6776
  Synthetic

SEQ ID NO: 6778 - protein, 184 aa, Artificial Sequence
  Synthetic
SSLDRVRRAIEELVKKVNTDSKRVKDRVRKLLKEVNDTSDRVRRDVKRKLDKVKDDARKAGTPDDVKRKLRRVEEEIKKLIEEDKEKNRRSEREVEELIERLEEANKRSKEELEKLIEDLKRSTDDRVVERVVREVERIVRENEELVKEVVRRAEEIVERNERHSRELLRRLAELVDDLRRKIE

SEQ ID NO: 6779 - protein, 184 aa, Artificial Sequence; identical to SEQ ID NO: 6778
  Synthetic

SEQ ID NO: 6780 - protein, 184 aa, Artificial Sequence
  Synthetic
SSLDEVRKRVTELLKKVDDTSKKVEDDVKRLLDKSTRTSDEVRKAAERLLEEVEESARRKGTPEEVKRRLEDVKRKVRKLIDDNRRTNERVRKRVEDLIRENRKKLEEVKRRVKKLIDELRRSTDDEMVKRVLEELKKIVDDLERHSRKLLKDARRIVEESIEHSDRVLKEATRIVEKLERDIR

SEQ ID NO: 6781 - protein, 184 aa, Artificial Sequence; identical to SEQ ID NO: 6780
  Synthetic

SEQ ID NO: 6782 - protein, 181 aa, Artificial Sequence
  Synthetic
DEIEEVLREMRELVERNVREIEKVVRENEKLVEDNIRLVREVAKELRDLVRKLIERVARTTDKEELKRVLKTIEDEVRKITERLKESSERSERESRKSVDKLRKSTEDIKRRIEELERRVERTEELEEVVKEARRLLKKSEEDLRRVEKRVEELNEKSKEEMERVRDDVRRLLEEVKERAR

SEQ ID NO: 6783 - protein, 181 aa, Artificial Sequence; identical to SEQ ID NO: 6782
  Synthetic

SEQ ID NO: 6784 - protein, 181 aa, Artificial Sequence
  Synthetic
SEVDELLRLADEIVRELRELVRRHDEIVDKLVEENRRIVEEHLRRVEDVVRRLKELVKKIKDKKKLEDKLRDLLKKLRELSREVEKLNRESLETIRRTTEDLERKLETLARKVRELEERVRRDEEAERVVKEARRLLREIEELVKRSVERVERLHREVHERIKESTKRVEELVDEVRKAVK

SEQ ID NO: 6785 - protein, 181 aa, Artificial Sequence; identical to SEQ ID NO: 6784
  Synthetic

SEQ ID NO: 6786 - protein, 184 aa, Artificial Sequence
  Synthetic
SAVDEVRKVIKEIFDRLAELLKHNSDMVRRLLEEIRELVKNNTEIVREVLKKLEDILRELTDKDEVRKALKELVDRLRKVSEEHKRRIEEIERRIRRVSREHEKTLKKIVDDLERLIRDVRERVEEEKLEKVAEDARRAIKDIEDKLRDSNRRLDKLIKEVRRRLEESHKRIEREIKEIEERVR

SEQ ID NO: 6787 - protein, 184 aa, Artificial Sequence; identical to SEQ ID NO: 6786
  Synthetic

SEQ ID NO: 6788 - protein, 187 aa, Artificial Sequence
  Synthetic
DKLDEVKEAARRVVEEAHKKNRRVLEKLDEVSRRAHELDKRVKEKLKEVVKRADDLLKEKGISEEKVKRVRDEARKIERELDRLNEENKRKNDESKKTLRELNERDREVVRKVEKEIEDLRREGGDDVDTLVERLRRLVEELRKHSDDTVRRMEDIVRRNKKHSEESVRKMDDIVKKLEELAREVVR

SEQ ID NO: 6789 - protein, 187 aa, Artificial Sequence; identical to SEQ ID NO: 6788
  Synthetic

SEQ ID NO: 6790 - protein, 187 aa, Artificial Sequence
  Synthetic
DRLDKVKEDLKRSSEDAHRKNKEAIELLDEVSTEAHKLDEDVRRKLEKVVREVRKLLEDKGISEELVKRLDDTAREVRERLERLNERNKEVNKKSKEKLKELNRRDEEHSRRLDKRLDDLARKGGDDIDTIVRDAEKIVEDNRRHSDETVRRIERLVTENLRHSEESVRTLDRLVEELLRTAEEVVR

SEQ ID NO: 6791 - protein, 187 aa, Artificial Sequence; identical to SEQ ID NO: 6790
  Synthetic

SEQ ID NO: 6792 - protein, 187 aa, Artificial Sequence
  Synthetic
DKLERVLRELERSSKEAHEKDKKVLEDLDEVSKRAHKANEEVIARLEDVVRKAEDELRKKGISKELVKRVEDTVRKIRKELEKLNEDDRKKNKESEDRLRKLNEDNKRHSEDVKRKLEDLARKGGDDLDTLVKRIEDIVKENEDHSRRSVEEIRRIVEENERHSRESVKTIKDLVEELERRAEEVVR

SEQ ID NO: 6793 - protein, 187 aa, Artificial Sequence; identical to SEQ ID NO: 6792
  Synthetic

SEQ ID NO: 6794 - protein, 187 aa, Artificial Sequence
  Synthetic
SELEKVLKDLEESSKEAHKADEEVLRRLERVSREAEKELKRVLDDLRRVVEEVERLLREKGISEEKVKRVKDTADEIKDRLKKLLDEVRERNRESEERLRELNERNKKHSEEVLRRLRELRRKGGDDLETLVRDARRIVKENEEHSRDSVRRIDKIVKENADEVRRVVKEIKDIVKRLEELARETVR

SEQ ID NO: 6795 - protein, 187 aa, Artificial Sequence; identical to SEQ ID NO: 6794
  Synthetic

SEQ ID NO: 6796 - protein, 171 aa, Artificial Sequence
  Synthetic
SLDEDVDELVKRVEEEMRRNVKELDKLVKEDKRLAEENVRRLEEIVDRSRKLADRKEGDKEKIKREADKSLEDLEESTRRLKERSDRLLRRLEESTKRVKDRLDEIEEDLKRKGVSEEVLKRLREVIERARRDSERVLRKLEKTTDKVRRDSERVLRENEKSIEDVARKMT

SEQ ID NO: 6797 - protein, 171 aa, Artificial Sequence; identical to SEQ ID NO: 6796
  Synthetic

SEQ ID NO: 6798 - protein, 186 aa, Artificial Sequence
  Synthetic
DELERLLEELKRTTRKIEEELKEVNRRLDDTTREAEKELRRLKEKLEEVVKRAEELLRRRGVSEEKVKRLRDTLDRVRKTVDELLKELKRVSDELRKRTEKSNRESRKRSEEIEREIEELARRGEPEKDVVKRLEDLVRDDDRIAKEDVKRLEDLVREDRTLVKEIVDRLEELVRTVEKLVKEVVN

SEQ ID NO: 6799 - protein, 186 aa, Artificial Sequence; identical to SEQ ID NO: 6798
  Synthetic

SEQ ID NO: 6800 - protein, 177 aa, Artificial Sequence
  Synthetic
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 6801 - protein, 177 aa, Artificial Sequence; identical to SEQ ID NO: 6800
  Synthetic

SEQ ID NO: 6802 - protein, 177 aa, Artificial Sequence
  Synthetic
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 6803 - protein, 177 aa, Artificial Sequence; identical to SEQ ID NO: 6802
  Synthetic

SEQ ID NO: 6804 - protein, 178 aa, Artificial Sequence
  Synthetic
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRSEEEVERVLEEVRRIIEKLKEDDKRSLERIERIVRRNNELNKESVDRIRKIIKEMEERAD

SEQ ID NO: 6805 - protein, 178 aa, Artificial Sequence; identical to SEQ ID NO: 6804
  Synthetic

SEQ ID NO: 6806 - protein, 174 aa, Artificial Sequence
  Synthetic
DESEDVEEKMRRLLEKSKDETRRVKEEVERLNEESKRVTEEVEKRVRDLLREVREKVRDKDVLEEIERRARKLVKELRELNREITERSKRSREELDKLNKKIEDDLRKIKKKLDDGKDVETVLREAKRLIEESIERIERVLKENRELAERSIKVLRDVLREVEDLIRKLEERAK

SEQ ID NO: 6807 - protein, 174 aa, Artificial Sequence; identical to SEQ ID NO: 6806
  Synthetic

SEQ ID NO: 6808 - protein, 177 aa, Artificial Sequence
  Synthetic
RKVEEVKKEAERLLRRSEEVSKKVADDADRLLKRSREVSDRVRRESERLLKEVAEAGVDEKILREIKKRSEESVKRLEDINKRLEDEIRRLKEELKRINDELRKRIERLREDLERDRTDKRVEDVLREARDLVRRSIKKIDEVLKEAKRLVEESIKLSEDNVRRNEEIIRDLERRTR

SEQ ID NO: 6809 - protein, 177 aa, Artificial Sequence; identical to SEQ ID NO: 6808
  Synthetic

SEQ ID NO: 6810 - protein, 177 aa, Artificial Sequence
  Synthetic
SAVERVKEEVDRLLERSKKESERVRKESEDLIRESDEVSRKVEEDSRRLIEEVERSGVDESILEELRRRSKKSKEDLDRINEELKRRSEESVKRLEEINKELKERVERLKEELDKIDDERVVTRLLEEAKRLVERSIEEIKRNVKENRKLVEESIKLSEENVKRNKRLVDEAIRAAE

SEQ ID NO: 6811 - protein, 177 aa, Artificial Sequence; identical to SEQ ID NO: 6810
  Synthetic

SEQ ID NO: 6812 - protein, 187 aa, Artificial Sequence
  Synthetic
SVVEEVVERVKRIAEELKRSSEENVDTVRKVVAEAKKLVEDDVREVEKLARRLKEVVTRDISDKKTLRDDIDKIEEEMRRLNKELEERIRKIERELERSSEENKRRVEKLAREIRKLVEDLERSGRVDERVLKDVKDKADKLIREVEETSKRSEEDVRKVIEEVREVLRESHERVKELIKEVREAER

SEQ ID NO: 6813 - protein, 187 aa, Artificial Sequence; identical to SEQ ID NO: 6812
  Synthetic

SEQ ID NO: 6814 - protein, 182 aa, Artificial Sequence
  Synthetic
SEAEKVAEDARKLAEEVIRLIEEVVERSKELVDRNEKEIRRVIEESDKLVEEVIRLLRRGDIRDEDIKRIEERLKELNTRSRETSKDVERELKELNKRLEEEIRKIEKEMKKLLDDLVRKRGETESVREVEKIVRDVVREIREMLKRSKDETRRVIKRVREVNDRSEKRSRDVVREARETSR

SEQ ID NO: 6815 - protein, 182 aa, Artificial Sequence; identical to SEQ ID NO: 6814
  Synthetic

SEQ ID NO: 6816 - protein, 182 aa, Artificial Sequence
  Synthetic
SEAEEVARRARKLVRELEELIRKSVEDSRELVKRNIEKIKRNVRKSEEDVDRVIKLLRRGDIREEDIKRIKEDLKRSNEESRRDSKRLEDRLRRLNEKLTRDIRRIEEEAEELLRDLVRRRGEAEAVREVDRIVKEVVRRVREALERSREETRRVIEEAKKANKESDDVSRKVAKEIDEEAT

SEQ ID NO: 6817 - protein, 182 aa, Artificial Sequence; identical to SEQ ID NO: 6816
  Synthetic

SEQ ID NO: 6818 - protein, 177 aa, Artificial Sequence
  Synthetic
RVIEEVDKEIKRVIKESEDVTKEVKDTSRKVLEDSKRESERVRRRSEEVLKKVEEEGVDKRILDELRRRVEESSKTLEEINRRLEEKIRDSERKSEEINKRLREELDKLREELKRIDDEDEVRRVAEKVKRLVDESIKRLKDNVKRNKELVDESIREVERNVEENERLATKVIEEAK

SEQ ID NO: 6819 - protein, 177 aa, Artificial Sequence; identical to SEQ ID NO: 6818
  Synthetic

SEQ ID NO: 6820 - protein, 177 aa, Artificial Sequence
  Synthetic
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 6821 - protein, 177 aa, Artificial Sequence; identical to SEQ ID NO: 6820
  Synthetic

SEQ ID NO: 6822 - protein, 177 aa, Artificial Sequence
  Synthetic
SVDREVEEIMRRVHKESEDVIRKVKDTVRRVLERSREVSERVKRDAERVLEEVKRAGVEKEILDRLREEVKKLEEELRKIDTDLERKIRELEKELEEINKKLREDLKRLKDELDKIKDKDFLKRVAEEVKRLVEESIKRVEDVAREVERLVEESIRLLEAVAKKVRDLVREVKRRRT

SEQ ID NO: 6823 - protein, 177 aa, Artificial Sequence; identical to SEQ ID NO: 6822
  Synthetic

SEQ ID NO: 6824 - protein, 184 aa, Artificial Sequence
  Synthetic
KEIEDLVKKIREIVDRIKKTVEDSVREVRRIVDESAKSVEELVKELKKLAEELRKLVEDGPEEKLRREAKRIIERADKLLKDDHRENKRLIEELRKINRDVREEVKRLTKELKESLDDLVRKRGETELIRTVERELREVEKEVKKMLDESTEVLKEVEERVRRMNDDVRRVLEKVARDVERDLR

SEQ ID NO: 6825 - protein, 184 aa, Artificial Sequence; identical to SEQ ID NO: 6824
  Synthetic

SEQ ID NO: 6826 - protein, 183 aa, Artificial Sequence
  Synthetic
KEVEEVVTKVDDLVRELEERSRRHVERVKEIADRNEKLVREVVKRSRDNVRELEELVRRGLERIDEELKRSAKTNKELVDRLRDKNRRSIEELKRLLDHNKELLDRVRRELERLLEEAERNRLPREVLEEVKKRIRDVLKRVEDASKRVKETIDEVLKRIKELTEDVERKSREVLRRVKEARK

SEQ ID NO: 6827 - protein, 183 aa, Artificial Sequence; identical to SEQ ID NO: 6826
  Synthetic

SEQ ID NO: 6828 - protein, 181 aa, Artificial Sequence
  Synthetic
KEVEDIIRKLRRHVKEIERTIREMVESVKRLADEVVKVLKDALDSARDHVRKILETLRDKGTSEVARRLERSNEEHMRRTEEEIRKLEERLDRHVKETRDVLRELRRSNDKLRDEVDRANLPEDVLRELRKVIEDTERTIKRLVDELEKVHREVKERIRKIAKDLRDKHKKSKRDIRETER

SEQ ID NO: 6829 - protein, 181 aa, Artificial Sequence; identical to SEQ ID NO: 6828
  Synthetic

SEQ ID NO: 6830 - protein, 181 aa, Artificial Sequence
  Synthetic
SAKDEVKDVNDKVRKEVRRVIEESRAVNEEIKRRVDTVLKESEDVNREVKREVEDKVRGEDLKRRVDKLLKELDRHSDELRRRLKEVLREVDEHSKELAERVKRILDKTTEEIKDLTRRGVDEKVAKEIVRKSEDVVRRIVEELKEDAKRSRDLVRELVKEIKEDVKRSRELVKRVVEEAK

SEQ ID NO: 6831 - protein, 181 aa, Artificial Sequence; identical to SEQ ID NO: 6830
  Synthetic

SEQ ID NO: 6832 - protein, 182 aa, Artificial Sequence
  Synthetic
REAEELVKRNEKIVTDIRRLVEKTVRDSRRVVEELKREAEETVERSRRVVTKLKELVERGDGRREEIERVTRELERENEELERRVKKVIDELKELNDRLEETLRRLVEESRRLLKDLIDKRGPDRMVEEVERTSREVEEEVKRVLKKSRDVTREVEEEVRRLLERSRKETDDVRKRLEEAER

SEQ ID NO: 6833 - protein, 182 aa, Artificial Sequence; identical to SEQ ID NO: 6832
  Synthetic

SEQ ID NO: 6834 - protein, 182 aa, Artificial Sequence
  Synthetic
DEAERLVEEIKRVVKEAEDLVRRTVEISRRVVETLRKEAEDLVRDSERVVKELTELARRGDGRREEIEKLIRELRKLNKDLEERVRRVERELEKENKRLEDTLRKLLEELRKLLEDLIRRRGRTELVEKVRRVIEEVEKRLRDMLRKSRDVTREVKERVARMLEKSKKVTDDVEKRVTDEDR

SEQ ID NO: 6835 - protein, 182 aa, Artificial Sequence; identical to SEQ ID NO: 6834
  Synthetic

SEQ ID NO: 6836 - protein, 182 aa, Artificial Sequence
  Synthetic
KEAEDLVRRVEEVVEELERRVEKLVRESEEVVKKLSKEVKESVDTNRDIVRRITELARRGDGREEDIRRLVTESRRLDEELRKRIEEVIRRLRKLNEDLTREARRVEEELERELRELIRKRGETEKVEEVERVIRRVKKRVEEVLRKSKTTTTDVERRVREMLERSEESTRRVKERADRERT

SEQ ID NO: 6837 - protein, 182 aa, Artificial Sequence; identical to SEQ ID NO: 6836
  Synthetic

SEQ ID NO: 6838 - protein, 184 aa, Artificial Sequence
  Synthetic
SEADDVVREIEDLVRRDKELVDEVVKRIKDLVRRDKKLVDEVVKEIKDLVTELEDLARKLDEEELRRVVKRVRDEIRRLADELREHSRRVEKEIEDLRRELEKHSEDVEREIRRLLKELRDRGIPEEMLRKLERVVEEVKRRSTEALKRLREVVKEVKETSKRANEELERVVREVKKRLDDATK

SEQ ID NO: 6839 - protein, 184 aa, Artificial Sequence; identical to SEQ ID NO: 6838
  Synthetic

SEQ ID NO: 6840 - protein, 184 aa, Artificial Sequence
  Synthetic
DEVREVVKEIRKLVEDDKRRVDKVVEDDRRLAKRDLDLVEDVVRRIEDLVRRVLEEARKLDRETLRKVVKDVIDTVDELLKRLERHSREVRKESEDLLRELRDHSRRVKERIKKLLDDLRRAGVDKSVLDELRKVVEEVKERSDRALEEVERSIRESEKESRRANEKLRKVVEEVRKKLEEAER

SEQ ID NO: 6841 - protein, 184 aa, Artificial Sequence; identical to SEQ ID NO: 6840
  Synthetic

SEQ ID NO: 6842 - protein, 184 aa, Artificial Sequence
  Synthetic
SEVDKVVKDIRDLVRRDLKRVEDVVRTDRRLAEEDLRRVKEVVEKIEKDVKELDELARKLDREELDTMLEKVKREIEERRKRLEEHSKRVEDESRRLLEDLRRHSKEVVDRIRELLKDLERRGVDESVLKKLKDVVDEVERESREALRKVEESIKESKRRSEKALEELREVVKRVDRLLEEARR

SEQ ID NO: 6843 - protein, 184 aa, Artificial Sequence; identical to SEQ ID NO: 6842
  Synthetic

SEQ ID NO: 6844 - protein, 184 aa, Artificial Sequence
  Synthetic
SEVDEVVKEVEDLVRRNEELVEEVVRRVEKVVTDDRRLVEEVVREIRKIVKDVEDLARKLDKEELKRVLDEMRERIERLLEKLRRHSKKLDDELKRLLEELREHSRRVEKRLEDLLKELRERGVDEKVLRKLEKVIREVRERSTRALRKVEEVIRRVREESERALRDLERVVKEVEKRMREAAR

SEQ ID NO: 6845 - protein, 184 aa, Artificial Sequence; identical to SEQ ID NO: 6844
  Synthetic

SEQ ID NO: 6846 - protein, 185 aa, Artificial Sequence
  Synthetic
DEVDEIVRRIEKLVTDDLKRVEDLVREVKKLVDEDKRKVDEIVKEIRRLVEEIRKEAERDRDERVLDKIRRDLERMLRKLEEDLRRSVEETKKTLRDLEKRIKESSEETRRELEKLEEELERRRMDEKVKRKLRKVVEEVERRSKKANEELEKKVREVEELSKRVLEKLKKVADEVRKEVKDAKD

SEQ ID NO: 6847 - protein, 185 aa, Artificial Sequence; identical to SEQ ID NO: 6846
  Synthetic

SEQ ID NO: 6848 - protein, 186 aa, Artificial Sequence
  Synthetic
DSVERLVETIREIARESLRRAKELVKSNKKLAEDSKRRVDKLVKELKDLVTRVKETLKRKRDDEETIERLKRELDRAVEEVKKALKESKEKSEEHVERMRRDIERTHRELEDLVRKVREDLKKDDLKGEVLELIEEVVREVKEVNTTVSKEVEDVVEETRKVNEDVAKLIEKVVREVKRVVDEVRT

SEQ ID NO: 6849 - protein, 186 aa, Artificial Sequence; identical to SEQ ID NO: 6848
  Synthetic

SEQ ID NO: 6850 - protein, 182 aa, Artificial Sequence
  Synthetic
SELERLVEEIRRLVREIEERSKKTTEDIKRLAEDIRRRSKEAVDENEDLARKIRKRAEERNDKDLVTELERRIEEIERRNKKLLDELKKRVERIVREVEKINEDLKRRLEELERRVKDVVRKRNEDSREIDKVIEEVRKRLKEVTDSDREVIKEIEEVLREVEERNRRSIEKIRKVLEDVTK

SEQ ID NO: 6851 - protein, 182 aa, Artificial Sequence; identical to SEQ ID NO: 6850
  Synthetic

SEQ ID NO: 6852 - protein, 185 aa, Artificial Sequence
  Synthetic
SEVDELVEKIRTTVKRVLEKHKRNTDETRRLVEEILERHTRTSRRIERVVREATDKLRRRKTEEVKKDLDRLLKELREEVEELKRRTTEILKRSRESSDRVRRESEEILDRLRKDVEDLRRKRKDVTEMLEKLREVLERAAEVLKRAEESDRTVDEEVERRVREVARSDDEVLKEVKREVERVKT

SEQ ID NO: 6853 - protein, 185 aa, Artificial Sequence; identical to SEQ ID NO: 6852
  Synthetic

SEQ ID NO: 6854 - protein, 182 aa, Artificial Sequence
  Synthetic
SEAEEVAKRVKEIAKENADLAREVAKDIKRLADENKKHADDVARDIERLAKELLEAARRGDAREEVAERARRRAEELARRHREENKRSEERARRLAEKAKRDNEKSREDIRRLLEDLKRKGAPERAEKLARDAAEEAKKAAEESNKLIREAAERLKEAARRADKLVEEAARRLEKAAEEARR

SEQ ID NO: 6855 - protein, 182 aa, Artificial Sequence; identical to SEQ ID NO: 6854
  Synthetic

SEQ ID NO: 6856 - protein, 182 aa, Artificial Sequence
  Synthetic
DEVDEVVRRDERLAEENLKRNTESSKRDRDLARENLKDAKRVVERIRKLMEDLKKLFDRGDIRDERARDVEREVEELLRELKRRNEESERRSRELLERLREDNERSKRRSKRLLERLRERNVDEKLTRRVEESLKRSEEVLRRVNESDKRSLEETRKVLEESNKEIEKVVRDLEELLKEVRR

SEQ ID NO: 6857 - protein, 182 aa, Artificial Sequence; identical to SEQ ID NO: 6856
  Synthetic

SEQ ID NO: 6858 - protein, 182 aa, Artificial Sequence
  Synthetic
SEADKVVKEVDDIVARNTEENDKSSKRVEDIIRENDKHAEEVVRDIRRLAEELRELRERGEIREKRLEEVRRRVEELLREHKEENDRSAEEIKKILRDLAERNKDSLRRIRKLLKDLKDKNLPEELEKRLRDVVRRAEERLRDVNRSDEEVVRRAEELLKRVDDRVKTVVEELKKTLDDERR

SEQ ID NO: 6859 - protein, 182 aa, Artificial Sequence; identical to SEQ ID NO: 6858
  Synthetic

SEQ ID NO: 6860 - protein, 182 aa, Artificial Sequence
  Synthetic
EEVDRVVKRDDDLARKNLEENERSSREDDRLVKENEDHAKKVVDDIRKLMEELRELARRGDIREKDADRVRREVDELLKKHRRFNEESRKESKRLLDELRRRNDESTKDSERLMRDLKRKNVPEELEKRLRESLRRSREVLKRVNESDRDSLERTKKRLEDVDREVRKVVEELRKVIRDEEK

SEQ ID NO: 6861 - protein, 182 aa, Artificial Sequence; identical to SEQ ID NO: 6860
  Synthetic

SEQ ID NO: 6862 - protein, 182 aa, Artificial Sequence
  Synthetic
SEAEEVARRVEKIAEDNARHAEKVAKDIEDLARENLELNERTSRRVERLARELLKAARRGDAREEVARRVEREIEKILEDANEANRRSEKEAEELAERHKEENERSKREIDELLKRLEDAGAPEEARKLARKAAEDARRAAERANELVKRAADELRRAAEEANKSDEDAAREARRAAEEAER

SEQ ID NO: 6863 - protein, 182 aa, Artificial Sequence; identical to SEQ ID NO: 6862
  Synthetic

SEQ ID NO: 6864 - protein, 182 aa, Artificial Sequence
  Synthetic
KDVEDVVREDEELAKTNKKHADDVVRRIKELIDRNRRLNEETSKRIEDLVRRLLELARRGDIREDELRRVREEVEKILKDVNEENRRSLRELERLVKEHEERNRDSKKRSEDLAEELKKRNVPERVRKEVERSLRKSDEVLRRVNDKVRRVLEELRKVLEDVNRSDEKVLRELEELLERVRT

SEQ ID NO: 6865 - protein, 182 aa, Artificial Sequence; identical to SEQ ID NO: 6864
  Synthetic

SEQ ID NO: 6866 - protein, 174 aa, Artificial Sequence
  Synthetic
SEDEKVRKVVEEAKEVNRRAEEAIKDVSERLERVNREVTKRSRDVSEEVRKMLERDASDKDEVERVKEKSKKSNEDLKRISERSRDESRKSNETLRRISEETRRRIREIEKLVKAGKDVDEVVKRIKELVDRSLELAERIVERNERLVEKSERDVRKIVEDNKRLADEVAKRAT

SEQ ID NO: 6867 - protein, 174 aa, Artificial Sequence; identical to SEQ ID NO: 6866
  Synthetic

SEQ ID NO: 6868 - protein, 174 aa, Artificial Sequence
  Synthetic
REDELVDKVLRELEELLRRVKKRLEDVSRDLERVNREVRDELRRVSKKVEDMARRDVGDKELVDEVRRESEKSNKELEDISRESKERSDDSNRKLDKLLKDVRDELRRIRKKVEDGKDAETVVRDIRRLAEELLRTVDKIVKDNERLARESRERVRRIVERNEELARDLARKAR

SEQ ID NO: 6869 - protein, 174 aa, Artificial Sequence; identical to SEQ ID NO: 6868
  Synthetic

SEQ ID NO: 6870 - protein, 174 aa, Artificial Sequence
  Synthetic
DDEKKVEDVVRKVKKVAEDVRRRLEKVSREVKKVLDEVRRRVEEVSREVEEILRRAASDKKDVEEVKRRSEDSKRRLEEIIKEIEERSRRSNETLKKLIKELEDRVRKIKEKVDRGSDADEVVKRIEDLVRDLERRVDEIVKRNKELVKRVEEEADKIVEDNKRLAEEVLRKAT

SEQ ID NO: 6871 - protein, 174 aa, Artificial Sequence; identical to SEQ ID NO: 6870
  Synthetic

SEQ ID NO: 6872 - protein, 174 aa, Artificial Sequence
  Synthetic
DSRRKVKEVIKELEEVLRRVKEEVEKVSRDLERLLKEVKEKLERVSRKVEEEIREKASDKELADEVRKRSKDSNDELKRLLDELRKRSEDSDRRLDEVVTRIRKRLKDIEKKVEDGSDADTVVKRIKELMKDVERIVEEIVRENRKLVTDLLREVDRIVEENERLAEELAERAR

SEQ ID NO: 6873 - protein, 174 aa, Artificial Sequence; identical to SEQ ID NO: 6872
  Synthetic

SEQ ID NO: 6874 - protein, 174 aa, Artificial Sequence
  Synthetic
SSKEKVERVVERLRRVNEEVIRLIEKVSRELEEVNKEVRERIERSVKETEDILRTAASDKEEVDDVRRRTEELVRRLEKLSEDSKKRSKESLEEVRRISKDTEDKVREIRKKVEAGKDVDTVVREIEKLMDDSKKKADRIVDENRELVKRSEEAVEELVRRDKKLAEDVFRKAE

SEQ ID NO: 6875 - protein, 174 aa, Artificial Sequence; identical to SEQ ID NO: 6874
  Synthetic

SEQ ID NO: 6876 - protein, 174 aa, Artificial Sequence
  Synthetic
DDERKVKKVVKEVRKVDEEVARRLDKVSKELRDVNREVKKKMEDSVKKTEDLAKKDASDKELVDRVRRETERLLEELEKLSRDSEEESKKSKEELERISRETEDRIRKIERLVEGGKDADTVVKRIKELAEESEKRVDKIVKRNKELVDKSKKDVDELVKRDEELMKDLVEKAR

SEQ ID NO: 6877 - protein, 174 aa, Artificial Sequence; identical to SEQ ID NO: 6876
  Synthetic

SEQ ID NO: 6878 - protein, 174 aa, Artificial Sequence
  Synthetic
SAEEKVRKVLKELREVNERVERELKRVSDESERVDDEVNTRAKKVVRDVERVLEERAGDKEEVEEVRKRIEELLEELKRLSEENKRRSEESEKELKEISKKTDEDLKRIERLVEAGKDVDEVVERIERLARESKKRVERIVRENEKSARESEKRADEIVKTIEELAERVARRAT

SEQ ID NO: 6879 - protein, 174 aa, Artificial Sequence; identical to SEQ ID NO: 6878
  Synthetic

SEQ ID NO: 6880 - protein, 174 aa, Artificial Sequence
  Synthetic
KDEERVKEVVKKLRKVNEDVRRLIERVSRESKRLDEEVNRELDESAKDTERALRERLGDKEAVDRVRDETRRLAEELKELSERNEKRSRDSAREVEKISRDTEERVKEIEDKVKAGADADEVVKEIEKLAKTSEELARRIVRENEESARESLERARKLVEDDRRLVKEVVERAE

SEQ ID NO: 6881 - protein, 174 aa, Artificial Sequence; identical to SEQ ID NO: 6880
  Synthetic

SEQ ID NO: 6882 - protein, 181 aa, Artificial Sequence
  Synthetic
DLEERLATVVRKVEEDLKKLRRDNEKVIREVEKLNEDLNRRNKKLIDEVRKLLEKAKREGSLRDEEVERLEEELDKSNKRLEEISRKNKKELEESHKRLAEIVKRLKDELEKIKEEVKRVDDEKRVRELLEKIKRLLEEVDRRVKESIKEIEDSLRRSKEKADRSIEEIKKLLDDLRERAR

SEQ ID NO: 6883 - protein, 181 aa, Artificial Sequence; identical to SEQ ID NO: 6882
  Synthetic

SEQ ID NO: 6884 - protein, 181 aa, Artificial Sequence
  Synthetic
SVEDLLRRVVEEVRKELERLKRKNEKVVKEVRKKNKEVNDRNEEVIRRVEKRLKKLKEDGRLSDELVEKLKEELRRSNEELRKISDENEKELEKSNRRLKKIADRVEEELKRIKEELDRVDDEEEVRRLVRRIEKIVDEVRKRVDKSVEEIKRSLKRSKELADESLERIRRLLEEIDERVR

SEQ ID NO: 6885 - protein, 181 aa, Artificial Sequence; identical to SEQ ID NO: 6884
  Synthetic

SEQ ID NO: 6886 - protein, 179 aa, Artificial Sequence
  Synthetic
SSDEELKKVLEDMKRVLEKVREDMKRVNDELKEAVERVKKESDDVDRELRRVIEEVVREDTDDEDLKRELDDIHRRNREHTERLLDEARRLLEDSKRHTEETEKTLRRLLEDLKRKIERKEVDVKDLVRTVERLVEEIKDLVRKDVERVKKIVRRIEDLAKKDVEVSEKLVKEIKDRAK

SEQ ID NO: 6887 - protein, 179 aa, Artificial Sequence; identical to SEQ ID NO: 6886
  Synthetic

SEQ ID NO: 6888 - protein, 179 aa, Artificial Sequence
  Synthetic
SAKELLDDVAKKLEEVVERVARKLDEVDERLREMIERVRKELEDVNRRLRDLVRRVVDKDRTDEDLKKRIEDLEERLRRHTEETVKRAEDIHRENREKLREMKETLKELRDRLKEILDRNELRVEEVVRDVERIVDEIEKRAEKVVRDSEKLVRDIEELVRRDVREVERIAEEIEKEAT

SEQ ID NO: 6889 - protein, 179 aa, Artificial Sequence; identical to SEQ ID NO: 6888
  Synthetic

SEQ ID NO: 6890 - protein, 179 aa, Artificial Sequence
  Synthetic
SADEELERVLRELDKVIKDVVEESRDVDRKLERVVREVERLLDDVDRRLKEVIERVVREVTDKEDLRREAEKIHKENTDRLRELKKELKKLLDDSRRHSKEVEDELEKLLRDLKRILDRKELDVKDVVTEVKKLVETVKRLVEENVKRVEKIAEEIRRLVEKVVRESDELVERIERRVR

SEQ ID NO: 6891 - protein, 179 aa, Artificial Sequence; identical to SEQ ID NO: 6890
  Synthetic

SEQ ID NO: 6892 - protein, 188 aa, Artificial Sequence
  Synthetic
SAEELIRKAAEDARRANKEAEDLIREAAKEARRANEEAERLIREAAKRAEDALRDADRKAREKEAKDRARKLAKEIRDLIKKAEEDAKKSHEETEELIRRAEEEIKKSHEEIKKLIERAEEEAEKKKDAEEEAKKLADDIREAAKRSLDRARELAKRIREAARRSLEEAKKLAEEIKKAAEKALRDAT

SEQ ID NO: 6893 - protein, 188 aa, Artificial Sequence; identical to SEQ ID NO: 6892
  Synthetic

SEQ ID NO: 6894 - protein, 184 aa, Artificial Sequence
  Synthetic
SAVERVVREVKKTVDESRKRAEKEKREVEDVVRRIREKVKRVVDDNRRVVETIKELSKERRDEELLRRAEEEVRRVHERNRDILREIAETIRRVEERLRESLEDSRRESKRVKEELEEVLKEDKSEEAREKLDRVRKELDDANRRVEEELRRVARELEKVLREVEELLRKVDEDIRRVLDEERR

SEQ ID NO: 6895 - protein, 184 aa, Artificial Sequence; identical to SEQ ID NO: 6894
  Synthetic

SEQ ID NO: 6896 - protein, 184 aa, Artificial Sequence
  Synthetic
KDVEEVARKVKRVAERSEELVAELVKKNKKVVDESREKVDDVVRRNKELVDTIRDLARRRKDEDLLREAEERVRRVHEENKKAHTDSKEAIDRLEEDNRRVNEESRRLSKRVKEELKEVLKRDRSEEIRKLAEDVKRELERVNKKVKELSDRAAEELKRVNEEVRKKLEEVDREIRKVLEEVRK

SEQ ID NO: 6897 - protein, 184 aa, Artificial Sequence; identical to SEQ ID NO: 6896
  Synthetic

SEQ ID NO: 6898 - protein, 184 aa, Artificial Sequence
  Synthetic
SLMEEVKKEVDKVVREIKELVRKVEEDVKKVVKESRDKVDKVVKENKKVVEKIRDLARRRTDEDLLREAEDEVRKVHEENKRIHKESEDTIREVEKKLKKVLDDIERLVKEVSDRAKRVLDDDRSDEIRKLIKEALDKLKEVLDEARDRLKKVKEELETVNREVEKLLRDVDREIEKVLKEVEK

SEQ ID NO: 6899 - protein, 184 aa, Artificial Sequence; identical to SEQ ID NO: 6898
  Synthetic

SEQ ID NO: 6900 - protein, 190 aa, Artificial Sequence
  Synthetic
SEAEKIVREVERVVEESRRVAKENEKEVDKVVDTIRKLIEDLARRVEDILKKIEEERRKGGDDKEKLLEKIKRLLDELRKLIEELERRVEKIVEDVKRHSEELKERSKDLNRRIKEKIEDVLRKLKDDRDVKRIEDLLREVEERLRRVSEEVKKRLKELHERVEEVLRELRKRLRDLERKARKVLEEAKK

SEQ ID NO: 6901 - protein, 190 aa, Artificial Sequence; identical to SEQ ID NO: 6900
  Synthetic

SEQ ID NO: 6902 - protein, 173 aa, Artificial Sequence
  Synthetic
DVKEVLDEARKVVEDSIRRSKELIDEVRKRVEESVEESKRLAETVAEEVREVIERARGRDSAEELKRELDRLIEEIKRSNEKLRRDIKKLEDDVRRSDERLRREIEKIEELIRRGSDIETVLREVKRLVRENVKRIAELVKTIEDLVRENSERVRRVVREIRELVKELEKKAR

SEQ ID NO: 6903 - protein, 173 aa, Artificial Sequence; identical to SEQ ID NO: 6902
  Synthetic

SEQ ID NO: 6904 - protein, 173 aa, Artificial Sequence
  Synthetic
DVDELLKRVEDEVRRSKEESEKLRKEVRKEVEDSAKTSKDLIDDARRTVEEVIKKVKGRDVIEELKERIERLEKTVRDSDKELRERIRELEREIEESNRRLEEDIKRIKKVIKDGADVDTVVERIRKLVKENSDRVREVVDTIKKLVEENVREVRRLVEEIKRLVEEVKRREE

SEQ ID NO: 6905 - protein, 173 aa, Artificial Sequence; identical to SEQ ID NO: 6904
  Synthetic

SEQ ID NO: 6906 - protein, 173 aa, Artificial Sequence
  Synthetic
DVKEVLKRAEEEVRRSIKRTREVLERVEKMVRDSSRTTTDLIRKVRREVKRVIDEVNGRDLARELKRMLDELDERLKDSDRKLKEKIDRLIKEIEESDDELRRTIEEIKKLIDDGTDIDTVLEDVKRLVKENSEKIDEVVREIRELVETNRKLVEDLVREIKELVEKALRDAK

SEQ ID NO: 6907 - protein, 173 aa, Artificial Sequence; identical to SEQ ID NO: 6906
  Synthetic

SEQ ID NO: 6908 - protein, 173 aa, Artificial Sequence
  Synthetic
DVKEVLKRAKDEVRRSSDRTRRLIEKVRDESERVVEEVKKLNEDVNREVERVIREVKGRDVVEEVRRRVEKLNRDNEKIIKEDRDALEEIRRRLEESDKRLEDVIREIEKVIDDGKDIDTVLREVEKLVRDNERLVEKLVKEVEDSVRETKKRVEESVDTVRRIVEELKRRAT

SEQ ID NO: 6909 - protein, 173 aa, Artificial Sequence; identical to SEQ ID NO: 6908
  Synthetic

SEQ ID NO: 6910 - protein, 178 aa, Artificial Sequence
  Synthetic
SEAEEVLREVKEVVDRSRELAERVLRAVRELVKRDEDLARKILEDVARVVKTIDDLARERSDEEVLRRVKRLVDELRKKLKKVLEDSARLAEDLRRKAEEVKRESKRLSDELREKAKKAGVDKEVVDRADRALREVNKRLDEVVREVEKLLRESLDRSRRVIEEVAKRLEEVLKKLED

SEQ ID NO: 6911 - protein, 178 aa, Artificial Sequence; identical to SEQ ID NO: 6910
  Synthetic

SEQ ID NO: 6912 - protein, 178 aa, Artificial Sequence
  Synthetic
DEMDEVRREVERVVREDEKLARDLKRRVEKVVEDIKRSADEVLKEVKKLVEEIRELMKKRTDREVLERVRRKVEELTRELERNHREIEELVRRVKRELEKALKESEDRVREVKERLERAGVDREVVRRVEEELERSLRKSREVVKRVEKELEDVLREHRKVLEEVTDLLRRVLEELRR

SEQ ID NO: 6913 - protein, 178 aa, Artificial Sequence; identical to SEQ ID NO: 6912
  Synthetic

SEQ ID NO: 6914 - protein, 186 aa, Artificial Sequence
  Synthetic
REAEEILKKVAEVVKEDKKLADDLRKKNKETVDDIRRKAEELLKRVKKVVEELKRRMEEGGDDRKKLTDRVEELLRRVEEELKDLKRKIDEIIERLKRDNERVLRRSEDLVRKVEEELKDVIDKSDTDELRKIAEEVRKRLEDSVRTTRDIIRRVKRENEEVIKELERVMRKVREDLKRVKEEIER

SEQ ID NO: 6915 - protein, 186 aa, Artificial Sequence; identical to SEQ ID NO: 6914
  Synthetic

SEQ ID NO: 6916 - protein, 178 aa, Artificial Sequence
  Synthetic
SREEVAKEVRELIARSEKETRDIIREVEDRMRRSKEETEEVIKEVKRLLEEVKKRLEEKGISEELRESVDRVEETVRRLLTKLREDSERLRRRLRKLLEEIRRESERLKEEVERLIRRNEGDAEEILRTVKKVVDRDRELAKRLLDEARELVRTNRELVKRVLETVTRLVKKIDDEAR

SEQ ID NO: 6917 - protein, 178 aa, Artificial Sequence; identical to SEQ ID NO: 6916
  Synthetic

SEQ ID NO: 6918 - protein, 178 aa, Artificial Sequence
  Synthetic
DEEEVEKRVKDLLRESTERTKEVNERVRRLAEESRKRTEEIIREVRRLAEEVEERLRRRGIDEELKRRVEEVKKRLEELLTDLKRRSDELRKRLEDSSRETEKKSREVVKTVDELRKRREGDVRELLETVKKLVKDDVDIVRRNLEEVKKLVETNVRLAEEVLKEVDRLVKKVEEDAR

SEQ ID NO: 6919 - protein, 178 aa, Artificial Sequence; identical to SEQ ID NO: 6918
  Synthetic

SEQ ID NO: 6920 - protein, 184 aa, Artificial Sequence
  Synthetic
DELDEIRKRVEELIKRSEEDSREVRRRLEEIIERNRKISRDVEREIEKLIKDVRDSNTTSEEAKELLKDIRRKLKELVDRLHKIDEDSLREVERLVKRLKDKNRDILRELEELARDLRRRLRGEELRRVEEVVKRVRELVERSKEETDKIAEDVRRLLKESNDDTERIKRKVEEMLKELEERIK

SEQ ID NO: 6921 - protein, 184 aa, Artificial Sequence; identical to SEQ ID NO: 6920
  Synthetic

SEQ ID NO: 6922 - protein, 178 aa, Artificial Sequence
  Synthetic
RELDEVVKTVRKLVDESKKESDDVAREARELLEKLERESEEVVRRVRELVKELKKKRDDERLDRVVKDILKKVEDLIRELREVNKETRKKVERLVKELERVNREIRERVERIMDVLRRGDVDVDEVLRKAKELIDDSRRLIEDVKRRLKELIDRDRRLIERVLEEAERLIRELDEEAR

SEQ ID NO: 6923 - protein, 178 aa, Artificial Sequence; identical to SEQ ID NO: 6922
  Synthetic

SEQ ID NO: 6924 - protein, 190 aa, Artificial Sequence
  Synthetic
KEIEELDKMVEDIVRELDELVRAHTETVDRLIRDLERSNEELRKLIKKIVDELEDLVRRGGDDKERLLREIKRLVDDLKRLVEKNTRDIKRMADELRETAKEVEERIKELIKRLEDLARDILRKRKDDEEVVRRLKDVERKVKKLAEDVKEKLRRSVERVTKLLKEVEDNSREVEKEAEERVDRVLKKVK

SEQ ID NO: 6925 - protein, 190 aa, Artificial Sequence; identical to SEQ ID NO: 6924
  Synthetic

SEQ ID NO: 6926 - protein, 175 aa, Artificial Sequence
  Synthetic
REVEELVERIERSSRRALERLEDLDRTIKKSSEDARRRLKEMDDRLEELVKRARDNGVDEEVVKEVKKLVEESRRDNEESVKRSEDLLRETERRNRDAIRRSEEEVRKILEVLKKGELREEEIKKVLEEDRKLVEKLERDNKRVLDEDKELVRRNEERNREVLERIRELIERART

SEQ ID NO: 6927 - protein, 175 aa, Artificial Sequence; identical to SEQ ID NO: 6926
  Synthetic

SEQ ID NO: 6928 - protein, 179 aa, Artificial Sequence
  Synthetic
DEVEKLIKDIRDIIRRVEEAVARLVEENNKLVKEVDDRLRELSKENRDIVRKVREGGVGDEVLEKAEDSSRRNDEDVKKLLTELRKSSEDLKRLVDDVRKKLEDKVRRLEEVVRKELSDKRTLLEEAKRVLEDIEKEARDLLRRLEEIIRRTRKLVKDILDRSRDILRRTRELVDRVRR

SEQ ID NO: 6929 - protein, 179 aa, Artificial Sequence; identical to SEQ ID NO: 6928
  Synthetic

SEQ ID NO: 6930 - protein, 179 aa, Artificial Sequence
  Synthetic
KEAEDLLRRIEDLIRKVKKEVEDLVRENNRLVEKVVRELEKLSDELRKLIKRIKDAGVSDEVLRRLEEIVKRNDEEVRKILEEAKKSSRRLEETMRKVLEDLRRLVERLKRVVDEELQDKETLLRDIERIRREIEKLIEELLRRAEEIIRDTERLVEKILRESKELLKEIRELAEREKQ

SEQ ID NO: 6931 - protein, 179 aa, Artificial Sequence; identical to SEQ ID NO: 6930
  Synthetic

SEQ ID NO: 6932 - protein, 184 aa, Artificial Sequence
  Synthetic
DLERVVEESSRLVERVVRRNKKVVEDIRRRVREVERKNEEVTKEIKKILDEVRRRLERDGADSTLLRELEEVIKEAEKRHKDSIDELREILKELEKRHRKSIRELREINKDLRRRVKDLRDKGGIREELKKLLERSREMLEKSERTVDTSREEAKRVLEESEELVERTLREVEEIIRRVIERVR

SEQ ID NO: 6933 - protein, 184 aa, Artificial Sequence; identical to SEQ ID NO: 6932
  Synthetic

SEQ ID NO: 6934 - protein, 184 aa, Artificial Sequence
  Synthetic
SLEEVLRAVRKLAEDVKRKNKEVLDRIRDSSRRSEEKLEDSLRKIEELVRKLEEELKRDGADERLAEELREILDRVRKEHKRLVEENRRVVKKVEDEHRKSEEELDRIVDELRRRVEELRKRGGVDEDLKRLLEEIKRVLEESEEKVERSLREMEEVDKETEKRSRKLNREVREVVKDVADKVR

SEQ ID NO: 6935 - protein, 184 aa, Artificial Sequence; identical to SEQ ID NO: 6934
  Synthetic

SEQ ID NO: 6936 - protein, 181 aa, Artificial Sequence
  Synthetic
SRLEDLLRKVKKVLDEIRRTIEKSLEDVRELIKRIERTIEKLLERSRDVVRRVLEDAERRRRKELVEELEKELRRIDEEVEEEVRRLIEELERIVRESEKLSDKLIRDLERIVKRLAEEVDSEKAKEVLKEVKDRVDEVAKELTDVNRDIRRIVDELRRRAEKVVRESRELSRELREELEK

SEQ ID NO: 6937 - protein, 181 aa, Artificial Sequence; identical to SEQ ID NO: 6936
  Synthetic

SEQ ID NO: 6938 - protein, 181 aa, Artificial Sequence
  Synthetic
SELERLLEEVEKELRKIERTITELLRRSRELLEEIERAIKESLRDSERLLREIEDTVRKRRREEIVDKLVKDLERLDEESKKLSEKLARDLDKANKRVEDTVRELIERLKEIVEELARRLDESKVREVLREVRERVKEVVERLKRVVEESRKRSEEVKKKLEEVNRRSEEESKRVKEELKK

SEQ ID NO: 6939 - protein, 181 aa, Artificial Sequence; identical to SEQ ID NO: 6938
  Synthetic

SEQ ID NO: 6940 - protein, 182 aa, Artificial Sequence
  Synthetic
KLEEVLRTVRKLVEDLREELERVVRTSRELTRRLEEELKEVVKRSEDLSRRLEEILKRDAREDKDLVTEIKRRLEELNRRNRELVKELLRLLDEVDKDLKRLVEELLRELEKVIKKIKDLVDNNVDLTEALKEVKRLVDEIRKTIEEALRDSKRLVDEIRETIKRSLEEVEKEVRKAEERIR

SEQ ID NO: 6941 - protein, 182 aa, Artificial Sequence; identical to SEQ ID NO: 6940
  Synthetic

SEQ ID NO: 6942 - protein, 182 aa, Artificial Sequence
  Synthetic
SIEDVLRAVEKLLRDLKRRSEEVVKHSETELRRLLEEVRRVLEHSREALERLEERIKDVREEVIKRVKELVEKLKKENEDLLTDVRRLLEELKRRNKELTERTKELLDRLKEEAEKAKRDNVSDEVIKEILERVKKLIEEIDERNKELNERTKELIKRIKDRLKELNDKTEKAIDKIRKEVE

SEQ ID NO: 6943 - protein, 182 aa, Artificial Sequence; identical to SEQ ID NO: 6942
  Synthetic

SEQ ID NO: 6944 - protein, 182 aa, Artificial Sequence
  Synthetic
SIEEVLREVEELLKELEKRARDVLRHSEELLRDVIRRSEEVVKHSEDLLRKLKEAAKDVREEVIRDVDRLVRELKERNRKLSDDSRRRVERLKEENEKLLKEVKDLVEELKRRAEKLSRDNVSDEELKKILDEVRKVIKELEDKLRKLNKKTEDVIRELIERNDRLNKDTKRVIDELKEKVR

SEQ ID NO: 6945 - protein, 182 aa, Artificial Sequence; identical to SEQ ID NO: 6944
  Synthetic

SEQ ID NO: 6946 - protein, 182 aa, Artificial Sequence
  Synthetic
SIEEVVEEVKELLERLIRRSEDVLRHSKKLLEELERKSERVVEHSEDLLRKLEEKIKDVKDDVIRKVRELAKKLRTENEDLSRRSREVVKRLKELNEKNLEEVRRLVKKLKEDAERLARNNVDDETLKRILEEVREVIKKLIKSSEDVNRETEELIRRLEDRNRKLNEKTEKVIREIEEEVK

SEQ ID NO: 6947 - protein, 182 aa, Artificial Sequence; identical to SEQ ID NO: 6946
  Synthetic

SEQ ID NO: 6948 - protein, 182 aa, Artificial Sequence
  Synthetic
TVEDVLRELRERLKESEKRDRDSVRKAEELLRRSEKRTDDVVKHSERLLEELEEAVRRIRGDELKTEVEEVRKKIRRSLEELKKHSKEVVDEIRRLLEESERHSKEVVEDIERKLESLRRIEDEDVVRRLLEEVEELLRRNVKKSEELLKEIRERLEDNIRKVEKVNRDNKREIEEILRRVK

SEQ ID NO: 6949 - protein, 182 aa, Artificial Sequence; identical to SEQ ID NO: 6948
  Synthetic

SEQ ID NO: 6950 - protein, 182 aa, Artificial Sequence
  Synthetic
TVEEVLKEAEDLLKESKERSEDSARRAEEILRRSEERTRKVVEHSREMARRLMEKVKEKRGDELKEEVERVLRRIEKSLEELRRHSERVKEEIRRLLEEDKKHSDDVVKTIRELLERLKRIDDEKVVEDVLREVEKLVRDNIEHSKRLLDEIRRRVEENIRRVDEVNKRNEELIREVEERVR

SEQ ID NO: 6951 - protein, 182 aa, Artificial Sequence; identical to SEQ ID NO: 6950
  Synthetic

SEQ ID NO: 6952 - protein, 185 aa, Artificial Sequence
  Synthetic
SKVEEILERVKRLIEENIKRSEEILEEVRRLIRENTEVSKKLLEEVKREITELEKEVREDRDKDRLRKKVEEVKDKIRKELKRNEDHSRRVAEEIRRLLRENERHSKRVADEVDRVLKELDKTTKDERVKDVLRRLKKIVDESKRRSDKVNKEIEDRVRESEKKSRKVNEDIKRLVKRVADEVER

SEQ ID NO: 6953 - protein, 185 aa, Artificial Sequence; identical to SEQ ID NO: 6952
  Synthetic

SEQ ID NO: 6954 - protein, 185 aa, Artificial Sequence
  Synthetic
SDIEDLLKKVEDLIRRNIETSRRLLEEVRKLIEENIRLAERILEEVRRLIEELARLTREDRDKDELRKKVEEVEKTVKDVIDDLRRHSDKVEEDIKKLLDDNRRHSEKVMREIEKVLKELRDRDNDEKVKDALRRLRDLIRRSKEDSERVNEEIKDIVRKSRETSEDVVRRARELLDKVRREVEK

SEQ ID NO: 6955 - protein, 185 aa, Artificial Sequence; identical to SEQ ID NO: 6954
  Synthetic

SEQ ID NO: 6956 - protein, 185 aa, Artificial Sequence
  Synthetic
SELEELLKEVAKLIKRNKDRVRKILDEVRKLIKRNEDVSRRLLEDVERLIKELEREVREDRDKDKLKRKVEEVRKRIEEVLRTNERHSREVAKEIKKVLDELREHSEKVARDIKRMLDDLRRKTRDKKVEDILRTLEELIRESERTSEEVLRELREEAEESKRKSKRVNDRIRELVEKVDREVDK

SEQ ID NO: 6957 - protein, 185 aa, Artificial Sequence; identical to SEQ ID NO: 6956
  Synthetic

SEQ ID NO: 6958 - protein, 185 aa, Artificial Sequence
  Synthetic
SKLERLLEEVEKLIRRNKRIVREILREVRELIERNIRVSEEINRRNRRLIEEIRRLVEEDKDKEKLRKKVEDLAEKVRESLERNEKHSREVEERIKELIRRLREHSEDVRRRIREVLKELAKTTDDERVKRILKEIERLVEESKRESERVLEEIKELVKDSKRRSKEVNDHSKKLVDEVREAVKK

SEQ ID NO: 6959 - protein, 185 aa, Artificial Sequence; identical to SEQ ID NO: 6958
  Synthetic

SEQ ID NO: 6960 - protein, 178 aa, Artificial Sequence
  Synthetic
SRIDELLKEIRKVTEKTRRDVERLLEEIRKVTDKSRKDSERSLDEARKVLDTIRKLLEDGKPKEKLLKELRDLLRRIEERNERILRENKRIVDEIKKEAEKLLKRNKEIVDEVAERAARDGVGEALERIKRSSEELAEEVKRVLDEVRRSSEELEKRARDSLRELRELVKRVEEEARK

SEQ ID NO: 6961 - protein, 178 aa, Artificial Sequence; identical to SEQ ID NO: 6960
  Synthetic

SEQ ID NO: 6962 - protein, 178 aa, Artificial Sequence
  Synthetic
SRIEKLLDEIRKVSKKSIDEVRKILEEVEKVTRDSIRKLRKLLREIEKVLEEIERLLKNGRDKDELVRRLEEIAKKIEEDIKKILEENRRIVREVKERLKAIVRRNEEIVDDVLKKMAKDGVGEALKRIKELSDEVREEVKKVLRKIEESSERLEEEAKKVLDTVRELVERVARRAKE

SEQ ID NO: 6963 - protein, 178 aa, Artificial Sequence; identical to SEQ ID NO: 6962
  Synthetic

SEQ ID NO: 6964 - protein, 179 aa, Artificial Sequence
  Synthetic
REAEEALRRVEEVVRRSKTELKKLLEDVRRLIEESERELRDLLRRVEEVIRRIREELRERKTEEVIKKIEKLVTDVREEVKRLLDRDRKIVTDIKRKVERLLEENERLVERVREEAERDLREVKEMLRTVDELLKDSERDSERVLREIEELLERSKRKSEEVLREIERLLEKIEREVRK

SEQ ID NO: 6965 - protein, 179 aa, Artificial Sequence; identical to SEQ ID NO: 6964
  Synthetic

SEQ ID NO: 6966 - protein, 177 aa, Artificial Sequence
  Synthetic
SEVEEVAREVDELVKESRDESRRIVEEAKRLLKESNKSVKDIERDARRLVKEVEDAVREEELKRLVDELRKRAEELVDESRKLDEDLRRRLDELVKRMEEINEELERRVRRIKELLKRGMDVKKVLDEVRELAERSKDLNRRLLERIRELVRRSKERNKELLKRLRDLVERVKREIK

SEQ ID NO: 6967 - protein, 177 aa, Artificial Sequence; identical to SEQ ID NO: 6966
  Synthetic

SEQ ID NO: 6968 - protein, 177 aa, Artificial Sequence
  Synthetic
DEVEEVKKDAERLNKELHESLRRSNEEAKRLLKESKDASREVVKDARRLTKELRETMNDDRVRDLVRRNEEVVREVEKTLERINEELERMVRRLVREDEKLNEDNKRKLDEAKERLRGGSDVEKVLRDLRRLTEETKRRNRETLEEIRRLIERSKEEIKRLLEELRELTKRTKDRIR

SEQ ID NO: 6969 - protein, 177 aa, Artificial Sequence; identical to SEQ ID NO: 6968
  Synthetic

SEQ ID NO: 6970 - protein, 177 aa, Artificial Sequence
  Synthetic
DEVKEVKDRARKLVEEVKRAVDEVRKRADELNKEVHESLRRSNREAERLVKEVEDTVREERAERELRRLEDRVREVVERDKKINEDNKRVIDELTKRLEDLVRELERVVREIEDRLRRGADVETVLREITELAKKILRDIEELLREITKITEESKRENEKSLRELEDLARRVKEKTR

SEQ ID NO: 6971 - protein, 177 aa, Artificial Sequence; identical to SEQ ID NO: 6970
  Synthetic

SEQ ID NO: 6972 - protein, 177 aa, Artificial Sequence
  Synthetic
DEVERLVEELERLLREVRDSVRRSNTEAKELNKEVHEAIRRVVEEARRLLEEVRRTADDEDVRRILKRLEEVIREIVERLKEINDRNRRVVEEVAKEDEKIVRELEKLVEEVRKVLKDGVDVETVLRRVEEVARRVKKLNEDTLRTLRRITEDSLRKIEKLLRDIEKLVREVVERLR

SEQ ID NO: 6973 - protein, 177 aa, Artificial Sequence; identical to SEQ ID NO: 6972
  Synthetic

SEQ ID NO: 6974 - protein, 180 aa, Artificial Sequence
  Synthetic
SEIEDLERRIKEVVDDLRRLVEENSKKIDDLLRRLKDLIRKVEEMNRKLIREAEELVREERSEELVREAEELVKTVHRENKRVEDEIRRLVEEVERHSEKVIRDIERLVRTIEEEIKSLPDSEELRKVEESVRRLAEEIKKELEDSRRRVEELVREIEKELEDVNRDARRLVDKVREELR

SEQ ID NO: 6975 - protein, 180 aa, Artificial Sequence; identical to SEQ ID NO: 6974
  Synthetic

SEQ ID NO: 6976 - protein, 184 aa, Artificial Sequence
  Synthetic
REVEELKKTLDRLVEESKRESDKVREDAERTVRESEDKSRRVKDEARRSLEEVEEDVKDESAEDILRRVRKVSEDHVKELKRLNDDLRRVSEDHVRTLDKLNEELREMVDRIRKRLDELEKRGGDKDEIKKILEEAEEVVRDSKKKIEDLLRHNKKRVDDSLRKIEEILKHNRDEIERVREEIR

SEQ ID NO: 6977 - protein, 184 aa, Artificial Sequence; identical to SEQ ID NO: 6976
  Synthetic

SEQ ID NO: 6978 - protein, 184 aa, Artificial Sequence
  Synthetic
DEVETVREEAKRLVEESRKESRRVEEELKKLLRRVEEEARKVKEELEKSVDEVRKAVTDKDAKDILKTLEDASRDHMRKLDEIIKRLKEIVEEVKRRLKKLNDELEKVVRDVERTLDDLKKKGGIREEIKKILERVREVVKRSKDEIREILKEVRKMIDKVRKEIKEILDHNKEVVRKIKEETK

SEQ ID NO: 6979 - protein, 184 aa, Artificial Sequence; identical to SEQ ID NO: 6978
  Synthetic

SEQ ID NO: 6980 - protein, 184 aa, Artificial Sequence
  Synthetic
SEVEEVKERAERLVRESEELSDRVRREAEKTIEAVRELVERIRKRLKESVEEVERRVTDKKAEDILRRVRELSKRHVDRLEKILRDVKKLSEDHVRTLEKLNKDLRDMVRKVEKELKELKDRGGVREEIKKLLEEVKRVVDKSKRDIDELLKHNRRKIDEVLRELEEILRHNETRIKEVLDRAR

SEQ ID NO: 6981 - protein, 184 aa, Artificial Sequence; identical to SEQ ID NO: 6980
  Synthetic

SEQ ID NO: 6982 - protein, 177 aa, Artificial Sequence
  Synthetic
SEVEKLLREAEEDVERILKRLEDSMDSNRELVERILETLKRSLDEVEKEIRKIIEELKRRRREEEARKLIEKIKRIIDTNHKLAEDLLRRLERHLRENHREAEELLRRLEELIEDLRRRNVDDKVIKRLEDLLRKVEKVVRDTNRTIKDSIRRVKEVVDTTNREAEKLLRRVEDTVR

SEQ ID NO: 6983 - protein, 177 aa, Artificial Sequence; identical to SEQ ID NO: 6982
  Synthetic

SEQ ID NO: 6984 - protein, 177 aa, Artificial Sequence
  Synthetic
SRVEKLLDEVRRLAEDILRDLERSMRSNEELVRKILEKLKESLESNRRLVKRILERLREERKEELARDLLRKLRKHLEDNHKLAEELLKRLEDHVKRNHERAKELLDELKKMLKELKDRDVDEKVIREVERLIEEVKRVVDDTNRRAEESIKEVRDLVRRTNEEIEKTIEEVDREVK

SEQ ID NO: 6985 - protein, 177 aa, Artificial Sequence; identical to SEQ ID NO: 6984
  Synthetic

SEQ ID NO: 6986 - protein, 180 aa, Artificial Sequence
  Synthetic
REAEEIKKALDKLAEELRELLERSRDTVRKLIKELRDLVRESRRRVKELIDDIRRRVDSKEMEKVLKTATDVLRRNEDLIRRIEKVLREILRKNKELADDIERVLRELEKKIEKLRRDGASREELKRLLEEVERLIERLKERIKRLTEESEKLVRELLKLIEKSTKESEEDVKRLVDEAK

SEQ ID NO: 6987 - protein, 180 aa, Artificial Sequence; identical to SEQ ID NO: 6986
  Synthetic

SEQ ID NO: 6988 - protein, 175 aa, Artificial Sequence
  Synthetic
SEIEDLLRRVRRLIEESEEVIKRVADEVKEIIDRSREKIKRVTEESREIIKRLKKDGKEDRDKLEKLVKELEDKNRESLRDTERLVRELRKLLEESLRLTEEIVTRLEKELRDIDRDRRVEDVERDIRRLVRKLREDNKRIAKTIEDLVRELRELNKRSEDETRKLVKELRDAAK

SEQ ID NO: 6989 - protein, 175 aa, Artificial Sequence; identical to SEQ ID NO: 6988
  Synthetic

SEQ ID NO: 6990 - protein, 183 aa, Artificial Sequence
  Synthetic
SEVERIKKAVEDLVRKLRKVSKETLDESRELVKELKERDKESEKDSRRLAERLRKLLEEKNQTDLRKEVEDVVRDMERSNKESKDKTDEVARELEESNRDNRRKVEEVVERLRRLLEKLKRSTDRKVVKDILDEVKKLIDDIEEHSKRVADRNRRLIEKIKKDTEDVIKRNRDLVTEIEKRIR

SEQ ID NO: 6991 - protein, 183 aa, Artificial Sequence; identical to SEQ ID NO: 6990
  Synthetic

SEQ ID NO: 6992 - protein, 183 aa, Artificial Sequence
  Synthetic
SEVEKIEERVKRLVEELKKSLKESEEETERLARELRDVDRRSKEESRRLAEELEDLLRRRNVDELKREVEKIVRDLDKSNRDSKRLTEKIVEDIKKSNEDSDKKVEDLRKRLEDLLRDLSRSTDDKVVEELLKEIEEEIRKILETNDKVVKENRRLAREILEDTKRVVDRNRELIKRIAERIK

SEQ ID NO: 6993 - protein, 183 aa, Artificial Sequence; identical to SEQ ID NO: 6992
  Synthetic

SEQ ID NO: 6994 - protein, 183 aa, Artificial Sequence
  Synthetic
DEVETIAKEVKELADKLRREVEESRKDSEDLVRKLRESLKESRKRSKDLVDELRKLLERKNTTKLREEVERVAEELKRTNDDSRRKVEDAMRKSKKLNDDLRRRVEKVVEEAKELLKDLKRSTDKKVVDDLRKRVEKLIKEIEEDIERVIRRSRKLIEDILRDNERVVKENEDLIREIEERIR

SEQ ID NO: 6995 - protein, 183 aa, Artificial Sequence; identical to SEQ ID NO: 6994
  Synthetic

SEQ ID NO: 6996 - protein, 183 aa, Artificial Sequence
  Synthetic
SDVERVEEELRKLLKEIEDSVRESERRLEKLLEDLKRSTEKTKKELKELIDRLEERVRERGDEEVKRVVEEVAKRAEDLLRESEELVREVAKRLRELLEESRRLVREAAEDLKRLLEELKRLTDSERVKEILERVRKLVEDVLRRNKRLVEEVERLIEEILRVDERIVREVRELIKRIEERIE

SEQ ID NO: 6997 - protein, 183 aa, Artificial Sequence; identical to SEQ ID NO: 6996
  Synthetic

SEQ ID NO: 6998 - protein, 183 aa, Artificial Sequence
  Synthetic
SSVEEVKKTLEDLLRESDKSVRESERRLRELLRESDESVERSRKTLEDLIRELEDLVRKRGDEEVKKEVDRVAEEAKKLLEDSKRLSDDLRRRLKELLEESEKLSRTLKDLLRRVLEELRRLTDDREVEKILREVTKLIEESLRRDREITEEVRDLIKKSKEKDKEIVDTVRRLIREIKERIR

SEQ ID NO: 6999 - protein, 183 aa, Artificial Sequence; identical to SEQ ID NO: 6998
  Synthetic

SEQ ID NO: 7000 - protein, 183 aa, Artificial Sequence
  Synthetic
RSVEEVVKTLEDLLEKLERSVRESEERLKKLLAESDDSVRKSAEELRRLIEELKDLVRREADEEVERTVREVAKEAEDVLEESKRLSDKLAERLKELLDRSRRLVEEVAETLRRLLEELKRLTDEREVKRLLDEVERLIDEIRERDKDIVREVDKLIKDSKREDKRIVDDVRRLIEEIKRRIK

SEQ ID NO: 7001 - protein, 183 aa, Artificial Sequence; identical to SEQ ID NO: 7000
  Synthetic

SEQ ID NO: 7002 - protein, 183 aa, Artificial Sequence
  Synthetic
SSVEEVKRELEKLLEDSDRSVEESKKTLRRLLEESNKELRRVAERLKDLIRELKKRVKERGTEEVARTVDTVAREAEKVLDKLREDSERLAETLKRLLEESERLSRELAKTLRELLERLRRLTDDREVEEILRRVRKLIEESKTMDKKIVDDVRKLIEESLRDIERIVEDVERLIKEIKERIT

SEQ ID NO: 7003 - protein, 183 aa, Artificial Sequence; identical to SEQ ID NO: 7002
  Synthetic

SEQ ID NO: 7004 - protein, 183 aa, Artificial Sequence
  Synthetic
SSVETVEKELRRLIKELRDSVKKSEDDLRRLLEESNRLVREVERRLRELLEKLRKLVEERADERVEDEVRKVAERLKKLLKELKELSEKLARDLKRLLERSKRLVEEVEKELRRLLEELKRLTDDREVKRILDEVKDRIRRILREDEEIVKEVRRRIKRSEEAIREIAREVDREIEDIERRIR

SEQ ID NO: 7005 - protein, 183 aa, Artificial Sequence; identical to SEQ ID NO: 7004
  Synthetic

SEQ ID NO: 7006 - protein, 174 aa, Artificial Sequence
  Synthetic
SEVEELEERARKLLEDVERLTREVEERAKELVKRVKDSSKRSEDEIRRLLRKLLETSGDNEEVRDVEERAKRVVEESRESNKKLEEDLRRLVEELRKSNEELKRRIEEVRKVLADGKDVEKVIRTLEEEVRRDEEKIREVLERVEDLIREDLRRDEELVKELEKLIREVDEKER

SEQ ID NO: 7007 - protein, 174 aa, Artificial Sequence; identical to SEQ ID NO: 7006
  Synthetic

SEQ ID NO: 7008 - protein, 174 aa, Artificial Sequence
  Synthetic
KEVEDLEEELKKLLKEVKTRTEKVVRDAEKSVRDLEKSSRDSDRTLKDLLRRLMETTGDNEIVEELTRRLKKLKEESDKSNEDHDRKSKKLVKRLEDSNKRLEEEARRLRKVLDDGKDVKKVLDEVRRLVEEDKKRIEEVLKENRESVKRDKELDDRLLERVRELIERALERAR

SEQ ID NO: 7009 - protein, 174 aa, Artificial Sequence; identical to SEQ ID NO: 7008
  Synthetic

SEQ ID NO: 7010 - protein, 174 aa, Artificial Sequence
  Synthetic
SEVERLEEEAKRLLEELKRLVERVVREAERSVEKVRDSVRRSEEEARRLLEEITKDDGRNELVETLERLAEELVRRSKKLVEEHEKRSRDLVRELEELVKRVEEKIRDVVRKLRNGKDVDKVVEDLKDDIRKVKKRIEEVLDENRKSVRKLDEDDRRLVDELRRLVKEVKDKVR

SEQ ID NO: 7011 - protein, 174 aa, Artificial Sequence; identical to SEQ ID NO: 7010
  Synthetic

SEQ ID NO: 7012 - protein, 177 aa, Artificial Sequence
  Synthetic
KEVEDLKEELKKLVEELERLVEKNVREARELVKRSEEESRRVAETARRLVDEIRRAGLDEEVVRRLKEVVDDVIRKLKELDDRLRDVVRKVEEENERLVRELRKVVKRVVEELEKTTDRRTITELLKEVEELVKRVLDAIRKSNREVEKLVRESLRRIEKLLREVEKLVKELLERRK

SEQ ID NO: 7013 - protein, 177 aa, Artificial Sequence; identical to SEQ ID NO: 7012
  Synthetic

SEQ ID NO: 7014 - protein, 177 aa, Artificial Sequence
  Synthetic
DEVERLEEELKRLVKEIEDSVRESKKEAEETLRESRKLSREVEERARRLVEELKRKGVPDELVKRLEEVVREVKKDLERLDEEHERKSEEIVRRSEKLVEDLRRLAEEVVRRLRRTTDEREIRELLEEVRKVVEEIKRRDDELVKENRRSIEESKRRIEELLKEVKELVERVTDTER

SEQ ID NO: 7015 - protein, 177 aa, Artificial Sequence; identical to SEQ ID NO: 7014
  Synthetic

SEQ ID NO: 7016 - protein, 177 aa, Artificial Sequence
  Synthetic
RDVEEVKKEAEELVKKSEESVRRSKEELERTLKRSREESERVKETAKKLVEKIERDGIPDRLVKELEDAVRRIAEELDKLDKDHEDKSKKIVDDSKKNLDELREFVRRVADELDKTTDKETIKRLLDEVRKLVEDSLRHDEELVERNKKSIKDSLDEIERLLREIEELVRKVEEDER

SEQ ID NO: 7017 - protein, 177 aa, Artificial Sequence; identical to SEQ ID NO: 7016
  Synthetic

SEQ ID NO: 7018 - protein, 177 aa, Artificial Sequence
  Synthetic
SDVDRVKEDAKRLVEESKRSVDESAKDMRRTLKRSRDESRRVKEELKRLVDRVKESGLDDKVVRELERAVRRVEEDLKKLNKDHEDKSRELIKRSEKNVRELKKVVEDVAEELDRTTDKDEIRELLERVKKLVDESRRHDKRLVEENRRSARDSLREIERLLREVRKLVEKVLRDRK

SEQ ID NO: 7019 - protein, 177 aa, Artificial Sequence; identical to SEQ ID NO: 7018
  Synthetic

SEQ ID NO: 7020 - protein, 177 aa, Artificial Sequence
  Synthetic
DEVETALEEVKELLERVLRKIEDDLRRVRDLLEKLKRTNEELLRKVREEVRRLADLIRKRRTEDVERELERLLDELRREVERVERENRKIVDELEKHTRRVVEEIKETLRELDRKVKEMNLDETVKREIEKARETLERLLKRSEEEVDRVKKEVEEISRRVKKEVKKLVDEIRERLR

SEQ ID NO: 7021 - protein, 177 aa, Artificial Sequence; identical to SEQ ID NO: 7020
  Synthetic

SEQ ID NO: 7022 - protein, 177 aa, Artificial Sequence
  Synthetic
RRVEEVAKELKRIAEKLKRDIEELLRDDKRLADELRETNKELLRKDKEILDRLAEEIKRRRTDEVREELERRIDESKKEVDEVVKENDRIVKESEERVKDLEKELEERLRRLKEKLKANRVDETVDRKIDELAERIRRLLEKVKRHVEETKRDVRRVSEEVRKHVEETKRDVRRRLK

SEQ ID NO: 7023 - protein, 177 aa, Artificial Sequence; identical to SEQ ID NO: 7022
  Synthetic

SEQ ID NO: 7024 - protein, 182 aa, Artificial Sequence
  Synthetic
SRVEDLVRRIRELVRRDLKRIKDLEEEIKRLAEEIERHSKKVVDELKELADRLRKMLEEGNLREEDIDRVRKEMERLLEENKRESDKLVRRLEELVKDSERHSARVVEELEKLVETIRSEGVEKEKVDDIRREVKRVVRESEEANKRVRKLVEDIVKRAEDSNRRVEELVRELVEDLKRAAK

SEQ ID NO: 7025 - protein, 182 aa, Artificial Sequence; identical to SEQ ID NO: 7024
  Synthetic

SEQ ID NO: 7026 - protein, 182 aa, Artificial Sequence
  Synthetic
SEVDELLKTIEKLARDDVKKIREVVEENKREVRRLEEHSKEVVKEIKDRIKEVLELLRRGELRRKDVKKVEEELEKLVRENKERSKEVVRRMRESNRRSEKHSRDLVRELRDRLREIAERGVEERVLERVERLVRRLAEESRRANEKSKEDTKRLEDRLKKSNDDLEKLVRDVVTRVREEAD

SEQ ID NO: 7027 - protein, 182 aa, Artificial Sequence; identical to SEQ ID NO: 7026
  Synthetic

SEQ ID NO: 7028 - protein, 182 aa, Artificial Sequence
  Synthetic
DEVKELEKRIRKLVREIEEHSKEVVKENRRLVEEDLETIKEVLREIKRRIKKLLELLERGELRREDVKRVEDELKKLLEDSKRHSEDVEKKLKESNDKNEKKSEEVVRELEDLVREIAERGVEKDVLKTIKDTVEELVERLKRSNERSREETKKLVKRSREANKRVEDLVRKVVKELREAEK

SEQ ID NO: 7029 - protein, 182 aa, Artificial Sequence; identical to SEQ ID NO: 7028
  Synthetic

SEQ ID NO: 7030 - protein, 182 aa, Artificial Sequence
  Synthetic
EEVERIVKEIRDLAEKDKEHSKRVEEEIRRLVEEVERHSRRVEEEIRRLAEELKRLLDRGELRDEEVRRVVKEIEDLVRRNKEETRKVVEDLKRLVEENKRHSDEVVRRLEKLVEDIKRKGLPEEKLEDLERKVRKLADESREVNDRLRELVERVVRRLEEVNERLERLVEELRRRLEEAKR

SEQ ID NO: 7031 - protein, 182 aa, Artificial Sequence; identical to SEQ ID NO: 7030
  Synthetic

SEQ ID NO: 7032 - protein, 182 aa, Artificial Sequence
  Synthetic
DEVEELVERIKRLVERDEREIKRVEDEIERLVRRVDEHSKRVEEEIRRLVTELMELLDRGELRDEKVKEVVKTAKELVDRNKRETDEVKKELDKLVEDIRKHSKDVVDELKDLLRRIKSRGVEERVVEKVRRLVDKLAERSRDLLRKLRDLVRRVVKRLEDVNRRLEELVRKLAEELKEKSR

SEQ ID NO: 7033 - protein, 182 aa, Artificial Sequence; identical to SEQ ID NO: 7032
  Synthetic

SEQ ID NO: 7034 - protein, 188 aa, Artificial Sequence
  Synthetic
SEIEKILDDIRREAEKDLRLSEKIVEDIKRLAERDIKRLREIVEEIEKLLREVSDELRKRKEKEELKKRVEEAEERLRRLVRELEEHSKKVVRDLEELVKKNHDHSRRLKEKMEELVKELRKEMDSEDAERLIREVEKLVRDLVRESEKSNEEVRKLVEDLVRESDKVLKDVKRLVDEVVRRAREEVK

SEQ ID NO: 7035 - protein, 188 aa, Artificial Sequence; identical to SEQ ID NO: 7034
  Synthetic

SEQ ID NO: 7036 - protein, 188 aa, Artificial Sequence
  Synthetic
SRIDEIVKRIEELARRDEEVSREIVKEIRDLAKRDEDTSKRIVEEIKELVKKIKEELERSKDKEKLARKVDELVRRLRELVKRNHDHSRRVVREMEKLVEENHKHSKDVVDTMRDLVRRLEEELDSEDAKRLLDKVRKTVEDLVRRSRKSNEDVRREVEKLVDRSRKSNTTVERLVRKVVRELRETVR

SEQ ID NO: 7037 - protein, 188 aa, Artificial Sequence; identical to SEQ ID NO: 7036
  Synthetic

SEQ ID NO: 7038 - protein, 188 aa, Artificial Sequence
  Synthetic
SRAEEIVERIKKLAEDDKRESDRIVEEIKKLARDIEEAIRRIVKEIRDLVKEVRDVLEREKDKEKLDRKVDDAVRKLEKLVRELKELVDRVVKTAEDLVRENHRHSKEVVETLERLVEELRKEATDERAKELVEEVERLVRELVKDSDRSNKEVRRTVKEIVERAEKLVRDVEEDVERLVRDLKRKVK

SEQ ID NO: 7039 - protein, 188 aa, Artificial Sequence; identical to SEQ ID NO: 7038
  Synthetic

SEQ ID NO: 7040 - protein, 188 aa, Artificial Sequence
  Synthetic
SEIEKILKEIEDLARRDEEVSKKIVEDIRRLAKEVEDTSRDIVRKIEELAKRVLDRLRKDRRKEELEKEVREVVKTLEELVKDNHRLIRRAVEEMKRLVEENHRHSREVVKELEDLVRKLRADSTSEDAERLVREVEDLVRRLVRRSEKSNEEVKRTVEELVRRMEESNDRVRDLVRRLVEELKRAVD

SEQ ID NO: 7041 - protein, 188 aa, Artificial Sequence; identical to SEQ ID NO: 7040
  Synthetic

SEQ ID NO: 7042 - protein, 180 aa, Artificial Sequence
  Synthetic
SEIEKLRKTVERIKEEVKRLSDEHKKRTRELERTSERLVEEHRERTEELRRRIEEIVRKKRDRSLEEIVKKLKELLDKLDKELEDSSRDTKRRLKRLDEDSDRSNKELAERLRRIAELIKAGKDIDTLVEEIKELMKEDSERIKKSVKEVDDLAKEDSDRIRDSVRTVKELADEAIRRAK

SEQ ID NO: 7043 - protein, 180 aa, Artificial Sequence; identical to SEQ ID NO: 7042
  Synthetic

SEQ ID NO: 7044 - protein, 180 aa, Artificial Sequence
  Synthetic
SEIERLEDRIRRLIRDSRELVKTLKKELKEIIERLEELSERLRREIERVVREVEDVVRKRRSDKIEDLVRRLKERLDRIIEESRDLNEKTKRELERVIREIERSSKESEDRAKKIEDLIRAGSDIDELLKKLDEIATRDREKIERLREEIRKIARKDEEDIRKLVKEIRDEVRKLKEDAR

SEQ ID NO: 7045 - protein, 180 aa, Artificial Sequence; identical to SEQ ID NO: 7044
  Synthetic

SEQ ID NO: 7046 - protein, 174 aa, Artificial Sequence
  Synthetic
SEVEELRELVKRLIERIKRVVETNERDLEELIKRVKDAVKKNKEDLERLIEEIDRKRVDERLIRELRKKLERLKEENERLVRDLKRAVDEVVKENRRLVDDLRRKLETVERVLDKGEPIKELLDELKRLIDEVEKKLRESNERVRRLAEEVLRRSKESNDRVRDEARKVKETAR

SEQ ID NO: 7047 - protein, 174 aa, Artificial Sequence; identical to SEQ ID NO: 7046
  Synthetic

SEQ ID NO: 7048 - protein, 174 aa, Artificial Sequence
  Synthetic
DEVEALKRTVEELIKRIRKAVEDNERDLERLLKESRDVVKKNEEDLKRLIEEIERIRVDEKLIRELREVVKKVKKENEDSVKESEEVVREVRKRNRELVRELETIVRRVERVVENGEPIEKLLRELERVIEEIVRRLEDSNRRVRDIARRDKERSKRSNDRVRRLAEEVKERAK

SEQ ID NO: 7049 - protein, 174 aa, Artificial Sequence; identical to SEQ ID NO: 7048
  Synthetic

SEQ ID NO: 7050 - protein, 174 aa, Artificial Sequence
  Synthetic
SEVEELKKLVEELRREIRRLVRENEEDLKKLLEESKRMVERLKELVKKLIEDIRRTRVPDELIRRLEEMAKEVERRLKKSVKESEDELRRVVEENRKLVRDLEKILEDVERVVENGEPIKELVDELKRVADEIVRRIRESNRKVRKIAEEDKTRIKRLLEELERLIADVERRAT

SEQ ID NO: 7051 - protein, 174 aa, Artificial Sequence; identical to SEQ ID NO: 7050
  Synthetic

SEQ ID NO: 7052 - protein, 178 aa, Artificial Sequence
  Synthetic
SEVERLLRELERSVTEVKERVRRLVEELERIVREVKKRVDEHKERNKRALEDVKRKVRDRKDVKEVVRELVERLRRIVEESDKNLRELLREVERLVEDVVRKVEELLKRNERLVEEIKKRGVREEVEKRARKTTEDIKRMADKVTKVAEEVLRRVEKVVEEVREVSRRVVEDIERDTR

SEQ ID NO: 7053 - protein, 178 aa, Artificial Sequence; identical to SEQ ID NO: 7052
  Synthetic

SEQ ID NO: 7054 - protein, 182 aa, Artificial Sequence
  Synthetic
KDVEKVIEDIERILTEVRRHSKEILDRIKRILETIREIVKEVKKRNEDLLREARESNVRSEEVRRIVEEIVRRARRSNEELRRIAEEIVRELDRLVKENHELIREVARRLEKLVEDLVRRRGRDKSVEDARRAVERVVREARRSNEEVKRAVEEVAKELERLVKESEDESRRIVEELKKTVD

SEQ ID NO: 7055 - protein, 182 aa, Artificial Sequence; identical to SEQ ID NO: 7054
  Synthetic

SEQ ID NO: 7056 - protein, 182 aa, Artificial Sequence
  Synthetic
DEVEEVIKRIRDILRRVEEHSEKILREIEKLLRDATRHSEEVKRRNEKILRDAENSRVRSKEAEDIVRRIVEEAKKSNEENHRLIRDLERRLRELVKENHDLIRRVEKELEELVEDLVRKKGNDEDVKRVRDEVKKVVERVRRSNKKVEDMVREVERRLRESNKESREDSKRIVEEMDRRVK

SEQ ID NO: 7057 - protein, 182 aa, Artificial Sequence; identical to SEQ ID NO: 7056
  Synthetic

SEQ ID NO: 7058 - protein, 178 aa, Artificial Sequence
  Synthetic
SEVEKIIDELRKVAEEHKRRVKELVDTNRKVLKEVKDRVRDLVRRVREILKDVSDKARRVTDRKTLEELLRRLKEMVDRVRETAERLLRELERISREHKKEAKRLLETNKRRVEEVKRRVREVDEIKEVLKESEEEVRRMLEELEKELRRSRKTVEELLRRLDKTLREVEEAVKRERD

SEQ ID NO: 7059 - protein, 178 aa, Artificial Sequence; identical to SEQ ID NO: 7058
  Synthetic

SEQ ID NO: 7060 - protein, 178 aa, Artificial Sequence
  Synthetic
DRVEELLKRVREILERVEREARRLVEEVEDVMRRHKEKLEELVRHNREVLREVSREARRTRDKETLKRLLDELRKLSKEHKDEAKRLLESNRRIVERVRERVERLLDELRKEVDKVRKAVREVEEVKKVLKEVEDTVRELVRRLEKKLKESIDTVERLLEELERVLRESNKTVEDETR

SEQ ID NO: 7061 - protein, 178 aa, Artificial Sequence; identical to SEQ ID NO: 7060
  Synthetic

SEQ ID NO: 7062 - protein, 178 aa, Artificial Sequence
  Synthetic
DEVRKILRELREALKRHVEEVKRLLEHNERVLKKVKEDVERLMEEVKRALEDVKRDVDRTRDKETLERLLRRLKTIVDRVRETAKELLDRVRKVSKEHEDALRRLKDTNREIVRRVAERLKDVKEVRKVLRESEKLIDDLLRELKRVLEETNRRVEDLLRRLEEVLRRVEKTVRDRAK

SEQ ID NO: 7063 - protein, 178 aa, Artificial Sequence; identical to SEQ ID NO: 7062
  Synthetic

SEQ ID NO: 7064 - protein, 176 aa, Artificial Sequence
  Synthetic
SLKERLEKVVEESLRRVEEVIKKLERRVEESERRVEELVKTLRDVLRKILRELEKEGGRELIEELRKALRRLDETVKKNLDENRELIEEVRRRLKKHLDDNKKVAEKLKEALKRNSSRETVERLLEEIRELLERSRKNVEDLERRIDKLLEDSERNARELLERIRKELRDISEKRK

SEQ ID NO: 7065 - protein, 176 aa, Artificial Sequence; identical to SEQ ID NO: 7064
  Synthetic

SEQ ID NO: 7066 - protein, 176 aa, Artificial Sequence
  Synthetic
SMKEEIDRVVREVAENVRDMIRRLKRVLEESLRRVDELVKEIKKVLDDVRRRIEEDGGDELIAELDKIAEEVKRNAEKHLERNKRLADEVRKELEKHRKENERLIRELKDRADKNSSEETVKRLVEKIRELNERSLDNVKKLLDRIRELLEESERNVKDIVRRIRDLLRRIKEKAT

SEQ ID NO: 7067 - protein, 176 aa, Artificial Sequence; identical to SEQ ID NO: 7066
  Synthetic

SEQ ID NO: 7068 - protein, 182 aa, Artificial Sequence
  Synthetic
DEVERVLEEIERMLREVEEHTRRVVEEVRRVLEEVKRHSERVVREIRRLLEELRKLVERGEITDEKLREVVKRLDDLVKENKRRSEEVVKRLRELVRRNKEKSRKLEEEAKKLVDDVRRSGAPKDLVRKVEEEVRRVKRELERLNKELEDEVRRIEEAAKRSNEELKKVVDEVKRELEKASK

SEQ ID NO: 7069 - protein, 182 aa, Artificial Sequence; identical to SEQ ID NO: 7068
  Synthetic

SEQ ID NO: 7070 - protein, 182 aa, Artificial Sequence
  Synthetic
DEVDEVLKEIRKVLEDVRKHSEEVLREIERVVREVKKHSRKVVEEIKEVVKRLEDLARRGEIRRKDVEDVVRKLRKKVRDNVETSRRVVEELKKLVKRNVEVVKRVVEEARRLVEEVDKGGVDKRLVDKVRKVVEEVERELKKSVDDVRRVVEEVERRLREVNKEVEDVVREVEERVRRAAT

SEQ ID NO: 7071 - protein, 182 aa, Artificial Sequence; identical to SEQ ID NO: 7070
  Synthetic

SEQ ID NO: 7072 - protein, 175 aa, Artificial Sequence
  Synthetic
DEEKEVEKVVRDVEDKLRRLLEENRDVSRKIKRELEELLKELKRSVDDSKEKLERKLREEDEVVKRVLKTSEDLVRELERLIREVEKDLEDSNRKVEDVVRDLKRRLKEIEKLVRDGADIKTVLEEIKKLAKEAEEEIKRTLERVKKLLEEVRRVVEELLRRNRTLLREIVRKAK

SEQ ID NO: 7073 - protein, 175 aa, Artificial Sequence; identical to SEQ ID NO: 7072
  Synthetic

SEQ ID NO: 7074 - protein, 175 aa, Artificial Sequence
  Synthetic
DEERELEEVVKDIERRSKKVVEDNRRVSEEIKRRLEKLLEENRKSAEDSKEMLRRELREKDEVVRRLLKESDDSNKEVKELIDDLTRRLDKSNEDLKRSVDETKEKLDRLLDLLRRGVDVKTIVTEVRDVVRRDKKKAEDTVRTVKELLDRARKKVEKTIRDNRKVLEEVVRKAR

SEQ ID NO: 7075 - protein, 175 aa, Artificial Sequence; identical to SEQ ID NO: 7074
  Synthetic

SEQ ID NO: 7076 - protein, 175 aa, Artificial Sequence
  Synthetic
SELERVEKVVREVKKALEDLLRRNKESVDRSRTEARRLLEELRESVRRSEEMVRRKLREKDEVVRDLLKKSRKLVEDLRELAERLKRKSEKSNEEVRRLVEKLTEELKDLLRLVEAGKDVEKVLKEIRDLLREAAERVERSIRRNKKVLDDLKEVVERLLKENERLLREIVEDAR

SEQ ID NO: 7077 - protein, 175 aa, Artificial Sequence; identical to SEQ ID NO: 7076
  Synthetic

SEQ ID NO: 7078 - protein, 175 aa, Artificial Sequence
  Synthetic
SAREKLRKVVEEIRRELKRLLEENKKVSDDIRRKLDELLKELEKSVKESIDTLRRDLREKTEVVERVERDSRRLIEELRKLVEDLDRRLKKSNDEVRKVVEELKRTLEELLKLLDDGVDVDTIVKELRELLKRAEEEVKKTSDRVADLVRRAEEVVKKLLRENEELLRRIVETAR

SEQ ID NO: 7079 - protein, 175 aa, Artificial Sequence; identical to SEQ ID NO: 7078
  Synthetic

SEQ ID NO: 7080 - protein, 175 aa, Artificial Sequence
  Synthetic
SEKEKVEKVVDEVRRRLEDLLRRNRESVRRSDEELKRLLKRNKEVSDEIRKRLRRELDKKDEVVRELEKRLEESNREVEKLIRDVVRKSEDSNRRVEKLVRDLLRRLEDILRLVEAGADVKTVLREIRELLKEAEERVKKSIKENEDLLDDVRRKVEESTERVERELERVSREAT

SEQ ID NO: 7081 - protein, 175 aa, Artificial Sequence; identical to SEQ ID NO: 7080
  Synthetic

SEQ ID NO: 7082 - protein, 175 aa, Artificial Sequence
  Synthetic
DEDREVEEVVKEVEERLRRLLKKNEDVSREIEKRLKELLEKNKRSVEKSEEMLRRKLREKSEEVKDLKDKSARSNEEVAEIVKDLKRRLEESNREVEELIRRVRKRLDELLKMVKAGKDVDRVLEEIRELLKRVKEEVERTSRDVKEVLRRAEEEAKRTDDENRKLLEEVVEKAR

SEQ ID NO: 7083 - protein, 175 aa, Artificial Sequence; identical to SEQ ID NO: 7082
  Synthetic

SEQ ID NO: 7084 - protein, 178 aa, Artificial Sequence
  Synthetic
DRSKEVVDRLEEELRKVKEDSKESVDRLRRLLEEVERRAEKSLRDSKEVLRRVKEEAERDRDEKTLRDLLRELKKDLERSDRELADLVRRLKEVVDRIRETNEKLIRDLKRRLEEVLDRNREVRELEKVVRDIIDRVRKMLETSEEVIREVLERVRKVLEENRRVNKDIIDKVEERVR

SEQ ID NO: 7085 - protein, 178 aa, Artificial Sequence; identical to SEQ ID NO: 7084
  Synthetic

SEQ ID NO: 7086 - protein, 184 aa, Artificial Sequence
  Synthetic
DEIERLIEEIKTVLDEIRKEAKRMIDENKRLLDEIRELSERVVEENRRLLEEIRDRAEKRRTEELAERVRRLLRRVEEENKRVARELRELLRKSEEDTRRLVTEVRDRLEKLRERVEELVRRKRVKELADELRKVLKDVRREIEKLVRDAEKSNEDSRREVERLVKRNRESLEEIRKRVEDLVK

SEQ ID NO: 7087 - protein, 184 aa, Artificial Sequence; identical to SEQ ID NO: 7086
  Synthetic

SEQ ID NO: 7088 - protein, 175 aa, Artificial Sequence
  Synthetic
SSKETLRKEVERLEKELKKLVDESRRVLEEVEREVRRAVRELEESVKKSAKRLRDRVRGEEILRRVEKKLKESEELVRRATETLKEVLKRLRESSKEVADRLKEVVERLRREVDKGGDDVEKLIRRVEELLERVRELVKKNIREIEELLERLRRLVEKVIEDDKRMLKEVEEEAN

SEQ ID NO: 7089 - protein, 175 aa, Artificial Sequence; identical to SEQ ID NO: 7088
  Synthetic

SEQ ID NO: 7090 - protein, 185 aa, Artificial Sequence
  Synthetic
REVEELIKRIERLLDEAREHSKEVIRRDEELLRRVRKIIEEIIREIERLLREAEDIARKRGGSDEEVLRRLEEIVRRLRELVERVKRELEKIVEESRRLVEKNEDLSRKLVETLKDLVRRLSRDVSEELLKRIEDVVRRVVEDLKRLNEEIRRSSEETEKELRRLLEEIRKVVEDVERRVRELVK

SEQ ID NO: 7091 - protein, 185 aa, Artificial Sequence; identical to SEQ ID NO: 7090
  Synthetic

SEQ ID NO: 7092 - protein, 185 aa, Artificial Sequence
  Synthetic
DEVREVIKAIRKMLEEAEKHSRDVIRADKELLDKIARHSEEVIKEIRRLLRELEKIAKDKGGESRELEELAKEVVERLKKLVEENVRLSRRIVETSRRLVRENKELSREIVERLEKLLRDLAKTVSEDLLRRIEEEVRRVVEALEKLNRDIEESSRRTEDTARKLNERIREVVEEVMRRVRKLVE

SEQ ID NO: 7093 - protein, 185 aa, Artificial Sequence; identical to SEQ ID NO: 7092
  Synthetic

SEQ ID NO: 7094 - protein, 185 aa, Artificial Sequence
  Synthetic
SEVERVIEEIRKLLEDAKRHSDEVIKTDEDILRKVKKHSEEVIREIEKLLEEIEELARRRGGRDKEVVERLREVVRRAEELVKDNKRRSERVVEESRELVERNRRRSEKLVRRLEELVRRLSRDVDEELLRRLEKLVEDVMRTLKKLNDEIRKSVDETEKTLEELNRRIRKTVEEVRKTAEDLVR

SEQ ID NO: 7095 - protein, 185 aa, Artificial Sequence; identical to SEQ ID NO: 7094
  Synthetic

SEQ ID NO: 7096 - protein, 185 aa, Artificial Sequence
  Synthetic
DEVREVIRRIEKLLEDVKRHSERVIREDRKLLRDAERRAKEVIDEIRRVLEEAKEIVRREGGESKKVKDELEKVVRDLRKLVEDLKREVTEIVKKSDELVKENTRESDRVVKELRELVRRLSRDVSEELLKTITDVVRKVEETLKKLNDEIRKSVEDTMRALKKLVDDLRRVVKEVEDRVREEAR

SEQ ID NO: 7097 - protein, 185 aa, Artificial Sequence; identical to SEQ ID NO: 7096
  Synthetic

SEQ ID NO: 7098 - protein, 185 aa, Artificial Sequence
  Synthetic
DVVREVIKTIKKILDEVRDHTRRSIERNEKLLRDIRKIVEDSIRRNRKLLDDAKKVAERDLSDKESLKRKVDEVIKELKDTLDELRKIAEDVIRELEKTLKENHELIREVIERLKELVARLRSQVDEEMVKTLKKVVEDVERELRRLNKEDEDTVREIAEAAERLVRDDERTVREIEEALKELVR

SEQ ID NO: 7099 - protein, 185 aa, Artificial Sequence; identical to SEQ ID NO: 7098
  Synthetic

SEQ ID NO: 7100 - protein, 185 aa, Artificial Sequence
  Synthetic
DVIRDVEKKIRDILERVREHTKKSIKENRDILDDVRRHTEKSIKENEDILDEVRRVAERDLKDKKTLTDVVRRIERELEKTLERDHRRIREVEKRLEETLRENHELIRDVIRRLKDLVDKLRSQVPEEMVKRAKDVVDDVARRLEELNREDKKTVEEIVETAKELNERDKETVERIRKKLEDLVK

SEQ ID NO: 7101 - protein, 185 aa, Artificial Sequence; identical to SEQ ID NO: 7100
  Synthetic

SEQ ID NO: 7102 - protein, 185 aa, Artificial Sequence
  Synthetic
DAVRKVIEDIKRALEEVRRHTKESIKRNEDILREVEKIARDIIREIRRILERVREVVERDLKDKDTLRKAVEDVIKRLEEILKELEDIVRDVIRRLEKTLKENHDLIREVIKRLEDLVRDLRRKVPEEAVETLKRVVDDVAKKAKELNREDEETVRKIVEELKRLLDELRREVERVADEARRAVK

SEQ ID NO: 7103 - protein, 185 aa, Artificial Sequence; identical to SEQ ID NO: 7102
  Synthetic

SEQ ID NO: 7104 - protein, 185 aa, Artificial Sequence
  Synthetic
SVAEEVIRRIEEILKRVEEHTRESIERNKKLLEEVRKHTEDVIRRIRELLERLERVVRRDLKDKETLRDTARRVVEELEKILEEDHRLVRRVEEELRKTLEDNHRLIREIEERLRRLVEDLKRKVPEEMVKRVKDVVDDVVRRLKDLNETDRRTVDEIVKEARRLNDELRKVVEEVEEKARRDVK

SEQ ID NO: 7105 - protein, 185 aa, Artificial Sequence; identical to SEQ ID NO: 7104
  Synthetic

SEQ ID NO: 7106 - protein, 183 aa, Artificial Sequence
  Synthetic
DEVREIIERIKKLLDDIRKVAEESIRRNEKLLEEVRKRVRESIEELKRIKEEVEKLAREGQPKEELKRIVDEIAKRADESNETLKRIVDKLRKDSKKSNEDVKKIIEELKKRLDDLLRDVRRVPEDVVRTIEEVVRRVEKELRRLLEENERVIREIERELKKLVDDNKRVSDEIKDRAERLVD

SEQ ID NO: 7107 - protein, 183 aa, Artificial Sequence; identical to SEQ ID NO: 7106
  Synthetic

SEQ ID NO: 7108 - protein, 183 aa, Artificial Sequence
  Synthetic
SEVEDIIRKIEESARRSEKVVRDSIRENRRLLEEVKREVDRSIERLEDIIRKVEEVARRGEPEEELRRIVEEVKRELEKSNKELREIVKELRERSRRSNEEVERIVRENAKRLDELLRDIRRVEERAVDTIRRVVEKSKTVSKKVLDENREVVREVDERVRELVRKNEDVSRKIEERARRLLK

SEQ ID NO: 7109 - protein, 183 aa, Artificial Sequence; identical to SEQ ID NO: 7108
  Synthetic

SEQ ID NO: 7110 - protein, 177 aa, Artificial Sequence
  Synthetic
DEEEEVERVVKEAEETIRELLERDKRVVKRLREEADRVLDEVREEVKRSEETAEDLRRKGLDERLVDRLRKLSEDHKRKVEELKRRLDEVLRRVEEESKRLLEELREILERVRRLVRRGDPGEKLIKELEDVLRELEERSRKTLEELKDVLRKVKETIDELIRTNRRELEKLERDTR

SEQ ID NO: 7111 - protein, 177 aa, Artificial Sequence; identical to SEQ ID NO: 7110
  Synthetic

SEQ ID NO: 7112 - protein, 177 aa, Artificial Sequence
  Synthetic
SEEEEVAKVVEDVRRRLEELKRAVEEVIRRTDEEAKRLLEADRRVVERVREEVKRLVEAGLDERLARTIEEILKEVLRRSEKLLEDLRRVNEKSDRDVDRLREEVEDILRRLRELVRKGEPGKELIKRLRDELKRLEDDARRILERNKKILEDVERESRRTLKELKDVLKELEERAR

SEQ ID NO: 7113 - protein, 177 aa, Artificial Sequence; identical to SEQ ID NO: 7112
  Synthetic

SEQ ID NO: 7114 - protein, 184 aa, Artificial Sequence
  Synthetic
SLVEELERVVKDVEREARKLNEHNRENSKRVEDRLRELNEHLRKNTEEVKRRLEELIRKKKDSEELLRLAEKLLTESEKLVRDMERENKKSIEDSRRLVKRVVEENKRVLDEARKLVEELKRLTDEDAIREVLRRIERLLEEVKKKNEETSKRSKELLEENAKRNKEVSDRSKRLLEEIKRRAD

SEQ ID NO: 7115 - protein, 184 aa, Artificial Sequence; identical to SEQ ID NO: 7114
  Synthetic

SEQ ID NO: 7116 - protein, 184 aa, Artificial Sequence
  Synthetic
SLTERLREVVRRVEEELKELIRHLRENSERVRKTLEELNRHLKENVEDVKRKLEDLIRKKKDARELERLLRRIIETSEELVRRVVERNKKSIEESERLVRDAMRKLEKLIDEIRKLVEEVSRLTDKDAVERVIEEIERLLDEVKKTVEELSKTSKKLLDENKKENEDVSRKSEELLKKIADEVK

SEQ ID NO: 7117 - protein, 184 aa, Artificial Sequence; identical to SEQ ID NO: 7116
  Synthetic

SEQ ID NO: 7118 - protein, 184 aa, Artificial Sequence
  Synthetic
SLKERLEEVVRRVRKELKKLIEHLERNVEEVRKTLEELNRHLDENVKRVKDTLTRLIEEKRDKKDLVEKLERALEDSKRKVDKLREENRESIRRSKKLVDDAKKKLDDVIRRIKELLERASRLRKKDEFERVLKRIKEVLDEVKREVEELSKESEDLLRKNEERNKRASDRSEDLLKKIAEEVK

SEQ ID NO: 7119 - protein, 184 aa, Artificial Sequence; identical to SEQ ID NO: 7118
  Synthetic

SEQ ID NO: 7120 - protein, 184 aa, Artificial Sequence
  Synthetic
SLLEELEKVVEEVKRSLDEVNKRNKKNTDDVAKTLTDLNEHLERNVRKVEEDAKDLVRKKKDSDELRERLEDIIRRSKELVDELRKLNTDSIERSERLVREAVKRNERAIERIKKLVDDASRLDKEKLAKDVLREIRRVLEEVKRDNDRTSKESKDLLDENKKRNEEVSEESERLLRDIARKVD

SEQ ID NO: 7121 - protein, 184 aa, Artificial Sequence; identical to SEQ ID NO: 7120
  Synthetic

SEQ ID NO: 7122 - protein, 184 aa, Artificial Sequence
  Synthetic
DLLEELKDVVDKVRRTLERLNEENRKNVEDVKRRLDDLNRKLEDNVRRVEERARELIKRKKDAEELREELERVIKTSKDLVDKLRRENEKSIEDSDRLVKKVERDNERVITRIEELLRRLARLTDEKAVRDVLKEIEELLRKVTKENKDTSDESRRLVKTNEDLNREASKRSEDLLARVEEKVR

SEQ ID NO: 7123 - protein, 184 aa, Artificial Sequence; identical to SEQ ID NO: 7122
  Synthetic

SEQ ID NO: 7124 - protein, 184 aa, Artificial Sequence
  Synthetic
SLTERLAEVVKRAEDLLRKLNEENKKNVEDVERTLRKLNKDLKDSVDRSRREAEKLIRRKKDSKDLARKLKKVVEDSKELVDRLMEENKRSIERSRDLVRRVKETNEEVLREIRRLLEELSRLTDKDAIEKVLEDIERVLREVEKRNRETSRDSERLLRRNEEENRKALERDEKVLKEVADEVE

SEQ ID NO: 7125 - protein, 184 aa, Artificial Sequence; identical to SEQ ID NO: 7124
  Synthetic

SEQ ID NO: 7126 - protein, 184 aa, Artificial Sequence
  Synthetic
SLEEALEKIVREVKETLERLNKENRDSVRETADTLRKLNEELRRNVKRVEEALRDLIREKKEKEELKDKVRELLRRSRELVEEVVKENKKSIEESKRLVDEAEKINRDLIRRIKELLDRASRLRKEEEAKRVLRKIEEDLKRVADINRKTIERDKKLLEDNERKNRKVSEESRELLEKIAKDVK

SEQ ID NO: 7127 - protein, 184 aa, Artificial Sequence; identical to SEQ ID NO: 7126
  Synthetic

SEQ ID NO: 7128 - protein, 185 aa, Artificial Sequence
  Synthetic
KEVEEIIEEIKDRLRRLEETVERLLRENREMLRRTREEVKEIIKRIRDLLRELKKIAEKDRRKEELERLARELEERLKRLVDELRRSLEKHDRESEESVKRLEELARRLLEDLDRLVKDLRRKGIDKKLVEDVDKVVKEVEDRVRRLIEALKKVSEDLHRENKKLIEELEEVVKEVKERARELTR

SEQ ID NO: 7129 - protein, 185 aa, Artificial Sequence; identical to SEQ ID NO: 7128
  Synthetic

SEQ ID NO: 7130 - protein, 185 aa, Artificial Sequence
  Synthetic
DEVKEIIKRIEDLLEDLKRKVERILREDERSLEESRKKVEEILKEIEDVLRKLKKDVEEDRDKDRLREEAKRLLEKLEKLVRDLKREVDENVKRSEKLVREAEELAERLVKELEELVRDLERKGVDESAIKELRDVVREVKKRAKELIERLRESVERSRETNERLIRELEDVVRRVEETVRRLIK

SEQ ID NO: 7131 - protein, 185 aa, Artificial Sequence; identical to SEQ ID NO: 7130
  Synthetic

SEQ ID NO: 7132 - protein, 178 aa, Artificial Sequence
  Synthetic
KKEEKIKRSVERSKEENERLIEELERSIRDTARRAEKLIERLEKVVREVDKRLRELREEGRLRDEEVDRLKKELDRLLRTVKELVKELKRRSTELLRRLEEIVRENEKISRDILKLLRDGKDVETVLREDEDTLRRSEEKVDKLIKDDRRLLEELEDKVRELLRTVKELLKRTEERVT

SEQ ID NO: 7133 - protein, 178 aa, Artificial Sequence; identical to SEQ ID NO: 7132
  Synthetic

SEQ ID NO: 7134 - protein, 178 aa, Artificial Sequence
  Synthetic
SSEERLKESIDRSKKRNKEAIEELEKSIRETEKTLEELIKTTRKSIEDVRKRLEDLERKGELDRKMVETLRKRLEDILRRNKTLVDRVKERSEKLLRDLRKIVKENEDRSREILKLVRDGSDIDTLIEEDKETLRRSDEEVRRLIDEDRRLLEEVEKRARESNKEIRDLLRRVEEEAR

SEQ ID NO: 7135 - protein, 178 aa, Artificial Sequence; identical to SEQ ID NO: 7134
  Synthetic

SEQ ID NO: 7136 - protein, 178 aa, Artificial Sequence
  Synthetic
SEEDELRESVKDSERRLRRLIEEDKRVVEEVEEENKRLIDKVREVIKRIEDRLDELRRRGELSEDSVRRLKELLKDILRKVEEIVERNVRRLREMLKESKRLVDRLKEESEEILKLVRAGKDVKEAIRRDRELLKRAEEESRRTLEEMRTSLEESKRRVEELIKTLKRLLDEAEKEAK

SEQ ID NO: 7137 - protein, 178 aa, Artificial Sequence; identical to SEQ ID NO: 7136
  Synthetic

SEQ ID NO: 7138 - protein, 178 aa, Artificial Sequence
  Synthetic
SSEEKVEESIRRSKKRLEELIRDVERVVRKVEEDNRRLEEKLRKSIEDTRRKLEELKRRGELDDELVRRVKEESDRLLDELRDIVRRNVERARRLLEELERLVEDLKRKSEKILELVRRGKDFETLIRDDKRLLRKVEEDAKRLIKEIRDSLRESEKRVEELIDRDRRLAKEVEDRAR

SEQ ID NO: 7139 - protein, 178 aa, Artificial Sequence; identical to SEQ ID NO: 7138
  Synthetic

SEQ ID NO: 7140 - protein, 178 aa, Artificial Sequence
  Synthetic
SSEERLRESIKRSKKRLEELIREVRKRIEEIRRKNEELIREVEEVIRRIREELKRLRDEGKLDDKTVKDLKEKLDRILEEVKRIVDENEKTARELLKRVEEIVRELEKRSKEILKMVRDGKDIDELIKEDERLLREVEKKVKEIIKRLDDSLRDSERRAKELIRELEELLREAEERAK

SEQ ID NO: 7141 - protein, 178 aa, Artificial Sequence; identical to SEQ ID NO: 7140
  Synthetic

SEQ ID NO: 7142 - protein, 178 aa, Artificial Sequence
  Synthetic
SSEDRLRKSIEDSRKRNEELTRALETVIREIRKRNARLIEEVKKVVEEVKRELERLREEGLLSDELVETVLREAERLLEELRKIVEDNVRTADKVLEDLKRIVRRNEEESKKIEELVKAGKDIDTLIKRDRETLKESEDRVRKLLEDLRRSLRESEKEARRLIEEIRTLLEKVAREAT

SEQ ID NO: 7143 - protein, 178 aa, Artificial Sequence; identical to SEQ ID NO: 7142
  Synthetic

SEQ ID NO: 7144 - protein, 175 aa, Artificial Sequence
  Synthetic
SEVEDVLRRIRELLEEVRELVERNLKEIKRLADEIERLAKENLERSRRLAEELRDGNLDEKAAKDVVDDSKRHSREVVETVKKIAEESKRHSDEVVKTLKDIVREIKREVEEKVRGEDAVERVERILRDADEKIKELARESERLNRELDELIKRLVDESRELNRELEEIVRERAR

SEQ ID NO: 7145 - protein, 175 aa, Artificial Sequence; identical to SEQ ID NO: 7144
  Synthetic

SEQ ID NO: 7146 - protein, 175 aa, Artificial Sequence
  Synthetic
REVEEVLKKIEDLARELTKKVRKNLEDIKKLAEEIRELAERVLRTSRELIKELRDGNLRDEELKRIVDRSRELSKEVVERVERIVEESEKHSKDVVDEMKEIVDRVRKEVEDRVRGRELLEEVRKILEEMRRRVDELVRRSEELNRKLRELVERLVKELEDLNDEAKKIVDDRAR

SEQ ID NO: 7147 - protein, 175 aa, Artificial Sequence; identical to SEQ ID NO: 7146
  Synthetic

SEQ ID NO: 7148 - protein, 175 aa, Artificial Sequence
  Synthetic
REVEEILKKIRTLLEEVKRRVEKNLEDIRKLLKELEDRVRRDLDEIRRLAEELRDGNLPEEDVRRVVEESKKHSRDVVETMKKIVTESEDHSRKVAEELKKIVKEIKEEADDKVRGEKLLAEVRKVLKEAEDKIRELVERSKTINTEVKKEVDRLVEESKKLNKELEDEVDRRAK

SEQ ID NO: 7149 - protein, 175 aa, Artificial Sequence; identical to SEQ ID NO: 7148
  Synthetic

SEQ ID NO: 7150 - protein, 175 aa, Artificial Sequence
  Synthetic
REVEEVLKKIRELIETLEELVRDDLRRIEELLRRIEDKVRENLRRIREVIKELRDGNLPEEELRRVVEDTKRHSREVVEEAKKILEDIRRHSERVAREMKKIVDDIRKKVEKDVRGEDLLKRVKELLDDIRRKVDELIDRSRRLLEDLRRRVKELAEESKKLNEEAEKIVEDRAR

SEQ ID NO: 7151 - protein, 175 aa, Artificial Sequence; identical to SEQ ID NO: 7150
  Synthetic

SEQ ID NO: 7152 - protein, 175 aa, Artificial Sequence
  Synthetic
KEVEEVLKEIKDIAEEIRELAERDLKRDKELVDEAEDLVRRNLEDIRRVIEELRDGNLSEEELRRVVEETKKHSDEVRKELEDIVRRSKEHSRRVAERVKRLVEEVKKRVEDRVRGEELLRRVEKLLEDLKRTVDEMVKRSEDSLRRSEETVRELEERSRRLNDEIRRIVDERAR

SEQ ID NO: 7153 - protein, 175 aa, Artificial Sequence; identical to SEQ ID NO: 7152
  Synthetic

SEQ ID NO: 7154 - protein, 179 aa, Artificial Sequence
  Synthetic
SEVDKVVKEIKEKLDEIRKEVEKVVREDERLLEEIERLARKVVRENKELLKDIRREGREDTEKAREMLERSERKVRELIKEAKKILEESRELVKRLTEKAREVLKEIRDEVKKLEDRTDDETVARKLEEVVREVEEEVRRLEEKLKRSVEETEREIRRVVKELEDSVRETEREVRRLSK

SEQ ID NO: 7155 - protein, 179 aa, Artificial Sequence; identical to SEQ ID NO: 7154
  Synthetic

SEQ ID NO: 7156 - protein, 185 aa, Artificial Sequence
  Synthetic
DDVEKLVRDIERLVEKVTRDNKKTVDDDKTLVDEARKENEETVERIKRELEELEKRVRKDRRREALKKELEELEKRIREILKTLHDRNREIIKRSEDLLKELHERNRRAIEEVRRLLDELRRNGVSEEATRKLEKVLRDLEEELKRVDRENEKSLRESRKIVEDLDRTNKRVVDELRRIVEELRK

SEQ ID NO: 7157 - protein, 185 aa, Artificial Sequence; identical to SEQ ID NO: 7156
  Synthetic

SEQ ID NO: 7158 - protein, 182 aa, Artificial Sequence
  Synthetic
DEIDDVLRKIEDLVRKLRELVKKVLEDSKRLLEEIKRLAKEALERSEELVRRVEELARRGDIDEKELREVLETSKRLSEEVRKRAEELLKESRDLSEELRKRLEDVVREIRKLVKDVADKTTIEEVIRKLEEAVKRAEELVKRIEEELRKVDEEVERLVREIEKELREVNDRLRRLIEEIAR

SEQ ID NO: 7159 - protein, 182 aa, Artificial Sequence; identical to SEQ ID NO: 7158
  Synthetic

SEQ ID NO: 7160 - protein, 185 aa, Artificial Sequence
  Synthetic
REIEEALKEIEKIIEDLRKIVEEVLKRLEEIDRELRKRNEDSNREIEKIIEDLKDMVRKKGPDEELKKLVEDIKKKVTDILRRNEKVVEESERLSKELLDDLERVVKKIEEDIKRILDRVREAGLSEEAERRAETVLRKLERVVDKVIKDIRKVLKDNERVVREVRKSAEELLDKLRKVVEEVRR

SEQ ID NO: 7161 - protein, 185 aa, Artificial Sequence; identical to SEQ ID NO: 7160
  Synthetic

SEQ ID NO: 7162 - protein, 185 aa, Artificial Sequence
  Synthetic
REIEDVLRRIEEIIRELEERNKKSNKEIAEIDKELRDRNRKSNEEIEKIIEDLKEAVERKGTNEELEKLIDEARKRLEEILRRNDTVVDESRKRSKDILDRNRELVREIEERLDRILKRVREAGLSEEAEKRIRDVLDKLREVVERVIRSIEDMLRRNEKVVREVKESIERALKRLEETVKRVRD

SEQ ID NO: 7163 - protein, 185 aa, Artificial Sequence; identical to SEQ ID NO: 7162
  Synthetic

SEQ ID NO: 7164 - protein, 185 aa, Artificial Sequence
  Synthetic
DEIEKMLRDIEEIIKRLRKIVEEVRDTLRRIDEDLRRRNEESNRRLEKIIEDLERVARRDGPDERLRKLIKEARETVERLLEENRRRVAKSRETSKKLLDELRRVVEEIEKRLEEILKKVKDDGLDKKAEDEIRKALRKLKEVVKKVLKEIAEMVERNDRELRRLEKSIRESLDKLRETVKRLED

SEQ ID NO: 7165 - protein, 185 aa, Artificial Sequence; identical to SEQ ID NO: 7164
  Synthetic

SEQ ID NO: 7166 - protein, 174 aa, Artificial Sequence
  Synthetic
DLVEEIRKTIEKIVREIRKVLDEVRKHTEDVIRDIRRVLKEVERHSREVVKRIRDERGTEKARDLVRRNKEKSERVVRRARELVKRNEERSREVVKDLRRLVKEIKDLAKKLVDDGIDKDELRKLVETLEKVVREVEEELRRLNEELEKVVREVEKRARESNDRLEKVVREVER

SEQ ID NO: 7167 - protein, 174 aa, Artificial Sequence; identical to SEQ ID NO: 7166
  Synthetic

SEQ ID NO: 7168 - protein, 186 aa, Artificial Sequence
  Synthetic
SEVDEVVKEIRKLVEDDEREVEKAIRDIRRSNEELRERVERLLEELERLIKEVEETVRRMEGKEEIDKLLRELEKRARDVLRELEELLKEDEKRVKEVLDRIKKVNEDTKKRVEELLREIVRRRGEDVEAVEKARKILEEVEKVVTDTEKKLDDIRKHVKEVVDRLRKEIEDVLKRVRDVAERERR

SEQ ID NO: 7169 - protein, 186 aa, Artificial Sequence; identical to SEQ ID NO: 7168
  Synthetic

SEQ ID NO: 7170 - protein, 182 aa, Artificial Sequence
  Synthetic
KVEELLKELLDRVKEVVDRIRRELEKALEESRRVVREVEERVKTANREVRKVVDDVRKRSDEKRLDDILKRVEEESRRSVEELRKRLRKVIEENRKLVEDLERKLERVIREVERLLEELRNVDEEDVRRVLEEIARLVRELEKMVRDVVKTSRDTVRKLREDVKKVVDENRKLAEKLKRDAD

SEQ ID NO: 7171 - protein, 182 aa, Artificial Sequence; identical to SEQ ID NO: 7170
  Synthetic

SEQ ID NO: 7172 - protein, 182 aa, Artificial Sequence
  Synthetic
RIRETLTKLLEDVKEVVRETDELLKRLNRRVREVVRETEERLEDLNREVRKVVRDIERETDDERLRKLLERVIRESERSVEDVRRHSEEVIRRSEKSVEDLKRHSERVIRTAKELVDRLQNVDEETVKDIVRKVKRLLEENRKLAEKITRDNEELLKENKEMLDEVRRRNTELLKRLREEAK

SEQ ID NO: 7173 - protein, 182 aa, Artificial Sequence; identical to SEQ ID NO: 7172
  Synthetic

SEQ ID NO: 7174 - protein, 182 aa, Artificial Sequence
  Synthetic
RIEEDATRLIKEVKDVVKETEERARKVNKEVRDVVRDVERRLKELNEEVERVIRDVKRRSDEKELDDLLKEVNKRSKKSVDDLKERLEDVIRASEKSLRELEKHSREVLKTVKELLDRLKDVDEKIADDVAKEIEDLVRRNREVVTEIEKKNRELVRRLRDMVRKVEEDNKRLLEELKKATD

SEQ ID NO: 7175 - protein, 182 aa, Artificial Sequence; identical to SEQ ID NO: 7174
  Synthetic

SEQ ID NO: 7176 - protein, 178 aa, Artificial Sequence
  Synthetic
SVRELVEEARKHSRKVAEESRKLVEDLTEESKRVIDESREKVERLREEIERVLREVKKEGRVDDKIVEKLRRTAEELRKRVKESNDRNREELEKLREKVEDSNRKNKKTLDELTKKIEDGEPIERVLEEVEESDKRDEERVRKLEREIRESNKRDKEIVDRLLDELRRIVEELRERAR

SEQ ID NO: 7177 - protein, 178 aa, Artificial Sequence; identical to SEQ ID NO: 7176
  Synthetic

SEQ ID NO: 7178 - protein, 178 aa, Artificial Sequence
  Synthetic
SVDEAVDELLKNSEEVIKDTERKARELLRHSREVNKRSERESERLKEEIERVLRKLKRDNKVDDKILEDLRKKLEDLERENRDSVRKNEETVARLLREVEKSNEDNRRTLKELKDLVRNGEPIEELVERIKDSNRRDKEIIKDLERKIRESDKRHKERVDDLARRVEEIVKELEEAAR

SEQ ID NO: 7179 - protein, 178 aa, Artificial Sequence; identical to SEQ ID NO: 7178
  Synthetic

SEQ ID NO: 7180 - protein, 175 aa, Artificial Sequence
  Synthetic
SEVKKVEKEAEDISRRSRELLEKIREEVERLSRRSEELLKDVERKVRKVIKEIEDKRSSEEAKELVDRIDETLKRLLEESRRLVKEAEDRLREVVKESEDLVREMERRLERLREEGSVDEETVRELIRDLRRNTKRVKEEADEMIRHLRENTERVEKRLRELREELKKVVERVRK

SEQ ID NO: 7181 - protein, 175 aa, Artificial Sequence; identical to SEQ ID NO: 7180
  Synthetic

SEQ ID NO: 7182 - protein, 175 aa, Artificial Sequence
  Synthetic
EMVDRATEKVRTLSDESRRLLKKVRDENRKTSERSKRLLDEIERRVKEVLKRIRTERSDEDARRLVDEVRKDLERIIEESERLVREVEDRNRRAIERSRKLVKDIERDLRRLVAEGSVDKDRVKRLIEELKENTERVEKSLRDLDRHNRRNTEEVKRSADELIEELKRVVDEVKK

SEQ ID NO: 7183 - protein, 175 aa, Artificial Sequence; identical to SEQ ID NO: 7182
  Synthetic

SEQ ID NO: 7184 - protein, 175 aa, Artificial Sequence
  Synthetic
DKADEIEETVRRVSETSERLVEEVRKDNERTSKRSDDLLKDIEDKVRKVLERMRRERLDEEARKLVEEVVRRLEELLKTSKKLVEELREKNRRLIETSKRLVEKVEKELKDARDEGSVDEEKVRRLIKELRDNTKKVAEELKKLDDHNERNVEEVKKRLEELIRRLEKVVEDVKR

SEQ ID NO: 7185 - protein, 175 aa, Artificial Sequence; identical to SEQ ID NO: 7184
  Synthetic

SEQ ID NO: 7186 - protein, 175 aa, Artificial Sequence
  Synthetic
DFVKKAKDDVKEVSKESEKLLREIEEEVRRVSKRSRELLETVRRRVEKVLRDMERERKDEKAEELVRRVEEDLKRVLKESEDLVREVEKRLREALERSRKLVEEVREELRRLVEEGSVDEDRVRELIKELEENTRRVEEKLRKLIEDLKRNVREVEERARRLIEELREVVERVKT

SEQ ID NO: 7187 - protein, 175 aa, Artificial Sequence; identical to SEQ ID NO: 7186
  Synthetic

SEQ ID NO: 7188 - protein, 186 aa, Artificial Sequence
  Synthetic
SDLERLKREAEELIERDKRLLRRVEEESRRTLEEDRRSLKESEDRARELIRRIEELAKKIKDKRELEERLRRLLRTLEEIVERNARLSRKLLEDSKKLVKELRELSERLLRTLERLVRELIRKKDKSDEMRDAARRLIEEITRSVEESERELKRLIEEDKRSVERSKKENDKLIEEVRRVVERVTK

SEQ ID NO: 7189 - protein, 186 aa, Artificial Sequence; identical to SEQ ID NO: 7188
  Synthetic

SEQ ID NO: 7190 - protein, 175 aa, Artificial Sequence
  Synthetic
DVEEVLRKLKKEVEEVIRRTEAEVAKVLKEVEKVVTETREEVRRVLEEVKRVVDDVRRRNRADDRLLKEALKRVRDLLRRVEEVSRKHRDDVRRLMEEVKEVSERTRRAIDEIEKKVRDVEEVRKTVEKLIDDNRRMLEEVVKRAKELIEHNRRVVDKVLKEAKKIVRDLEETVR

SEQ ID NO: 7191 - protein, 175 aa, Artificial Sequence; identical to SEQ ID NO: 7190
  Synthetic

SEQ ID NO: 7192 - protein, 175 aa, Artificial Sequence
  Synthetic
SVEEVLKKLLEEVRRVAEETRRRAEKLLDDDRKVAEESKKRAEELLKEVKDRVDDVRRRNTLDDRILKDILRKVAELVKELEEISKRSLDESKRLVEEVEKVSRETEERVRDIARRVKDMEKVARTIKKLIKENRKFLEEVEKRSRETLKTNKKVLRDLEKRAKKIIEDLERTLR

SEQ ID NO: 7193 - protein, 175 aa, Artificial Sequence; identical to SEQ ID NO: 7192
  Synthetic

SEQ ID NO: 7194 - protein, 176 aa, Artificial Sequence
  Synthetic
KIEELMKRLEDEAKRSLDESEKKLEELRRDSERSVREVEELLKELLDRARRVLEKLGDSEEARKVLERVRKLVTEVREHSERVSRENERLVKENRDHSRRLLERVRELVERVSRLTDEEEVKRVAREVEELIERNRRHSDRIAEEVKETLERNREKVRRVLEKLKKELEDVLEKRK

SEQ ID NO: 7195 - protein, 176 aa, Artificial Sequence; identical to SEQ ID NO: 7194
  Synthetic

SEQ ID NO: 7196 - protein, 176 aa, Artificial Sequence
  Synthetic
DIEELARRLEEAVKDSLRRVEEKLRRLEDESRRSVEDSDRKLKELIDRVRKVLKDLGESKEAKDVLREVRRLVEENRKHSEDVSRDNKRLVDEVRRHSEELLKEVKRLVDEVRRLDKDEVVRRVARRIEELLKENDDLVRRVAEEIKRTLKENNEHSDDLRRRIEELIKEITERRR

SEQ ID NO: 7197 - protein, 176 aa, Artificial Sequence; identical to SEQ ID NO: 7196
  Synthetic

SEQ ID NO: 7198 - protein, 176 aa, Artificial Sequence
  Synthetic
DIEELLERLRRRVEKSLEDSDRLLRKLEEDSKESVKRVKRLLEELIKRVKEVLKKAGNSEEAKKVLEDVERLVREVEKHSREVSERNKKLVDDNRKHSEDLLRTVRKLVEEVRRLTDKELVKRALEEIEKRLKDNRDHSRRLAETVKDTLDKNDKKVEEVRREIEELLRRLDEKRN

SEQ ID NO: 7199 - protein, 176 aa, Artificial Sequence; identical to SEQ ID NO: 7198
  Synthetic

SEQ ID NO: 7200 - protein, 176 aa, Artificial Sequence
  Synthetic
DIEDLLRELRKRVEDSLKKSEDRLRRLEEKVKRSLDEVEKELKRLLDEAKKVVDKAGNSEEAKKVLDDVKRLVDRVRRESERLLKEVRDLVRENKKHSKELLDEVDELVERVRRLDKDEEVRRVLERIDRLIKRNDDHSRKLEKEIEDLLRRNNREAEEVAKEVEKLLEDLERRRK

SEQ ID NO: 7201 - protein, 176 aa, Artificial Sequence; identical to SEQ ID NO: 7200
  Synthetic

SEQ ID NO: 7202 - protein, 182 aa, Artificial Sequence
  Synthetic
REIEEVVKELDDLLRRNDERVKRILDELEELIKKHDRRSDEVTKEIRELLRKLEREVERDKSKEDLERKLDELRRTVDELVRDVERHAREVLERVKELVERLERHSRRVLEEVEKLVREVVRTKEARELAEELKKRAKESVDRSKKALEELKKRAREAVRRSREKLKKLKREVEKVVREVRR

SEQ ID NO: 7203 - protein, 182 aa, Artificial Sequence; identical to SEQ ID NO: 7202
  Synthetic

SEQ ID NO: 7204 - protein, 187 aa, Artificial Sequence
  Synthetic
DELREILERVRRVLERSKELSEELLRRVEEVLRRLRKHSRDLEEKVRRILTEIEKRARERRDDDEKLLREVKKVLEDVERELDRSIERSEEVVEELKRRADRSIEESRRLLETVKKELEDLIERRREVKDLREKLDKLRRDLEEVLRRNEEIVREATRRIRKVLDENRKKVEELKRRAERVLEELRR

SEQ ID NO: 7205 - protein, 187 aa, Artificial Sequence; identical to SEQ ID NO: 7204
  Synthetic

SEQ ID NO: 7206 - protein, 187 aa, Artificial Sequence
  Synthetic
DDLRRIAKEVEKVLKTSEDLSEELKKEVKRVVDESREDSKRLREEVRKVLEEVKRLADRNEKDREELLDEVRRLLEEVRRLLKESIDRSKRLLEDVKKKLEDSIRESERLLRTVEERLKELIDKKREVRELKEILKELKKELERVLEDNRRKVKELEDELREVLKRNEKIARELEKELRRVLEEVRR

SEQ ID NO: 7207 - protein, 187 aa, Artificial Sequence; identical to SEQ ID NO: 7206
  Synthetic

SEQ ID NO: 7208 - protein, 187 aa, Artificial Sequence
  Synthetic
DELRELEERAKKVVDESRENSDRLAKKVKEVLKRSRELSDELRKEVERVLREIKERARRKDEPREDLLREVAKVLEEVKRRLEESIRRSKRLLDEVTRELEESIRRSEELVDRLRKKLEELIDRRREVERLRDILDKIAREVERVLEENRRIVTELKKELEKVLDENRKIVEELERRARKVLKELRD

SEQ ID NO: 7209 - protein, 187 aa, Artificial Sequence; identical to SEQ ID NO: 7208
  Synthetic

SEQ ID NO: 7210 - protein, 187 aa, Artificial Sequence
  Synthetic
DELRELLEEVRRMLRESRENSRKLAEEVERVLRESEEDSKKLKRDVEKILEDVRRKLERNEKDKKDLLKEVEDELRKVRKDLEESIRKSKRLLDDVRRRLEESIRRSEKLLRDIDKRLKELIDKRKEVDELRRILDELRRRAKKVLDDNRKIVRDLERELRRVLEENRKIVEELEKLLEKVLEELRR

SEQ ID NO: 7211 - protein, 187 aa, Artificial Sequence; identical to SEQ ID NO: 7210
  Synthetic

SEQ ID NO: 7212 - protein, 187 aa, Artificial Sequence
  Synthetic
KELEELAKTVEDLLRENDRLAEEVLRTVDDLLRKNDEISKRLLDTARKLLKELKDLKRENRGDKKDLLRTLERLLEKLKEDVDRSRKISEDLLREVKRLVDELRERSKRILDEVRKLAEKLIREKDKSEDVKRILEKLIRDVEKSLKDVDDRLRELIRRVEESLRRNEEILKEVERRAEEVVEEVRR

SEQ ID NO: 7213 - protein, 187 aa, Artificial Sequence; identical to SEQ ID NO: 7212
  Synthetic

SEQ ID NO: 7214 - protein, 187 aa, Artificial Sequence
  Synthetic
DDAERLLEDVRRLLEENDRISEEVLKTVKRIVDENDRLAEELLRTVDELVKRLKELRERNEGDKKVLDKEVKKILREVEKLVEELRRISKKLLDDVKRLVDESRKISEKILDDVRKLVTELIRKVKDFERIRKILEKVIKEVEDSLRRNSEIVERAVDRARESVKRVKEIVETVERKIRKVVDEVRK

SEQ ID NO: 7215 - protein, 187 aa, Artificial Sequence; identical to SEQ ID NO: 7214
  Synthetic

SEQ ID NO: 7216 - protein, 187 aa, Artificial Sequence
  Synthetic
SEVEEVKDRVTKLLKENDDISKELEERVRRLLEENDRHSREVEKTVRKLLEDLKRLAEENKGDKKVLTKEAKRILDEVRKLVKENDDLSRKLLEDVKRLVETSKRISEKLLRDVKRLAEDLIDKKRDSKRVKDILRRLVEEAEESLRRNEKKLRELEKRVRESLKRSHKINKELEERVKEVLDRVRD

SEQ ID NO: 7217 - protein, 187 aa, Artificial Sequence; identical to SEQ ID NO: 7216
  Synthetic

SEQ ID NO: 7218 - protein, 187 aa, Artificial Sequence
  Synthetic
DEVERVLEEAKKLLDTNDDLLRKLDDTVRKLVEDNNRISEEVRERVERLLRRLEELVRKNEGDKKKLEKDARDILRKVRELAKESDERSRKILEEVRRLAEKLKRDSERLLRTVERLVRKLIDDKRDSERVKRILDRVIKEVTDSLKRVEDRLRELIRRVEESLKRNREELRRLEERVKDVLDKARR

SEQ ID NO: 7219 - protein, 187 aa, Artificial Sequence; identical to SEQ ID NO: 7218
  Synthetic

SEQ ID NO: 7220 - protein, 187 aa, Artificial Sequence
  Synthetic
DRLEDLLRDVKRLLEENDKHSKEVEERIRKLVEDNNEISRTVARDVEEKLKRLRERTEEKRGDKKVLERDVERLLEEVDRLLKRSEEISERILREVRREAERNDEESERILKEVRDLVRDLIDKFRDSERVRRTLEELTRRVEESLKRSHEINRKVIREIEKSMDENKKELERLIDRARRVLEDVRK

SEQ ID NO: 7221 - protein, 187 aa, Artificial Sequence; identical to SEQ ID NO: 7220
  Synthetic

SEQ ID NO: 7222 - protein, 187 aa, Artificial Sequence
  Synthetic
SEAEEVLKRAEEILRENNKISRDLEEEVRRLLKENDDLLREVEETVERLLEELKELAKRNEGDKKELVKRAEDLLRRVRDLVRRLEERSKEILKEVKRLVEESKRRSEELLKRVRELAKELIDRKKDSERVKKILERVIRELEKSLKDNERKLRELEERVRDSLRRVEESLRRLERRVEEVLERVRK

SEQ ID NO: 7223 - protein, 187 aa, Artificial Sequence; identical to SEQ ID NO: 7222
  Synthetic

SEQ ID NO: 7224 - protein, 187 aa, Artificial Sequence
  Synthetic
DEMEKLRKDVKKLLEDNNKISRDVEKTVEELLRRNDEHSKEVLKRVEDLLRELKKLKDDKDGDKKELLKTLEDILREVAELLKRNDDLSRKILEDVERLARESKKISEEILREVERLAEDLIRKFDKSEDVKRILEELKKRAEDSLRENEKRLRELIREVEKSLRRSHEINRDAERKVRKVLDDVRR

SEQ ID NO: 7225 - protein, 187 aa, Artificial Sequence; identical to SEQ ID NO: 7224
  Synthetic

SEQ ID NO: 7226 - protein, 182 aa, Artificial Sequence
  Synthetic
SEIEELLERVKELLKRNRELVERVKRTVEELNKDNDRVVKEIEDEARRLLDELEKIMRRTSDKRTLDKILREVLERVRKLVEDLEEHSRRILKRTEELVRKLRKHSEDVKRTVDRLVKEVVRDDRMRRIAKKAIDDVRKSVEDSKRILDELRKSTEESVKRTRDILKRVLDEAKKVVEDLRR

SEQ ID NO: 7227 - protein, 182 aa, Artificial Sequence; identical to SEQ ID NO: 7226
  Synthetic

SEQ ID NO: 7228 - protein, 182 aa, Artificial Sequence
  Synthetic
DELEELRTRVEKLLKENNDLVREVLKTVKKLNDENRKLVERILREVERLLRELREIAKTTSDKDTLKKELRRVLEEVKKLLEELREHSRRILETTKELVRRLEEHSKRVLDTVEDLVRKVVRTEEMRKKAEELRKRVDESVKDTRKKLEELRKSTEKSVRDTDRILKDLERRAREVVDELEK

SEQ ID NO: 7229 - protein, 182 aa, Artificial Sequence; identical to SEQ ID NO: 7228
  Synthetic

SEQ ID NO: 7230 - protein, 177 aa, Artificial Sequence
  Synthetic
DVEEAVRELRETLDKSVERSERTVRELVKKLETSVEETREEVERVVEELDRVVEEAKKDVSEKIVDEIRKLVDKLRKEAKKVLEDSKRKVDELRKEAKKVVDESRERAEKLKKDLDERGAGAKEVRKEVKELVERDEDLVRKIREKVEKVVKDNKDLLRRIREAAKRVVREIRERLR

SEQ ID NO: 7231 - protein, 177 aa, Artificial Sequence; identical to SEQ ID NO: 7230
  Synthetic

SEQ ID NO: 7232 - protein, 184 aa, Artificial Sequence
  Synthetic
STMDEIRRIVEKVLKEDKDLAETADRLNRDSVRRDEELAERNKRTNERVVREIEDRLKKEKSEEVVKTIKELIERVVKRNEESIRESERLVRELVKKNEEIIRRSKKLVEEVERRAREILKSSEDKRLEDIVREVKKRLEDSLRDTERIVREVDERNKESLRRSKEIVERVNKLLRDVLERART

SEQ ID NO: 7233 - protein, 184 aa, Artificial Sequence; identical to SEQ ID NO: 7232
  Synthetic

SEQ ID NO: 7234 - protein, 179 aa, Artificial Sequence
  Synthetic
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 7235 - protein, 179 aa, Artificial Sequence; identical to SEQ ID NO: 7234
  Synthetic

SEQ ID NO: 7236 - protein, 170 aa, Artificial Sequence
  Synthetic
SAEEVVRELDKELKKVLEDSRDLVRRLEEELRKVLEDNEEVVKEIERSSDDVLRKLGDSEEAREIVKRSRDELKESIDDSRRIVEKIRRDLERNIRKVEEIIEDIKRKLKDLRGSDELLRRVKELVERARRHSERLLEEVKRLVDEIRERSKELLERARRLNEEMKERTR

SEQ ID NO: 7237 - protein, 170 aa, Artificial Sequence; identical to SEQ ID NO: 7236
  Synthetic

SEQ ID NO: 7238 - protein, 183 aa, Artificial Sequence
  Synthetic
SDLEELFREVKELVDDNLRKSDKLRRDVEKRVRDNERRSEKVHEDNRRLIEKIERLVRRGELREEDVRRALEEIKDSLRRSLETSKKVLDDIREELKRSLDHSREVLEEIERLLEEILRKDKDSDRVRTLVKELRERAKKSLDDNRRMVEELRKRLEESLRRNKRVVEESEKIAKEVLDKVRT

SEQ ID NO: 7239 - protein, 183 aa, Artificial Sequence; identical to SEQ ID NO: 7238
  Synthetic

SEQ ID NO: 7240 - protein, 183 aa, Artificial Sequence
  Synthetic
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 7241 - protein, 183 aa, Artificial Sequence; identical to SEQ ID NO: 7240
  Synthetic

SEQ ID NO: 7242 - protein, 183 aa, Artificial Sequence
  Synthetic
DDLEELFERVKRLLERNNEVSKKLEDDVRKLIEDNERRVERVHRENEKELRRIEDLKRRGEIREKDVKRALEEIKRSLDELLKHSKDVLEEIEKLLRDSEEHSKTVLKEIEDLLRDILRKDKDSERVRRLVEELRKLLEDSLEKNKRLVDELRKRAERSLREVRKLVERSKREAERVLEEVRK

SEQ ID NO: 7243 - protein, 183 aa, Artificial Sequence; identical to SEQ ID NO: 7242
  Synthetic

SEQ ID NO: 7244 - protein, 183 aa, Artificial Sequence
  Synthetic
SRVEEMFERIERLVRRNNEVSRRVHERNRELIKRNREKVKKVHDDNKKLIDDLRELKRRGEIREEEAKKVLEEIEKSLRELKKHSEDVLREIDKTLRESEKHSDDVTREIDELLKRILDEDKDSERVRRLVEEARRLLKKSKDDNRRVVKRSREEVTRSLREVEKLVDESRREAEKVLEEVKK

SEQ ID NO: 7245 - protein, 183 aa, Artificial Sequence; identical to SEQ ID NO: 7244
  Synthetic

SEQ ID NO: 7246 - protein, 183 aa, Artificial Sequence
  Synthetic
KELEEAFDRVRRLLEENKRKAEEVHRTNEELVRRNNEKSERVHRENEKEIERLDRAKKRGEIREEEAKRVLEKIERSLKRSEEHSEELEREVERTLRELEKHSEDVLKDIERLLKDVLRKDKDSERVKTLLKELRDRLKESRETVKELVDRSREEVKKSKKRNKKVVTDSRRRIKDVLDKVRK

SEQ ID NO: 7247 - protein, 183 aa, Artificial Sequence; identical to SEQ ID NO: 7246
  Synthetic

SEQ ID NO: 7248 - protein, 183 aa, Artificial Sequence
  Synthetic
KEAEDMLRKVRKLIKENEKHSREVADEVRKLVEDNDRKVDEVHERNRKLITDLRRLAEEGRVREKDVKAVLEEIEKSLRELRKHSRDVLKRIDDLLKENEKHSREVLKEIKRLLDELKKEDKDSERLKTVVTELEKRARDSLEKSKEINKRLREELKRSEERVERLVRKSEEEAKKVLDDVRR

SEQ ID NO: 7249 - protein, 183 aa, Artificial Sequence; identical to SEQ ID NO: 7248
  Synthetic

SEQ ID NO: 7250 - protein, 183 aa, Artificial Sequence
  Synthetic
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 7251 - protein, 183 aa, Artificial Sequence; identical to SEQ ID NO: 7250
  Synthetic

SEQ ID NO: 7252 - protein, 185 aa, Artificial Sequence
  Synthetic
SEVEEIFKRVTDLLKRNRDLVREILERSRRLVERNDREAKKILDDARRLIEELEDAVRKERDKDTLRKKVKELRDEVKRLVDRLRKHSKDVLDTDRKLVKELEDHSKELEKEVERLLEELERRSRDERVKKLLDELRERVKRSVEESRRVLDDSRRKSEDSLRRSEELLKRVEEIVERVAREVER

SEQ ID NO: 7253 - protein, 185 aa, Artificial Sequence; identical to SEQ ID NO: 7252
  Synthetic

SEQ ID NO: 7254 - protein, 185 aa, Artificial Sequence
  Synthetic
SEVEEIARRVDKLLKDNKRTVDEILKESRRLVKENNELVDKILREVEELLRRLEDEVRKERDKDELTRKVKELIDRVRKLLEDLRRHSEEVRRRDEELADRLRKHSKELEERVKRLLEDLRRKSTSERVEKLLRELEKRVKESVDTSREVLKRSREDSKRSEDRTEKVLREARKRVEDVADKVRK

SEQ ID NO: 7255 - protein, 185 aa, Artificial Sequence; identical to SEQ ID NO: 7254
  Synthetic

SEQ ID NO: 7256 - protein, 185 aa, Artificial Sequence
  Synthetic
REVEEIVKEVERLVRENDKVAKEIVDESKRLVEENRKRVEEIRREVEELIRRLEDAVRKERRKEDLARKVKELRDTVERLVRELKKHSEEVLRRDEDLVRRLRRHSEKLKKDVDDLVRDLERKSDDKRVKDLLEELRKRVKDSRKKSEELLEESERRSKKSLDDTRRVLKDARDIVEKVADEVRK

SEQ ID NO: 7257 - protein, 185 aa, Artificial Sequence; identical to SEQ ID NO: 7256
  Synthetic

SEQ ID NO: 7258 - protein, 185 aa, Artificial Sequence
  Synthetic
SDVEEIKKRVKELLEENKRLVETIEREVRRLIEENRRLAKRILDEVRRLLEELKDRVDKDRDKDELRKEVERLLERVKELLDALRKHSKDVLDTVKKLLEDLRRSSEELRRTVEELVRRLEERSDSERVKKLLTDARKEVERSLRESKKALDELRRIVEKSLRDTERLLRTAEKEVEDVLREVER

SEQ ID NO: 7259 - protein, 185 aa, Artificial Sequence; identical to SEQ ID NO: 7258
  Synthetic

SEQ ID NO: 7260 - protein, 185 aa, Artificial Sequence
  Synthetic
SEVEKIFRDVEDLLRRNEETAKEILKTSEELVRRNEELVRRILEEVRDLIRKLREVVERSRDKDELRRKVDELRREVERLVRELEKHSRRVLEEDKRLAEELRRSSKELEDEVKRLLDDLRRRSTDRRVEELLRRLAEAVKESLERSERLLRRSEEESRRSLKKTEDILREAREIVRKVAEEVKK

SEQ ID NO: 7261 - protein, 185 aa, Artificial Sequence; identical to SEQ ID NO: 7260
  Synthetic

SEQ ID NO: 7262 - protein, 185 aa, Artificial Sequence
  Synthetic
REVEEIVKEVRRRLERNDEVAERIVRESERLVEENNRLVEEILRRVRKLIEELLDLVRKSRDKSKLKKKVDELRRTVKKLLDELREHSKRVKEEDERLVDELRKHSRKLLEEVKKLADELRKRSTDERVEKLLRDLEREVDESRKKSRKLLERSREESDRSLKTTEDILREAERIVEKVEEDVRR

SEQ ID NO: 7263 - protein, 185 aa, Artificial Sequence; identical to SEQ ID NO: 7262
  Synthetic

SEQ ID NO: 7264 - protein, 185 aa, Artificial Sequence
  Synthetic
SDVEEIVRRAEKLVEDNDRVAEKIHEDNRRSNKRTLDEVRKILEEVRKLIKDLEDEVRRDRDKDRLRKKVKELKDEVERLLRELEDTVRRDKETSKDTARKLRKHSEDVEKTVRDLVTELARRSDDERVKRLLRRVEKSVRDSKRRSEKLLEDSERSSEKVEKDVRDVLKEAREIVRDVAEKVEK

SEQ ID NO: 7265 - protein, 185 aa, Artificial Sequence; identical to SEQ ID NO: 7264
  Synthetic

SEQ ID NO: 7266 - protein, 185 aa, Artificial Sequence
  Synthetic
EEVERIVEDVRRLLEENRELVKRILDEVRKLIKENNRLAREILETVRTELEKLRDLVRKLKSKEDLDRKVKELRRKVKELLDDLRRHSEDVRRRVKELLDRLRDSSRRLREEVRRLLDDLRRKSTSERVEKLLEELERRVEESVEESERVLREAEKIVRDSRKTTEELLEEAKRRVDEVAKEVKK

SEQ ID NO: 7267 - protein, 185 aa, Artificial Sequence; identical to SEQ ID NO: 7266
  Synthetic

SEQ ID NO: 7268 - protein, 185 aa, Artificial Sequence
  Synthetic
SSVDEILKDVRRSNKENLDLVEKILRESKKLVEENRRLVKEILDRVRKLIKELLRLVREDRDKDTLRKKAEDLERTVKKLLKELEDSSRDVIRRDKELVTRLKESSDRNLERVKKLAKELREESTSEKVEDVLRRLKRTSERSLEESKKLLEESEKDSDRSRKESEEVLREAEEIVKRVLKEVER

SEQ ID NO: 7269 - protein, 185 aa, Artificial Sequence; identical to SEQ ID NO: 7268
  Synthetic

SEQ ID NO: 7270 - protein, 185 aa, Artificial Sequence
  Synthetic
DDVETIVERVRELLEENNRLAREIVERVEKLLKDNDDLVKEILEEVDRRIRKLEEAVKRDRDKETLRKKVRELEERVKELAERLKKSSKELKDEVDRLLKELEDHSRDLERRVKELLDDLRRKSTDRRVEELLRKLEEDVKRSLEDTKRLLDELKKKVDESRKRSKDVLDKAREIVDRVRRSVEK

SEQ ID NO: 7271 - protein, 185 aa, Artificial Sequence; identical to SEQ ID NO: 7270
  Synthetic

SEQ ID NO: 7272 - protein, 185 aa, Artificial Sequence
  Synthetic
SEVEKIVRDVEESNKKTKKKVEDIEEEVKDLVRKNNELVKRILEEVKRLLEELKRVKKDDRDKDRLRKKVEELIRTVEELAKELEDHSRRVIETVRRLLERLRRTLEEDLKEVERLLDELRRRSDDERVKRLLDRLRRTSEEVLERVEEVLKKAEEIVRKSFEDSKRVLRKAEEDVKRVARDVEK

SEQ ID NO: 7273 - protein, 185 aa, Artificial Sequence; identical to SEQ ID NO: 7272
  Synthetic

SEQ ID NO: 7274 - protein, 173 aa, Artificial Sequence
  Synthetic
SVDEAAKEAEEIVETVERESRKLLEDSRRIVEEVKKRSEEILEEVRRRVEEVVKESKLKRLADELRKMVKKIKDDVERSNKKTEDDLRKSEEEVKRSNDTTREILKRIREVLKAGSPLERLLEALRRVIDEDRKRSKKLHEENKRVIERDKEISDKLLDDLRKLVADLRRRAK

SEQ ID NO: 7275 - protein, 173 aa, Artificial Sequence; identical to SEQ ID NO: 7274
  Synthetic

SEQ ID NO: 7276 - protein, 179 aa, Artificial Sequence
  Synthetic
REAEELEKEVKKVVDDSKKRLDELDEENRRVDETIKKISEDLTREVKDVIRRIRDGNLREDEVRKVVKEVTDKLEDSNRRVEELIRRTEKKLRDALERSKELSREVLEKARKLLEDKKDLEELRELVERLRRRLETVNRELERRVRELKRSNDESHRENREVIEELIKELKKVLDDVRK

SEQ ID NO: 7277 - protein, 179 aa, Artificial Sequence; identical to SEQ ID NO: 7276
  Synthetic

SEQ ID NO: 7278 - protein, 179 aa, Artificial Sequence
  Synthetic
DELREILRKVEKVVEDIERTSDKLRREVDKVVDDSRRKLEELEKEVKKVIEDIRDGNLREEEVREEVKRVVRKAEKLLEDSRRETEKVVRDAEESNKEVKRLIDEVKKELDRIIEEKDKVDRLKEAVKELAKRLKDVHERNKRLIDTLREKLKRINDELERSVRELKKELEEVIDRVRK

SEQ ID NO: 7279 - protein, 179 aa, Artificial Sequence; identical to SEQ ID NO: 7278
  Synthetic

SEQ ID NO: 7280 - protein, 179 aa, Artificial Sequence
  Synthetic
DEVEELKRRVDRLVEEIRKLSEELLKRNRDVDREIKKRVKDLEDKVRKVIRDIEEGNLRKEEVEKVVRDVKRELEELERRVRELVKRTIEEAERSNEEVKRIIDEVEKEADRLLEEKKEVRELDEVIKEIRRRLEKVHRDNRRVIDEVRRSNRDSERDIAEAVERLTRLLETVLEKVKT

SEQ ID NO: 7281 - protein, 179 aa, Artificial Sequence; identical to SEQ ID NO: 7280
  Synthetic

SEQ ID NO: 7282 - protein, 187 aa, Artificial Sequence
  Synthetic
DELEELRTTVTKLLEDLKKISDDLREEVRRLLEEVEEISKRLEETVRRIIKRVEDIVRRDGGRDERVVREVARILEDIERLLRESLKRSKEVLDEIEKLLRDSEKISRTILEKIERDLERLLRRKKDVKDVKEVVKKLRDELRRVLERNKEVIDRLREKAREVLEKDRKLVDDLREEAREVLERVKT

SEQ ID NO: 7283 - protein, 187 aa, Artificial Sequence; identical to SEQ ID NO: 7282
  Synthetic

SEQ ID NO: 7284 - protein, 187 aa, Artificial Sequence
  Synthetic
DELEEIKKEVEELVKTNERIVDKLREDNKRLVEEVKRISEELEREVRRIIREVREIVKRDGGRDKRVRDTVRKVLRDIEELLKRSLDISREVLERSAESLRRSLEISKEIADRIRKLLRKLLEDLKDVKDVEKLLRELEEEAKRSLKRNRDVIEKLREENKRLLDDDRRVVEELRKEAKDVLDEVEK

SEQ ID NO: 7285 - protein, 187 aa, Artificial Sequence; identical to SEQ ID NO: 7284
  Synthetic

SEQ ID NO: 7286 - protein, 187 aa, Artificial Sequence
  Synthetic
REVDELKKTAEKLIRDDERLVEEVLRTSKKLVREDEDMVRKLRKTIEDLIRRLTDVAREELKDKDELRKMVREVLERVKKLLEELRRHSKRILDEDRRLAEELRRHSDEIKDRVRKLVEDLLRRLDKVRDVKRVLDEVEKLVEDSKRETERVLRESEERSRRSLEETEKALKDLAKLAEDIKREVEK

SEQ ID NO: 7287 - protein, 187 aa, Artificial Sequence; identical to SEQ ID NO: 7286
  Synthetic

SEQ ID NO: 7288 - protein, 187 aa, Artificial Sequence
  Synthetic
REVDELRKRIEDLVRRDEEVARKVLEDVRRLVRRNREKARELLERVEKLVRDLKRVADRDLKDKETLKRMVDRVIEEVKRLVEELRRDSKRVIDEVERLVRELEDHSRRVKDEVEKLVRELLERFKDVEEVKRVLDELRKLVKDSERKTKEVVEKVREDVKDSLRRSEEVLKRVKELVDRVADEVRK

SEQ ID NO: 7289 - protein, 187 aa, Artificial Sequence; identical to SEQ ID NO: 7288
  Synthetic

SEQ ID NO: 7290 - protein, 187 aa, Artificial Sequence
  Synthetic
SDLEKLKERVDELIRRDDELVKRVLEESRRLVDRNKKKVDELRRRARKLIEDLKRVADRDLKDKRTLTEKAKEVEKTVDKLVKDLRRDSKKVKDDDEKLAEELRRHSKEILERVERLLEELLRRLDKVERVKELLDRLRKKVEDSREKTERVLKESRELSDRSLERSEEVLERVRREVREVVERLKK

SEQ ID NO: 7291 - protein, 187 aa, Artificial Sequence; identical to SEQ ID NO: 7290
  Synthetic

SEQ ID NO: 7292 - protein, 187 aa, Artificial Sequence
  Synthetic
DSLREVEKRIRELIRENEELVKEVLERSKRLVDEDRETAERLRKTVEELLKRLREVADKELQDKDTLREMVKKVIEDVRRLLEELRRHSEKILRDDKRLVDELRKHSEDVKREVDKLLKELLEELKDVDEVRKALEDLKRTVDESERRTEEVLKESEDLSRRSLKETEDLLRELEKRVKEVADRVED

SEQ ID NO: 7293 - protein, 187 aa, Artificial Sequence; identical to SEQ ID NO: 7292
  Synthetic

SEQ ID NO: 7294 - protein, 187 aa, Artificial Sequence
  Synthetic
SDLDEVRKEVKRLIDENRTLVDEIRRRIEKLIRENKKKVEELRKRAEELIRRLKEVADRDLKDKETLKRMVDRVLDEVRRLVEELREDSRDLERRVEELVRRLKDHSRELEREVRRLAKELLDRLDKVRDVKRLLDDLKRLVKESLDETERVLRELRKEVKDSLRDSERALREVEDLVRRIKKRVEK

SEQ ID NO: 7295 - protein, 187 aa, Artificial Sequence; identical to SEQ ID NO: 7294
  Synthetic

SEQ ID NO: 7296 - protein, 187 aa, Artificial Sequence
  Synthetic
DEVKKLEEDVRRLIEENEELVRRVKKTSDDLVKRNKEKVEELRKRVEDLIRRLREVERRDLKDKDELRRKAEEVLRRVKKLADDLKKDSRDVLETDRELVERLKRHSEDLKRRVEELLKDLLDKLKDVDEVRKALERLRDEVRRSVTDTDRVLKESEDRSRKSLEDSERVLRELEELVKRILDDLAR

SEQ ID NO: 7297 - protein, 187 aa, Artificial Sequence; identical to SEQ ID NO: 7296
  Synthetic

SEQ ID NO: 7298 - protein, 187 aa, Artificial Sequence
  Synthetic
SEVDRLRETIKRLLEENKELVERLRERVRKLIRENEKKVEELRDRAKKLIDRLREVRTRDLKDKDKLRKVIEEVERRVRKLVDDLRRDSDRLEEAVRRLLKELEDNSRELKKEVERLLRELKERKKDVRDVERALKELRDRIEESLRRSEEVLKELEERVKESRDESRRVLEEVRRLVEEIKRRAEK

SEQ ID NO: 7299 - protein, 187 aa, Artificial Sequence; identical to SEQ ID NO: 7298
  Synthetic

SEQ ID NO: 7300 - protein, 187 aa, Artificial Sequence
  Synthetic
KDVEDLEREIDRLLDEDRKVVEDLERKIKKLIDDNKRLVDKLREDVERLIRRLREVTEKELKDKDTLRKMVRDVKETVKRLLEELERNSREVLKTVKKLLDDLRRHSKRIKEEVEKRVRELLERLKDVKKVKEVLDELRKRVDRSLEEAEKALRRLEKLVRDSLRRSEEALERLKRLVDDVKKKVED

SEQ ID NO: 7301 - protein, 187 aa, Artificial Sequence; identical to SEQ ID NO: 7300
  Synthetic

SEQ ID NO: 7302 - protein, 187 aa, Artificial Sequence
  Synthetic
SELDEVKRRAKELVDRDKKLVKEVLDTSRELVRRNEELVRRILEEVRKLIEDLAEVTKRDLKDKDTLREMVKRVKEEVERVLRELERNSREVLKRDKKLADELREHSREVLERVERLVRDLLEKKKDSKEVKELLDEVRRLAEESRREVERVLRESEKRSRESLKKSEDALERAKKLVEDIKDEVER

SEQ ID NO: 7303 - protein, 187 aa, Artificial Sequence; identical to SEQ ID NO: 7302
  Synthetic

SEQ ID NO: 7304 - protein, 185 aa, Artificial Sequence
  Synthetic
SEEDKIREIVDRVLKESEKLIEEIERRVDKVLKRIKELTDEIKKRAEDVIREIEDIVRKERSERVEKRVKELEKELDEMAKESNERVRRLVEEVKKELREVLKDSRRLSKEVEETLKRLLEEKKEVDELRKVVEEIKRELEKIDKKLEEVVRRIEKKLEDILKENSKAVREIRELLKKVKRELEK

SEQ ID NO: 7305 - protein, 185 aa, Artificial Sequence; identical to SEQ ID NO: 7304
  Synthetic

SEQ ID NO: 7306 - protein, 186 aa, Artificial Sequence
  Synthetic
DEVEELKRRVEKLLEEIERLTKTHEDRSRRLIEDIRDSNRKLKEDAERLIKEIEELKRKVKDKETLTREVERLLRELEEKLKRDLKRVEDVLRDNERSVRESEKRSRELLERLKKLLEELKTKSKDSEELKKVVDDLRREAERILRRDEEAVKRSEKLLRDILEHVKRVVDEIREELKRILDRVRE

SEQ ID NO: 7307 - protein, 186 aa, Artificial Sequence; identical to SEQ ID NO: 7306
  Synthetic

SEQ ID NO: 7308 - protein, 186 aa, Artificial Sequence
  Synthetic
DEVREIEKRVRDLIREIEKSNRDLEREAKRLIDEIDDLSRKLKEDADKLIEEIKELKKKVKDKRELTDRVRKILEEVERLLRESIERSKEVLKELEKLLRDDLKKVEDVLRTVEKILKDLLRRDKDSEEVRRVVEKLRRLLKTITEHVKEVLDRLRREAEDALRRDKEVADRIREEARRILEDVKK

SEQ ID NO: 7309 - protein, 186 aa, Artificial Sequence; identical to SEQ ID NO: 7308
  Synthetic

SEQ ID NO: 7310 - protein, 186 aa, Artificial Sequence
  Synthetic
DDVKRIEKEVRRLLREIERLTREHEKESRELVREIEELSRRLEEEIKRLIEEIEELRKRVKDKEKLTRDVERIKRRVEKLLKESEDRSKRVLDENRKSARESIERSREVLEELKRLLEDLLRRDKDSKEVRDVVKRLEEEIREVLAKDEEVARRSVEALADILRRDKDVVDRIRKLLKEILDRVRK

SEQ ID NO: 7311 - protein, 186 aa, Artificial Sequence; identical to SEQ ID NO: 7310
  Synthetic

SEQ ID NO: 7312 - protein, 174 aa, Artificial Sequence
  Synthetic
DREEVVKEIKKRLEDLNRRVREVVKKIDRELEKLLEESKRVVDDLRRRLEELKKRIKGDDAKRKVEEIVKEVEKILKRVIDDNKRLVDELKRLLEEVIRRSETSVRRLEDVLRREIQDERELERLVKEVEKTNERLLDELRKAAEEVAKRSEDTLRELRDIIKKVEERATDIAR

SEQ ID NO: 7313 - protein, 174 aa, Artificial Sequence; identical to SEQ ID NO: 7312
  Synthetic

SEQ ID NO: 7314 - protein, 174 aa, Artificial Sequence
  Synthetic
SKEDVVREIEKTLKDLLDDSRRVVRESEERLKELNRRLREVVKESKRRLDEALRRITGDELKERVRKLVEDLRKINKESIERSEKSVEELRRHSRKVIRDNEKLVDDLRRVLRRDIQDTEELRRLVDKVREDSERTLERDRRLAKEVSDRNKRLVEENRKIVEEVLKTIEELRR

SEQ ID NO: 7315 - protein, 174 aa, Artificial Sequence; identical to SEQ ID NO: 7314
  Synthetic

SEQ ID NO: 7316 - protein, 174 aa, Artificial Sequence
  Synthetic
EREKVVKKIKEDLDRLNEEVKRVVDESRKLLKRLNERVEEVIREIRKTLEELTRRITGDRMKERAEEIVKRVDDILKKVNKDSERSVRELERHSREVIERSRESVRRLEEVLRREIQDERELERLVAEVAERNKKLLKDDKDLARKVAEDNEDLLRRLRDEVEKVRRTADEIRR

SEQ ID NO: 7317 - protein, 174 aa, Artificial Sequence; identical to SEQ ID NO: 7316
  Synthetic

SEQ ID NO: 7318 - protein, 174 aa, Artificial Sequence
  Synthetic
SREEVVDELRKRLEELNKEVREVVRESERKAERALEEVEEMVKRVREELEKLKRDIKGDEMRREVDEIVRKVEEDLERVIREVKKLIDDLRRHSEDVERRSKESVDRLKEVLERDIQNKDDLRRLLKEVAERNRKLLEDDEELAERVLREVRRLLEELRRRLKEIKERLDEIRR

SEQ ID NO: 7319 - protein, 174 aa, Artificial Sequence; identical to SEQ ID NO: 7318
  Synthetic

SEQ ID NO: 7320 - protein, 174 aa, Artificial Sequence
  Synthetic
SREEVVRRADKLLKDLNKRVKEVIERSERKLRELNERVRDVVRKIEKRLEELERRIKGDELKDRVRRIVEELERKLREVIKRSEDSVEELRRHSEEVNRRSRESVERVKEVLKRDIQDEEELKRVITKVLRDNEELLKTDEELAEDVARKNKKLLDDLEKTVKEVMDRAEELRR

SEQ ID NO: 7321 - protein, 174 aa, Artificial Sequence; identical to SEQ ID NO: 7320
  Synthetic

SEQ ID NO: 7322 - protein, 174 aa, Artificial Sequence
  Synthetic
SREEVVRDIERRLRELNKRVADVADESRRRLEELNEKLRRVVEESRRRLEELRKEIKGDEAKKEVERLVEELERINRESEERSKKSVEDLTRHSKKVNDDSRKSVRRLEEVLRREISDDDTLRREVKKVERENERLLEEDRRLVREVTRRNEKLVKDNREIVKEVLERAKELTR

SEQ ID NO: 7323 - protein, 174 aa, Artificial Sequence; identical to SEQ ID NO: 7322
  Synthetic

SEQ ID NO: 7324 - protein, 174 aa, Artificial Sequence
  Synthetic
SREEVVKEIKDRLKKLNDDVKRVIKESEDLLRKLNEEVRDVVRKIEETLEELLRRITGDRLAEEVKKIVEELTKRLRDVIRESEKSVEELKRHSEEVDRRSKKSVERVEEVLRREIQDEERLKEVVAKVAKENKDLLRRDEELARRVAERNKKLVEDLRRLVEEVRRRAEELRR

SEQ ID NO: 7325 - protein, 174 aa, Artificial Sequence; identical to SEQ ID NO: 7324
  Synthetic

SEQ ID NO: 7326 - protein, 175 aa, Artificial Sequence
  Synthetic
SESERVEELLKEVAKRVKEVSDRSKRLLEEIERRVKEVSDESEELLRRIIDEAKKVDRRREVIKEAADRARDVVRKSRELVRKVVEELRKLLEESRELVKKVMDELRKMIEDLKRTGVEERVVDRVRRELEKLIKDLEENSREVERSLRELIEHLKKNVEDVEREAKRVIDELKT

SEQ ID NO: 7327 - protein, 175 aa, Artificial Sequence; identical to SEQ ID NO: 7326
  Synthetic

SEQ ID NO: 7328 - protein, 178 aa, Artificial Sequence
  Synthetic
SLEEKLRRVLDELRKTIETLLKTNKDVLKKLEEDVKRIIRRNEEVLRDLERKVRDLKKKGGKEEEVRRLLRELRRINRESEKEIEELLRELRRLSEEHKRRVERLLEELERILSEVEPDERLKRVVDELRKRAKKLLEDVERVIRKSEEEARRLLREVEKVVRELDREAEKLVEEVRR

SEQ ID NO: 7329 - protein, 178 aa, Artificial Sequence; identical to SEQ ID NO: 7328
  Synthetic

SEQ ID NO: 7330 - protein, 178 aa, Artificial Sequence
  Synthetic
SSEETLRDILKKVEERSEETLRHNERVLEEVRKEVERILRRNEEVLRRLEKEAKELKKRGGEREKVERLLKELRRINEESRKEAERLVRELKRVSREHLEESKRLLEELDKVLKSLEPDERLKRVVDDLERRIRELLERDERVIRRTEEEARRLLDDVRRVVEELDKRAEDVVKEVKD

SEQ ID NO: 7331 - protein, 178 aa, Artificial Sequence; identical to SEQ ID NO: 7330
  Synthetic

SEQ ID NO: 7332 - protein, 178 aa, Artificial Sequence
  Synthetic
DEEETLKKILDDVRKVSRDTMEENKTFLEELSKVADKIIRDNEKVLDDHRKAAEELKKRGGREEDVKRLLDTNREINERSEREVERLAEELRKISEESLEKSARLLKKAEDVLRSLPPDERLKRVVDDIRRSLEELLKRDEEVVEESRKEVKRLEEEVREVVTRSDKLMDELLKKVKR

SEQ ID NO: 7333 - protein, 178 aa, Artificial Sequence; identical to SEQ ID NO: 7332
  Synthetic

SEQ ID NO: 7334 - protein, 175 aa, Artificial Sequence
  Synthetic
SEKEEVLREAREEAKDIERRLERLLERDKEVIDRVEKDLERLLRENKKLIDDVRRRVEEEGPDERLKKELRDSLRESAERVKDLLRRLEEHLRRTAEELRKLAEDLRESIKRLRERIGDDEVMDEIRRLAERVERRLREVLERSKKLVDDLRERLKEVLKRIEDLYRRLEEEADR

SEQ ID NO: 7335 - protein, 175 aa, Artificial Sequence; identical to SEQ ID NO: 7334
  Synthetic

SEQ ID NO: 7336 - protein, 185 aa, Artificial Sequence
  Synthetic
TAKEVLDEIRKVHEDLNRKIEEVLKHSEDVLREVEERNERSVRHSEDMLRRLEERIDRKGREEELRRELDKDLDRLRREHEEHHRRLKKTLDDLRKEHEELARKVKKVSEDAERKLDEVRRKLKDNEEVLRKLLEENKKEIRRLEEELKRLNEEVKKRIKELEDSSRKENDRVRERIRELDERVK

SEQ ID NO: 7337 - protein, 185 aa, Artificial Sequence; identical to SEQ ID NO: 7336
  Synthetic

SEQ ID NO: 7338 - protein, 185 aa, Artificial Sequence
  Synthetic
TLDEAARTIEELLREVEERARRVLRHSEKVLDKVRKENEDSLRHSDEVLRRVEREAEKKGIDESLLKRLKEVLKRLRDEHREHHEDLKRRLKELKDKHEKLLRDLKRVLDEIRERVKEVKRDLKDEEEVIEKTLRDVERRLRDLEDKLRKLNEEVEKTIRDLRRSSEALNKKVKDLIKKLLDEVK

SEQ ID NO: 7339 - protein, 185 aa, Artificial Sequence; identical to SEQ ID NO: 7338
  Synthetic

SEQ ID NO: 7340 - protein, 185 aa, Artificial Sequence
  Synthetic
TLDEVAKEIEELLRRVEEENRKSLEHSERVLDEVRERNERSARHSEEVLRRLREEVRRKGIEEDKLRELEKRLEELRDDHRKHHEDLKRTLDELRKRHEDHHRRLKEELDRIRDEIRKVRRDLKDNEKVIKETLDRVRETIKRLIKSSRDLNEEVKRRIRELIESSRKKNEDVKKTIEELLRRVK

SEQ ID NO: 7341 - protein, 185 aa, Artificial Sequence; identical to SEQ ID NO: 7340
  Synthetic

SEQ ID NO: 7342 - protein, 185 aa, Artificial Sequence
  Synthetic
TADEVLKEIEDVHRRVNTENRKSIEHSKKVLEEVRRTNEKSIEDIERLLREVEKRIRDKGTEEDLLRKLEKVLDEIRKRLEDHHRTLEEVLRRLEKEHEKHHRELEEVSKDAKKKLDRLRKDLKDDEDVLRKALEENERLIRELEESSRRLNERVKELIRELEKSSKRLLDEVKKLIDELREEVR

SEQ ID NO: 7343 - protein, 185 aa, Artificial Sequence; identical to SEQ ID NO: 7342
  Synthetic

SEQ ID NO: 7344 - protein, 185 aa, Artificial Sequence
  Synthetic
TLEEVVEEIRRRHEEVNRRNRESVENSREVLERVEEDNKDSLRRIRELLERVARKLDERGVDETLKRKLEETLERIERELRKHHEELKETIERLERKHEEHHRRLEKVSRDAEREIEKVKRDLKDDEDAIRDMLRRNEERLRRLIESSEKLNRESRDVIRKLIESSRDLLRKVKETIEKLEEEVR

SEQ ID NO: 7345 - protein, 185 aa, Artificial Sequence; identical to SEQ ID NO: 7344
  Synthetic

SEQ ID NO: 7346 - protein, 185 aa, Artificial Sequence
  Synthetic
TLEEVVRDIERVHEEVNESLKRVNETTTDMHRRLNEEAKRVLEEIEKLLKDVEKKIRDKGTEEDLLRKLKETLDRIRKKLEKLLRDLKRKSDEAKKEDEKLEEELRRRSEDVKRKLEEVRKKLKDDEDAVKRELDRNREEIKKLEKRIRDVLKKNKDLIDKVREELKRLLDEVKKRIDKLAEEVK

SEQ ID NO: 7347 - protein, 185 aa, Artificial Sequence; identical to SEQ ID NO: 7346
  Synthetic

SEQ ID NO: 7348 - protein, 184 aa, Artificial Sequence
  Synthetic
SLDEAAKEIEELLRRSHEELKRVVKEIRDLLRRSHEELRRALEEIERLLDEVRRKLEERNVSEKLKKELEEVVKKVRDDLKRIREENKDDIRRLEKKLDDLRRKNEELIKKLREDLRRLKEEPVDDETVKELLRRVRKLVRESIEEVKTLLREAEEKVRRNERKVEEILRRVRETIRRLEERIK

SEQ ID NO: 7349 - protein, 184 aa, Artificial Sequence; identical to SEQ ID NO: 7348
  Synthetic

SEQ ID NO: 7350 - protein, 184 aa, Artificial Sequence
  Synthetic
SLDEALERIRRMLKRSHDENRRVAEDIKRLLEESHRENERVVKEIRDVLDKLREDAERNNISEELRDRLRRVVEDVERKLRESTKKNKKLIDDLRKRLEESSKRNKERIDELEKRLEDIKRKPVDDEDVKRLLDDVRRTVEENIRRSETELRDVKRRVTETIRESERLLEEVKRIIDKLREEAK

SEQ ID NO: 7351 - protein, 184 aa, Artificial Sequence; identical to SEQ ID NO: 7350
  Synthetic

SEQ ID NO: 7352 - protein, 184 aa, Artificial Sequence
  Synthetic
GLDEVLKEIRELLKESHDRLRRVLEEIEKLLEDSHRRNEEVVRRIRKVLEEVREKAERDNISEELRKKLEKVVREVEKRLEESTRKNRKLIEDVRRELEELKRKNEKVLDDLEKDLKRAKDEPVDERLVKELLDRARDKIRRNIEELERKLRAVEEKVRRTIRESEELLDRVRKIIEDLEREAT

SEQ ID NO: 7353 - protein, 184 aa, Artificial Sequence; identical to SEQ ID NO: 7352
  Synthetic

SEQ ID NO: 7354 - protein, 184 aa, Artificial Sequence
  Synthetic
DLDEALKEIERLLEEVERRNKEVLERIRRLLKRSHEELKRVLEEIEKLLRDLKKRVDDGNVDDELRKRAEKVIREVEDKLRRIEEKNREMIKRLEDELRRSSEELKKEVKRLRDELKDIKDKPVDRDSVRDLLRRAKERLDELIKTSKELLDRARKKVKENEEELRELLKDVRRIIKKLTEEVR

SEQ ID NO: 7355 - protein, 184 aa, Artificial Sequence; identical to SEQ ID NO: 7354
  Synthetic

SEQ ID NO: 7356 - protein, 182 aa, Artificial Sequence
  Synthetic
SELEDLLREVKELIDRLIDDSRRLVKTAEELIREAIKRSEDLLEEVKRLIDRVTEMVERGELDEDRLRELERRIAELIKRSKELSDELRRRIEKIIEDSKRRTEEALERIRRKIEELKKKRDDERVREVLERIKRLLEELKKRDEDSVREIERLLEELKRRNDRVVDEIRKLLKELAERVKK

SEQ ID NO: 7357 - protein, 182 aa, Artificial Sequence; identical to SEQ ID NO: 7356
  Synthetic

SEQ ID NO: 7358 - protein, 184 aa, Artificial Sequence
  Synthetic
DLDEVIRELEKLLKESHEAVKRVIKKSEDLLRDSHKKVKDVIRRSEDLLRKLEEEVRKNGLTEIEKRLRERAKELRDDAKRLEEENRKIIEDLERHARDLERKNRRIIEEVRRLLKEIKDRNSDDRTLLEELRRRIEELLKENRELLKRHEDKSKKLLEDNERLLREHAKKSDEIRRELRERVR

SEQ ID NO: 7359 - protein, 184 aa, Artificial Sequence; identical to SEQ ID NO: 7358
  Synthetic

SEQ ID NO: 7360 - protein, 178 aa, Artificial Sequence
  Synthetic
DEVERAKDVLDELRRRVEEELRRWKETSERLREESERALEKSEARLREAAEKLERVKRNNVSEDELKKLIDELDRILKELRKEHKELVEKWKKTIDEVRETLKRLLDKLEEILEKLARDGVDEEVLRDIREKLRELAERLKRLLDDDKRVLDEVRKANEDLLRKIKEDIEELRKELEK

SEQ ID NO: 7361 - protein, 178 aa, Artificial Sequence; identical to SEQ ID NO: 7360
  Synthetic

SEQ ID NO: 7362 - protein, 178 aa, Artificial Sequence
  Synthetic
DEDEEVKRTIEELRKEVEKTLREIEKSLKESEDKSRKHLEEVKKSLKETEEEVDELKKRNVDKEDLDRVVKKMEDNLKRLEDTARKLVREMRENLKRIKKRLEELTERLERTLDELRRRGVDEKVLRELEERVRRLKKELKRVLDDYKRKLEEAERRNRKVLKEYEDSLRELADRLRR

SEQ ID NO: 7363 - protein, 178 aa, Artificial Sequence; identical to SEQ ID NO: 7362
  Synthetic

SEQ ID NO: 7364 - protein, 178 aa, Artificial Sequence
  Synthetic
DEDREVRKTIEKLKRDSERHLEEMKRSAEESRKEVDKLLKKIKDSLRRTEERVRRLKKNNVSEEEVERLVREARENLERLREELERLERELRANLERLRKTAEDLTRRIRETLKELEDRGVPEEVLRELRKIVEELRKRNEDVLEEYERILRELKERLDRVLKEYEDRLRELEKELRD

SEQ ID NO: 7365 - protein, 178 aa, Artificial Sequence; identical to SEQ ID NO: 7364
  Synthetic

SEQ ID NO: 7366 - protein, 178 aa, Artificial Sequence
  Synthetic
SEAEKAKETIDRLADRVRKLLEEIKRSLDDSRRKSKETVEENEKTLDRMRKEVDAAKERRVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 7367 - protein, 178 aa, Artificial Sequence; identical to SEQ ID NO: 7366
  Synthetic

SEQ ID NO: 7368 - protein, 178 aa, Artificial Sequence
  Synthetic
EEDERADETLKRIKRESDETVKKNERTITELLKRVKRLVDEIRKSLEETARRVDSAKKRNVSEDELRKLVKELEDNLRRIAEELRRLEEELRRILEKLAEDHKRLIDKIRKILKDLADRGVSEEVLRKFRKILEEAAELNKEVIDRSRKIIEDASRLLREVLEDYETKLRELKDKLDT

SEQ ID NO: 7369 - protein, 178 aa, Artificial Sequence; identical to SEQ ID NO: 7368
  Synthetic

SEQ ID NO: 7370 - protein, 172 aa, Artificial Sequence
  Synthetic
SLKEVIDDLERIIRELEKRNREVIKRVRKIVREAEEKNEDVIRKLKETIERLERELDDEDLLRELREKLRRLVEHVKKVIEDLREEIRRLEKHVEDEIKKSKDRLDELTKRLKDLDSRELRDEIRKIKKKNDEHLKRLEDELRKLLEKSDRHVKELEDRIRKAAKEVKDAKD

SEQ ID NO: 7371 - protein, 172 aa, Artificial Sequence; identical to SEQ ID NO: 7370
  Synthetic

SEQ ID NO: 7372 - protein, 172 aa, Artificial Sequence
  Synthetic
SLEDVIRDLARIIEEAERRNKTVLDELRKTIKELVEENEKVLDEDDKKSRELEKRLDKEELLDRLRKENKKLKDHVRKKNEEAKKRLKELEDHVRRVIEELKRELDKLRREAKDLGSRRLREEIKRLLRESEKHVEDLRREIERIKRENEEHLKKWRRDSERLEKEVEDAKR

SEQ ID NO: 7373 - protein, 172 aa, Artificial Sequence; identical to SEQ ID NO: 7372
  Synthetic

SEQ ID NO: 7374 - protein, 181 aa, Artificial Sequence
  Synthetic
DELEKLRDDARRIEEKHRRTVEKDKDVVRRMDKEVKDHVRRLKELAKKLEDDVRKRGDEKVIKELEEKLKRIHEESEKTKRKLKEDADRLEEDNERVKKESEDKLRELRERARKVKEDGIDKRSVDEVLREITEIVERVMELNDKSVEETRRIVERLKEEIDTVNDEIAKIVRKVIEEIKR

SEQ ID NO: 7375 - protein, 181 aa, Artificial Sequence; identical to SEQ ID NO: 7374
  Synthetic

SEQ ID NO: 7376 - protein, 181 aa, Artificial Sequence
  Synthetic
DELERLKEAAKRLADEVKEHVDRSRENAKRLKEEVEEHVKRLEDVARTMDEEVKRRGDDRVVKRLREILKKLHEESERTIRRMRRNLEENHRRTEESKKRLRDKLEELKRRLEKFKEDGVDKESVDRVLKEIEDIVRRLEERLDESNKELKEIVDDVTEKLERVNRKIAEIVKRLSDEIRK

SEQ ID NO: 7377 - protein, 181 aa, Artificial Sequence; identical to SEQ ID NO: 7376
  Synthetic

SEQ ID NO: 7378 - protein, 181 aa, Artificial Sequence
  Synthetic
DELEELRRAAEEMEKEVREHVKRSEKNAKDLEKEVREHVKKLREVLRRLTEKVKRRGDERVIEDIRRTLKELKDESDETEERMRRNLEENHRRTEESKRRLEEKLERLARKVEEVKRKGIDKEKVDRVLEEITREVERLKKELDESNERLERIVRKVIEELRKVDEDAEERVRRLEEEIRR

SEQ ID NO: 7379 - protein, 181 aa, Artificial Sequence; identical to SEQ ID NO: 7378
  Synthetic

SEQ ID NO: 7380 - protein, 181 aa, Artificial Sequence
  Synthetic
DDLDRLREAAERMAREVEDHVRKLKDLIRRVRERVERHVKKLEDDLKRVKEEVDRRGDKKVVDKLRRDLERLRRETEKSKRELEEDLKRAKDESRKTLTRLRDALERLREEVKRVEDKGIDKDKVRKVLEDIKRIVDRLEERIREVDKDLERIVRELMKRLDEVNKRLEDTVRRLSEEIRR

SEQ ID NO: 7381 - protein, 181 aa, Artificial Sequence; identical to SEQ ID NO: 7380
  Synthetic

SEQ ID NO: 7382 - protein, 185 aa, Artificial Sequence
  Synthetic
DLIEEIKKLAEDHHRRVKEVLDRNREVAERLKKRVRRIVEENKRLAEDVTRKIKELKRRVKDRDELRRRVEEIERRLKKHIDDSNRRITELKEEVERHLERSERELEKSKRDLERKLREVEKRKRTEDLRRVLEELREIVTRNEKEIRDTIRELEEIVKRLKEDNDRSVRELERILEELREELER

SEQ ID NO: 7383 - protein, 185 aa, Artificial Sequence; identical to SEQ ID NO: 7382
  Synthetic

SEQ ID NO: 7384 - protein, 175 aa, Artificial Sequence
  Synthetic
DSDEEVRRVLEKVEEDVRRLAKDIRDSVRRSEERIDELVKKLEKSIDESRRRVETTADNVEELKKIIKDSKEELKKVVKTVRKVLEDSKRELEKVLEDVKRTIKDLKDEVRKMREEGRVDERLLEEIEKVVEDLRRKAEELIEKNERLLRRLEEVAKELDKRNKELLEELIRRNE

SEQ ID NO: 7385 - protein, 175 aa, Artificial Sequence; identical to SEQ ID NO: 7384
  Synthetic

SEQ ID NO: 7386 - protein, 175 aa, Artificial Sequence
  Synthetic
SEADKVREVLKRVKEEIDRLVEEIEKVNRDSRREVEKLVEKLRKSLKESKDRIARDLDRVDEVRKILKDSKERLEKVIREVRKAIKDTHEELRKRVEDVERELKRLVEEVEDMIRRGNVDEELLRKIEEVLRRLTEDAKRLIRRNREILKELRELAKRLDEENKELLDELIKKAR

SEQ ID NO: 7387 - protein, 175 aa, Artificial Sequence; identical to SEQ ID NO: 7386
  Synthetic

SEQ ID NO: 7388 - protein, 182 aa, Artificial Sequence
  Synthetic
SMIEKVREVLKEVADRVRRLLEENKKSIDDSARALEELIKRIRESLRKSEEDLKREVRGEEERRKVRRLLEESKRKIDEDEKRVEKRLRDSEKSSRDLAEDLRRVLEDIERKIEEVAKRLKDDSEFVKRILDEVDEILKRLERRVKEHSRKNREELEKIRKEAEEILRENEELLEKIVRDAR

SEQ ID NO: 7389 - protein, 182 aa, Artificial Sequence; identical to SEQ ID NO: 7388
  Synthetic

SEQ ID NO: 7390 - protein, 182 aa, Artificial Sequence
  Synthetic
EMVERLEESIDRSRKELDRLIEENKKVLEEVEERVRRLIEKLKRSIEESEERLRRKVRGEELAREVKKLLDDSRRRLEELKERAERVLRELKKSSEDLARDVKRLLKESREKLEELARKLKDNDEVVRRLNEENKKLLEDIRRRAKDHSRRVREILEDLEREVEKMNEENKDLLERIVRRAK

SEQ ID NO: 7391 - protein, 182 aa, Artificial Sequence; identical to SEQ ID NO: 7390
  Synthetic

SEQ ID NO: 7392 - protein, 182 aa, Artificial Sequence
  Synthetic
SMIEALKENIRRSEEEIRRLIEEWRKVSEDIEREVKKLIKELEESIDESAKRLREKVRGEEELTRVEKLLRDSEEELKRLAEELEEVLKRNKDKVKEEVERARKLLDDSRRKLEKAERDLKDDSDFVRKLLEENNELLKEIKKRVEKVLEESKELLKELREKIRRLNEKNKKLLEEIVRRAK

SEQ ID NO: 7393 - protein, 182 aa, Artificial Sequence; identical to SEQ ID NO: 7392
  Synthetic

SEQ ID NO: 7394 - protein, 178 aa, Artificial Sequence
  Synthetic
SEIEKVVKDLRERLKELRESVKRLDDKNRELLERLEREVEEMDRRNEKLLRDLKRQDRDEKDLRRVIEKSKEDLRRLEEKLKEVIKRSEEELEEHVKRTRDVIERLKRRVEKLARDLDKEELLRTLEKVLREIAEELERLNRKVRESIRESARRLKRLIEKLERSIRRSAEELRKRAK

SEQ ID NO: 7395 - protein, 178 aa, Artificial Sequence; identical to SEQ ID NO: 7394
  Synthetic

SEQ ID NO: 7396 - protein, 178 aa, Artificial Sequence
  Synthetic
DEIDKIVKKLRDILREIEKRAKEVNKRNKELLDELRERVKDLDRTNEELLRELKDSDRDKKDMERVIRESEDRLRKLEEELRRVIERSERELRRLEKEARDVIEEMERDVRRIAKDLDSDKLLKKLKDVLDEIAERIKELIRELRESIKKSAEELKRLIDRVRRSIEESAKRLEDRAR

SEQ ID NO: 7397 - protein, 178 aa, Artificial Sequence; identical to SEQ ID NO: 7396
  Synthetic

SEQ ID NO: 7398 - protein, 178 aa, Artificial Sequence
  Synthetic
SELEKILEKLRRIVEELAKSVRKLNEENKELLKRLADSVKKLDDDNKRLLTDLRRRDNDEKDAKRVIDKSRDDLRKHVERSREVIEDSKRKADKHVEDTKRVIETLKREVDEIARELDSEELLRTLEDVLRKIAEDLERMNRELKRSIKKSADDLKRLNEKVKRSIERSAEELRKRRT

SEQ ID NO: 7399 - protein, 178 aa, Artificial Sequence; identical to SEQ ID NO: 7398
  Synthetic

SEQ ID NO: 7400 - protein, 178 aa, Artificial Sequence
  Synthetic
DEIKKIVEEIKKTLEEIDKSVRELIRRAREILRELEESVRELIRRNSKLLEDLRRQDRDEKDARRVIEESRRELEEHRKRSEDVIRKLREEVEKHVRETEEEIKRIEDEIRRLKEKLDKDELLKELEDVLKEVAEEIKRLNERLKKVLEEIERTLRELNRRLEENIRRSARALEETRR

SEQ ID NO: 7401 - protein, 178 aa, Artificial Sequence; identical to SEQ ID NO: 7400
  Synthetic

SEQ ID NO: 7402 - protein, 178 aa, Artificial Sequence
  Synthetic
SEVEDLLRRIEKILEDLRRSVEELLKRIEDALRRLEEEIRKVTEESKRLLEDLTRRDTDEREAREMIKENEKKLRDLEKKLRELIKRLKEEVDKHVKDTRDVLTRIREEVRKMAEKLDKRELIEEVEKVVKRVEEALKRLNDRVRETLDEVRKRLEDAIRRWREESERIARELEKRTT

SEQ ID NO: 7403 - protein, 178 aa, Artificial Sequence; identical to SEQ ID NO: 7402
  Synthetic

SEQ ID NO: 7404 - protein, 178 aa, Artificial Sequence
  Synthetic
SEADEIVRRIEELLKELEREIRKVIRDSERLLKELEDSVRELLKKIRDVLDELTKSDRDEKEARDVIRKLAKEVEDHLRRSKEVIDRNRKKLEDAEEKLKELIERIKREIDEIKRRLDSEELLRKLEAVLDKVKKDLKKMIDDWRRVSERIARELEKLNRRVKEELDRVKEALDERTR

SEQ ID NO: 7405 - protein, 178 aa, Artificial Sequence; identical to SEQ ID NO: 7404
  Synthetic

SEQ ID NO: 7406 - protein, 178 aa, Artificial Sequence
  Synthetic
SEIDEVVERIKRTLEEAEKRVKKASEDHKRRLDELRKKVEKLIEDNERTLEAVARRKIDEELLKELEKESEDRLRKLKRDAEEVTREMKKTSDELAEELKRLKDEIRKELERLEREGIEERLLRKLRKVVKDVDDRLKELLEENRDVVRRIKEELEKLLEKVRRSIEESRRRMRETRR

SEQ ID NO: 7407 - protein, 178 aa, Artificial Sequence; identical to SEQ ID NO: 7406
  Synthetic

SEQ ID NO: 7408 - protein, 178 aa, Artificial Sequence
  Synthetic
SEVDEVLKDIRRILEEARKRVEELDRENKRILDEVREKVKELNERNKEILRAAEERKIDDDLLRKLVEDSRRLLKELEEELRRLTERSKKLLKELAEEMDRLVKEIEDKLRKLREDGIDEKLLRDAKRVVEEVSKALKDLLKEVEDSVRRSKREMEKLLEELRESVKRSEEELRRTSK

SEQ ID NO: 7409 - protein, 178 aa, Artificial Sequence; identical to SEQ ID NO: 7408
  Synthetic

SEQ ID NO: 7410 - protein, 182 aa, Artificial Sequence
  Synthetic
DEVEDLLRRNEELLKRLLEEIKKLTDEHREELKRLAEDVKKVVEDVRRLLKELEEMVRRGELDEKTLDEARRRLEKLLKELKEKIDRVKEEMEKSNRKLEKKIRDAKRTTEEILKRLKDKGVDEKLVRKLEESVRRSTEELEKALKRNNDVIRRIAEALDDLLRRLEKVIREIEKKLRDDTR

SEQ ID NO: 7411 - protein, 182 aa, Artificial Sequence; identical to SEQ ID NO: 7410
  Synthetic

SEQ ID NO: 7412 - protein, 182 aa, Artificial Sequence
  Synthetic
DRVEEAVKDIERLLRELKRDVERLVRENEKILKDAKREVDELTKDHRRKVEELDEMVKRGELDKDTVDRVKKEMKETNEDLSRKATEIKKRSEDILRRLEEKIREVRKRLEKLLEELRREGVSEDLLRKLEKVVRDVEKKLRKLLEDLKRSIDRSTRELEKLNEKNNEVIRDIERRLDEAET

SEQ ID NO: 7413 - protein, 182 aa, Artificial Sequence; identical to SEQ ID NO: 7412
  Synthetic

SEQ ID NO: 7414 - protein, 178 aa, Artificial Sequence
  Synthetic
SEIEKLIEEIRRVVKEIKREVERAIRENEKLLRESKRRNDELIKEIERVVEELKKRNVPEEDVRKVLADLEKKLEELHREDRKLIKESEELLKRLMEEAEKILEELKRRLDELIRRRGRDRLIEELEKVLRDVEKVARDVLRKLRRSIEESRRRSEELNKTVKKVLEDVARTATERSR

SEQ ID NO: 7415 - protein, 178 aa, Artificial Sequence; identical to SEQ ID NO: 7414
  Synthetic

SEQ ID NO: 7416 - protein, 178 aa, Artificial Sequence
  Synthetic
REIEEAIKDVERVLRESEERNRRLIERIKRMLKKSEDENRKFIEDNKRLADDLRRRNVPEEDVRRTIERSRRELEKLVKRDEDLLKRLEEELRKLHEDDRRLLEELERKVEDIIRKRGRTEDVERLRKVIEEVKRRMKELNERLKEELREVAKRSRDLNKELRESIEESADRARRRRK

SEQ ID NO: 7417 - protein, 178 aa, Artificial Sequence; identical to SEQ ID NO: 7416
  Synthetic

SEQ ID NO: 7418 - protein, 178 aa, Artificial Sequence
  Synthetic
DEIERLREDIKRVLEESTRRNKKLLDEIRKALDESRRKNEEAIRRNEEVVRDLKDRKVPDKKVKEVIDRNRRMLEELVRDDKDLLKRLEERVRELHETDRKLIKDLRELLRRIIEKRGETDKVRTLRRELEEVARALEELNRRVEEELDEVRKESERLNKELEDSIRKSAEDAKRTTK

SEQ ID NO: 7419 - protein, 178 aa, Artificial Sequence; identical to SEQ ID NO: 7418
  Synthetic

SEQ ID NO: 7420 - protein, 174 aa, Artificial Sequence
  Synthetic
DEKDKAIEDVRDLLRRNEEVARRMDKRLKDLLDTIRKKAEDLDRELKRLLEEAERLVREGTTEELVKKLKKELDDSRRRLEKLIEELRKRLRDSIRELEEHLKRSEEELRRLLEEVKDVKELEKVLEEIRRRSEELLKHHAEVIERIERDVERLRRHHEDTIRKIKEKVDRDRK

SEQ ID NO: 7421 - protein, 174 aa, Artificial Sequence; identical to SEQ ID NO: 7420
  Synthetic

SEQ ID NO: 7422 - protein, 174 aa, Artificial Sequence
  Synthetic
DEDREAIKEVEKLLRDNERVARRLDEEVKELLDEMRRRSEEMDRELERLLEEAKRLADKGTREELVKELEKRLDESHDRHRKLVEELEERLERSIEELRKHLDDSRRRLKELEDRVDKVEELKEVLREVDKRSKELLKHHKRRIEEVRKRVRELNKHHEDVIRKIKKKVREDRK

SEQ ID NO: 7423 - protein, 174 aa, Artificial Sequence; identical to SEQ ID NO: 7422
  Synthetic

SEQ ID NO: 7424 - protein, 174 aa, Artificial Sequence
  Synthetic
KEAEEAIKRVEDLLRRNKEVAERIIREIRRLLREADETSKRMDEDLRRLLREAEDLVRRGTTEEVLEELKERLKESHKEHKKKVDELIERLRKLLEDLERHIRKSDRDLDRLREEVKDVRELDKVLERVKRESDRLLKEIEKVVREVEERLRRLNEHHEKVIREIEKKLEDDRR

SEQ ID NO: 7425 - protein, 174 aa, Artificial Sequence; identical to SEQ ID NO: 7424
  Synthetic

SEQ ID NO: 7426 - protein, 174 aa, Artificial Sequence
  Synthetic
DEDREAIERVRRLLDENRKVVEELDERLKELLRDAEEKSRRVIKTLRELLKEIEDLARRGTDREVAEKLRRALEELHRRHREMVKELKERLERSIKRLEEHIRKSKEDLDDLRRKVDKVDELRKVLEDVERASKELLDHHRDVIRRIEEELKRLNKELEKVIREIERAVEELER

SEQ ID NO: 7427 - protein, 174 aa, Artificial Sequence; identical to SEQ ID NO: 7426
  Synthetic

SEQ ID NO: 7428 - protein, 174 aa, Artificial Sequence
  Synthetic
DEDRDAIRKVEDLLRRIEEIVRRLIEEVKRLLEDNRRKSKRFIERVDELLKEMEKLVREGTDAEMVRELKDRLRRLHEEHADHVRDSARRLDELLRELERKIKELEDRLRDLEEKVKDVKELEELLRRVEREVEKLLTDLRRLLREVKETSKRLNEELKRRADEVEKKADEDRK

SEQ ID NO: 7429 - protein, 174 aa, Artificial Sequence; identical to SEQ ID NO: 7428
  Synthetic

SEQ ID NO: 7430 - protein, 181 aa, Artificial Sequence
  Synthetic
SSKDRIRKVLEEVRETLDRLAKRIEKSLRDSAKRVEDLAEENRTSLKETKERIDELIKRRKDRDRAEEVKKRLDESRRHVEEDEKRVREDLRRSADEARRVLDELRKTLEKLRKEVEDVIREGKLGEELIRRIEEELKRIEDTVEKIIRKDEKLLEDIERESERHIREDKELLKELEKEER

SEQ ID NO: 7431 - protein, 181 aa, Artificial Sequence; identical to SEQ ID NO: 7430
  Synthetic

SEQ ID NO: 7432 - protein, 181 aa, Artificial Sequence
  Synthetic
SSDKEIEDVLRKVKDELDKLARALDESLKRSEKDIDRLEEELKESHDRTREEIRKLIEERNVDKLAEDMKRKLKESLKEAREVVDEVRKRLERSRREIEKMIKKLEEDLRTLERKVREVIKRGRLGDELIREIKKVLDRIREEIERLLREDEELLERLREDAKRILDKNKELLDELRRRVK

SEQ ID NO: 7433 - protein, 181 aa, Artificial Sequence; identical to SEQ ID NO: 7432
  Synthetic

SEQ ID NO: 7434 - protein, 181 aa, Artificial Sequence
  Synthetic
SADRKLEEVLKKVEDDIRDLERRLKRSLDESKREVERLERENRRVLEEVEKKVRADNVDEERLREIKRVVDEAKESLRELVRRMRKVLEDSTREIEELRRRLREVLKEIRKEVKEMRDRGESEETVKRIIEKIERILRKLKRDAERILDKDRKLLKKLEEESRKHIEDVKRLLEELERRTR

SEQ ID NO: 7435 - protein, 181 aa, Artificial Sequence; identical to SEQ ID NO: 7434
  Synthetic

SEQ ID NO: 7436 - protein, 181 aa, Artificial Sequence
  Synthetic
ELEEKLKRSLEDSRRRVEELRRTNEEVLREVEEEIRRLIKENEDSLRESKKRVDDRNVEREKLEKAKKVLEDSERSLRKLAKEARDVLREMRETLRKLEEKMERVLRESEKEIRRVATRGESKETVDKILEDDKELLRRLEEESKRHIDEVRKILEDLERRSRRHIEEDKKLITELEKETK

SEQ ID NO: 7437 - protein, 181 aa, Artificial Sequence; identical to SEQ ID NO: 7436
  Synthetic

SEQ ID NO: 7438 - protein, 181 aa, Artificial Sequence
  Synthetic
DLDERLRRSLKRSKEEVERLRKENEEVLRRSKETTKELIKTNEKVLEDVERLVRESNVDEERLRKAKEVLDRLRESLKKLAEESRRLNKRLEETLRKLVRDMEEVLRRSEEKIKEVDTRGESRETVEKIIKEDEDLLRKLKEESDRHIKDVERVARENERESKRHIEEVRKVLDELREETR

SEQ ID NO: 7439 - protein, 181 aa, Artificial Sequence; identical to SEQ ID NO: 7438
  Synthetic

SEQ ID NO: 7440 - protein, 181 aa, Artificial Sequence
  Synthetic
SAEEKLEEVLKRVAERIEELIRRNRRVLDRVREEIKRLVEENRKSLDESERRVRERNVSREKLERAKELLDRSKDSLRRLEEELRERLKDLERTLKELEERAKRKLEEIKKEVKDVADRGESEETIERIIKKIEDILRKLEEESERHIRRVEEELKEMEKRSREHIEEDKRLLEELERRTK

SEQ ID NO: 7441 - protein, 181 aa, Artificial Sequence; identical to SEQ ID NO: 7440
  Synthetic

SEQ ID NO: 7442 - protein, 181 aa, Artificial Sequence
  Synthetic
SAEDELRKVLEKVREDIDRLADENRKVLKRSKDETKRLIKENREVLERVEEIIRRDNVDRKDLEEARRVLEEARRSLEELVERSKRLNDRLEETLRELIKEAKRVLEEAEREVREVATRGESEEAIERIIRRIREILERLRKKSEEHIRRVEDVARRNEEESREHIKTVEKILEELKRKAD

SEQ ID NO: 7443 - protein, 181 aa, Artificial Sequence; identical to SEQ ID NO: 7442
  Synthetic

SEQ ID NO: 7444 - protein, 179 aa, Artificial Sequence
  Synthetic
SEVEELIKRLKKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRKEVEELDRRIEKVLKEIEEKIREVIKEWERVHREVNELLKRLIDENRKVLDEIRKLLEEKSK

SEQ ID NO: 7445 - protein, 179 aa, Artificial Sequence; identical to SEQ ID NO: 7444
  Synthetic

SEQ ID NO: 7446 - protein, 179 aa, Artificial Sequence
  Synthetic
SEAEDLIRRLKEVLDELKKKADDLIRDTKRLLDEIRKKSEDHIKRDKELLKDLKRRDTRKDEAKRVLEESERTLRELERDLERLLEKDRRDMEEMVKELRRVLEELRREVERLKEERKEVDRALREIEKVLKEIKELIEKVIRDWKRVHDEVNEELRRLIEKNRKSLKETADELDRKRK

SEQ ID NO: 7447 - protein, 179 aa, Artificial Sequence; identical to SEQ ID NO: 7446
  Synthetic

SEQ ID NO: 7448 - protein, 179 aa, Artificial Sequence
  Synthetic
SEVEKLIKEDKELLERLKRDVERLIEELRRTLKELKKESEKHIEDDKRLLDDLRDRDTDDKVAKDALRRSKETLEELVEKLKRVLDELRKKVKELMDRARRVLEESRKRVEELKERRKEMDKLITDIRRSLDETRRRIEKLIREIEKVLREIEETLRELEKRNRESLERTRETLERKSK

SEQ ID NO: 7449 - protein, 179 aa, Artificial Sequence; identical to SEQ ID NO: 7448
  Synthetic

SEQ ID NO: 7450 - protein, 183 aa, Artificial Sequence
  Synthetic
SEVDELIERDKKLLRDVERDVRRLNKEVRDILDEIRKDVEDALKENKELLDRLREMVKRGEADERTAEELRKTSEDLLRELEKRAREIEERLRRTLEELAKRLERVIRESRKLLEDLRRRRREMREVLKRLEDSSKDTTDKLRELLRSHKKVIDEVREKLKELLDRYRKVSDEIREEIDRARK

SEQ ID NO: 7451 - protein, 183 aa, Artificial Sequence; identical to SEQ ID NO: 7450
  Synthetic

SEQ ID NO: 7452 - protein, 183 aa, Artificial Sequence
  Synthetic
SEVEKLIEDDRKLLEDAEEEVRRNNREIERILDKAREDVKRIIKEIEDLLREADEAAKRGEVDEDVVREVAKRIRDLLEELRRRAEEIKRRLDRSHEELRRALEEVDKRSKELLDDLRRRKKDAEEAKRRIKKSIDDSRRELKRLLESNRKVIEEVKKTLEELIRTLEEVVRRVEDRLKKLAD

SEQ ID NO: 7453 - protein, 183 aa, Artificial Sequence; identical to SEQ ID NO: 7452
  Synthetic

SEQ ID NO: 7454 - protein, 185 aa, Artificial Sequence
  Synthetic
DSVEELLKRLRDLLEESKRRAERLIREIERLLRESEKRVRELNRRLEELLREAEDRVRKEGPTERLEELVEELKRRLKRSSDELKKHLDESRKRLKEIIEEVERHIERSVREMRRILEELRKEGAPEDALRKLEKVIREIEREHRRLLEEIRRVLKEVDKRHDEVRKSHEDVIRRIEERLERLKK

SEQ ID NO: 7455 - protein, 185 aa, Artificial Sequence; identical to SEQ ID NO: 7454
  Synthetic

SEQ ID NO: 7456 - protein, 185 aa, Artificial Sequence
  Synthetic
DSVERLIEEIRRLLKRSEEIARKLIRDAEKLLEEHRRRVEELNREIERKLEELDEKARRRGPTEELKDTVRKLREDLDRSLEDLRRHSERLKEELDRLLKELEEHIERSKKRLDEIEEEVRKEGVPREALEKIRKVIKEVKDTHRDLLRRVRDVIRRIREASKETERSHREVIERVRKRLDELTK

SEQ ID NO: 7457 - protein, 185 aa, Artificial Sequence; identical to SEQ ID NO: 7456
  Synthetic

SEQ ID NO: 7458 - protein, 185 aa, Artificial Sequence
  Synthetic
KSVDDIIREIRKLLEDHKRRVDELLERLKKLLEDHRRTVDKLIKDLERLLEELARRVKREGPTERVRKLVKEAEDRMRELTKRLEEHSKKLKDDLRRILEDLRKHSDDLRRRLEKLLREVEEEGVPREALERIREEVRRVEEASERTLRELEKVVRRIERESEKLKRELEKVVEDAKRTLEKLIE

SEQ ID NO: 7459 - protein, 185 aa, Artificial Sequence; identical to SEQ ID NO: 7458
  Synthetic

SEQ ID NO: 7460 - protein, 185 aa, Artificial Sequence
  Synthetic
SSIEKLLEELKELAKRHEDEVKKLIRELEDLARKHKERSEKLNEEIKKLLKELADRVRERGTTEEVEEMIKEVRERLERSHDDHRRHSERLERELRRLLKELREHSDRLRRELERILKEVDEEGADERVRRRLRKVVEEIKERSDRTIREMEKVIREIKEESRRLNKSHEEVIRDVKRRADELRK

SEQ ID NO: 7461 - protein, 185 aa, Artificial Sequence; identical to SEQ ID NO: 7460
  Synthetic

SEQ ID NO: 7462 - protein, 185 aa, Artificial Sequence
  Synthetic
SEVEDLLRDLERLLEEHRERVERLIKRLRELLERHKRTVEKLNRDVKEKLRKLKKEAEDKGPTEELEELVKRVEEDLRRSLKELREHSERLKRELKELLDRLRDHSRELEERLRRILKKLEEDGAPEEALRRLKRVVEEIKRRSDRLIEKAEEVIRDIEEKSEETLKSHREVLERVKKILTDLRK

SEQ ID NO: 7463 - protein, 185 aa, Artificial Sequence; identical to SEQ ID NO: 7462
  Synthetic

SEQ ID NO: 7464 - protein, 185 aa, Artificial Sequence
  Synthetic
DEIDRLLEDLRRLLEEAERRVTEIIKRIKKLLEEHERRVRELNKDLRRLLEEAEDVVRRKGPTEELEDLARKLKETLEESLRRLEEHSRRLEKELRDLIDELRKLIKEVKDRLEEILREVEKRGVPEKARRDLERVVTEIDRELKRLEEDIRRVLEEVKRRSEDLRRSHRRVIEDIKRRLEELRR

SEQ ID NO: 7465 - protein, 185 aa, Artificial Sequence; identical to SEQ ID NO: 7464
  Synthetic

SEQ ID NO: 7466 - protein, 185 aa, Artificial Sequence
  Synthetic
KEVEDIIREIRKLLEDHERKVKELIDEIRRLLEEHERTVRDLNRRIKKLLEEAKEFADRKGPTEEADKLIKELTERLKKSLEDLKRHSDELKKTLEEILERVREDSERLEKRLREIEDKIRRDGVPKEMIDRVRKVVEEVKKRSRETLERIRKVIEEVKARSKELIESHEEVIKRVEETLKRLKD

SEQ ID NO: 7467 - protein, 185 aa, Artificial Sequence; identical to SEQ ID NO: 7466
  Synthetic

SEQ ID NO: 7468 - protein, 177 aa, Artificial Sequence
  Synthetic
SLEEEIKKLLKEVRDVNDRLKETIEDLAEKIERLAKRMIERIEEILREVDRLVKEVNLPEEMKKRVRDLLERIRRELEELLKELRKLLKRIRERHDELKKRSEENIKRIEDELRKTGEEDVIREILKEIRKHLRDSEEENKKTLDTLRKILEDLTKAAEDILEEIRRELDRLRKEAT

SEQ ID NO: 7469 - protein, 177 aa, Artificial Sequence; identical to SEQ ID NO: 7468
  Synthetic

SEQ ID NO: 7470 - protein, 179 aa, Artificial Sequence
  Synthetic
SELEDILRRLREEVKRLREESRKLLEDNRRLVEEVKRESDKVLKRLKDKADRLKELAERGDLDEEMAERVERELRRILEEHKRKSKEIEDESEKLDREHKESTREVVERIKKELDDARRRGIPTREIKTVIDELTRELERLNREHEDLTRKLREELKKLNKRIKDLIDTLKKLLEDLKK

SEQ ID NO: 7471 - protein, 179 aa, Artificial Sequence; identical to SEQ ID NO: 7470
  Synthetic

SEQ ID NO: 7472 - protein, 171 aa, Artificial Sequence
  Synthetic
SEEEKLRELVKEVEKRTRELNENLRRSIEEVERDTEELDKNLEKSIREVKKVLDDLNLSDDDVRKVEEDLRRLHEEHRRHVERSRRRLEELYRRHERHARESKKELKELEDRGEPAEDVLRRIRELLERNEEVNRRLDEASKRLLEENRRKNKKLDDDSKELLKRLTERAK

SEQ ID NO: 7473 - protein, 171 aa, Artificial Sequence; identical to SEQ ID NO: 7472
  Synthetic

SEQ ID NO: 7474 - protein, 171 aa, Artificial Sequence
  Synthetic
REKERLEKVIRELETKARELNKNLKKSIDDVRRETERLNENLKRSVDELRKRLKDLNLSRDDVERLDEELRKLEREHHEHVERSDRELKKLYDRHEETIREVEERARELKERDEPAEEVLKELRKLVEELERRNRELDKRSKDLLRENRELNKDLDRKSRELMERVERKTR

SEQ ID NO: 7475 - protein, 171 aa, Artificial Sequence; identical to SEQ ID NO: 7474
  Synthetic

SEQ ID NO: 7476 - protein, 171 aa, Artificial Sequence
  Synthetic
SEEEKLERLIEDLERKLKELNDNLKESIDRVRKRTEELNRNLRESIKRVKEELERQNLREDTVRDLEEKLRELHKRHEDHARRSDKRLKELHKEHEDLIREVEKRLRELRRRGEPAEEVLRELEKLVEDLERENRRLDKESKDLLEENKKVNKDLDDESKRLLEEVSKEAK

SEQ ID NO: 7477 - protein, 171 aa, Artificial Sequence; identical to SEQ ID NO: 7476
  Synthetic

SEQ ID NO: 7478 - protein, 178 aa, Artificial Sequence
  Synthetic
SDKEDVTRLLEEVSRASERSRKRWKDSSDEVKRTSEESIRRLRELLERLRERIERVIREKKDDDLRRKLERLLERLERIIRELEKRSKELNDKNEEDAERVTRESKELNDRLKKEIDRDITDVDELRKKIEEIVKRDEDLVRRLLEDSKRLAEEDRRLLEEVKREIDEIRKRIDEEVK

SEQ ID NO: 7479 - protein, 178 aa, Artificial Sequence; identical to SEQ ID NO: 7478
  Synthetic

SEQ ID NO: 7480 - protein, 182 aa, Artificial Sequence
  Synthetic
DEIDELVRRIEELAERHHRRVDEIVKRNEEVLKELDERARRLVRENEEVLKRLEETVRREGPRDELAERVEEHLRDSERRVRELERRLEEHIKRSEEELDESTKRLEDELRKVAEELKRRNMEERAEKRLRDVLEKLRRDVERNREEIKKSAEDVRREVKRVTDELKESIERVRKRVKELKD

SEQ ID NO: 7481 - protein, 182 aa, Artificial Sequence; identical to SEQ ID NO: 7480
  Synthetic

SEQ ID NO: 7482 - protein, 181 aa, Artificial Sequence
  Synthetic
EAERKVKTVVDELRRIVDELAKELEESLKRTDETIKRLARELERVDRELEEIIKELERKGLSEEEVRKLRETLKKLHEENRRVIEELEREVRESEETLRRVIEEIKKRLEDLRRKLDKLAKDGRVDDEVVRKVEEEAERIKKRIKDLVRRDEKLVEDMRRRIKRLVEKNRKVAEKMRTDTD

SEQ ID NO: 7483 - protein, 181 aa, Artificial Sequence; identical to SEQ ID NO: 7482
  Synthetic

SEQ ID NO: 7484 - protein, 185 aa, Artificial Sequence
  Synthetic
DLEELLRKVLEELRKIVEDARRENEKSLRESEKIVREVEELNKKVLEEVEKKIREVIEEKKEDKELVDEMRRVLKELEDRSRKLTDETRKKLKESEEKSRKLTEETKKVLEDLRRKLKEVADRGESEETIKRIVDEIRKEAERLLRRHRKSVKEDKDLAKKIREDHKKSVEDIERTLEELEKRAK

SEQ ID NO: 7485 - protein, 185 aa, Artificial Sequence; identical to SEQ ID NO: 7484
  Synthetic

SEQ ID NO: 7486 - protein, 175 aa, Artificial Sequence
  Synthetic
SEIEELVKEIKKVADEVRRRHEKSVREIERKLEELDKKVKDLVDEDKKLADELRRRNEDKETLDRVLKESEEKVRRLARDLERVLRESREESRRLVEDTRRLLEELEDKVRRINAGDRVRRELERVLRDVERIIRDVKRTNKRVDDDVERRIRELRKELEDSLRRSKRIVDEVRR

SEQ ID NO: 7487 - protein, 175 aa, Artificial Sequence; identical to SEQ ID NO: 7486
  Synthetic

SEQ ID NO: 7488 - protein, 175 aa, Artificial Sequence
  Synthetic
SEIERLVEEIEKLLRKMAEEHKRSVERDERLARKLKRENEEHIKTDEELVDRLRRRNEDEKRLKEVLDRSEKSMKELKDRNKKVLDESKKESEDIKRRTEKLLEEIEERIRRINAGDRVLRELKRVLDEVKKIIEDVAKENEDSDRRSKKIIEDVVRENKESLDRSREEIERVRK

SEQ ID NO: 7489 - protein, 175 aa, Artificial Sequence; identical to SEQ ID NO: 7488
  Synthetic

SEQ ID NO: 7490 - protein, 175 aa, Artificial Sequence
  Synthetic
KEIEELVKRIEDEARRLKEEHKKSVREIEELLKRLTEEVRKLVERDKKLAEDLKDRNEDEKRLTEVLRESEERIRELVKRAKEVLEESRKRSEDLARENRKVLEDLRREVERINVDDEMLRLLEKVLRDWEEIVRRVKEANDDVNRRVEETLRDLKRKLDRSLEDSERIIREVAT

SEQ ID NO: 7491 - protein, 175 aa, Artificial Sequence; identical to SEQ ID NO: 7490
  Synthetic

SEQ ID NO: 7492 - protein, 184 aa, Artificial Sequence
  Synthetic
SVEDELRKVIKENEDVLREVEERVETVIKRNREVIEEVAREVERVIEETRRLLKEIEKAGVDEDELRKVEERVRKHAEELRKILEDLRRSSRKLAEEARDILRDLKRTSDELRKEAEKVTKDGDSEESIKRLLEKIRKHSEEVKETIRRLLEKIEEHTERVKREIDKMLRSNEDLMRRIKEEAE

SEQ ID NO: 7493 - protein, 184 aa, Artificial Sequence; identical to SEQ ID NO: 7492
  Synthetic

SEQ ID NO: 7494 - protein, 184 aa, Artificial Sequence
  Synthetic
SIKEKLDEAIERNERVLRRVEEEVRKSNEKNKEVLRRVSEEVRKVIEELEDLLRKIAEKGVEEEKLKRLRDELDKIRRELEKRLEDLERSTRDLVRKLERILEELKRTSDELRKEVEEVDKRGTSDETAERLLRKIEKHSREVDETIRRMLEEDERHIKEVEDTIREMLERLKRLIDEAEKDAK

SEQ ID NO: 7495 - protein, 184 aa, Artificial Sequence; identical to SEQ ID NO: 7494
  Synthetic

SEQ ID NO: 7496 - protein, 182 aa, Artificial Sequence
  Synthetic
DEVREVLKKIRELIKTNREHVTRLLRTIEELSRRSEEMIRRILEEIEKLIKDVRRLTEEGELTEEKAEKLRRDVEEIVKEAEKRLRDSNEEVKRLVDEHREVNKDLERRLEDEKRRLKEENLPEEMEKLLEEAIKEAREDSRRSDREVEEVLRKHKKVNDRVREEIERVLRKLEELLKKDRT

SEQ ID NO: 7497 - protein, 182 aa, Artificial Sequence; identical to SEQ ID NO: 7496
  Synthetic

SEQ ID NO: 7498 - protein, 182 aa, Artificial Sequence
  Synthetic
SEVDEIVRRLEELIRRNTEKVERLLERHERLIRELKERVKELLRKHEELAKEITELTKRGESTDEVIEEIRKRSDELNRRLEETLKRIRDDSRRTLEDLKRHSEKSRKDLEELLRDAERKGTGKEARDRIRKVLEELKKKNKELEERIRKVSKELEKVLEDVKRESEKVSKELRERLERSKT

SEQ ID NO: 7499 - protein, 182 aa, Artificial Sequence; identical to SEQ ID NO: 7498
  Synthetic

SEQ ID NO: 7500 - protein, 185 aa, Artificial Sequence
  Synthetic
SELERLEKEARDIVENLKRVLEELAKDVKRLLKESDELLKDLREKVREILERIEELARRNISEELVKEVTKRVRDEVERLRRRLEKVHRDHERTVKRIDEEIRRHVERSEEEVKRVEDEVRRRNMDETAKRELERLVKELRDVHREVEKRLKELAKELREVNKRIKDDLDRLVEALEEVLDRVRR

SEQ ID NO: 7501 - protein, 185 aa, Artificial Sequence; identical to SEQ ID NO: 7500
  Synthetic

SEQ ID NO: 7502 - protein, 184 aa, Artificial Sequence
  Synthetic
SELEELKRRIDELLKENEEILRELEERVRRLNKENRDLLRKLEEEAKRLVEEVRRVAEEGRSEEVLDALRRELERIVEEVRRRIEESLKKVEDLLRRAEEVIRETHEKLRKVAEEVREELKRRRVTEVKERIEKVLKDLERRNRESEKEVRRLLKELKESIDDSRRRVDELVKRLRKVLEDIRR

SEQ ID NO: 7503 - protein, 184 aa, Artificial Sequence; identical to SEQ ID NO: 7502
  Synthetic

SEQ ID NO: 7504 - protein, 177 aa, Artificial Sequence
  Synthetic
SAEETLEKLIRDLEKSIRKSAEDLERLIRELEKSVRDSAKLLRDLIREVRDVVRDVVRAKGDREEVKEIRDRVEKAVEKLERVIKESEDRLKELVDRARKVIEDSKKELDEAVKELERRKADKDVAERVKELDKRNKDLLKRLEEEVRRLIKENERLLRELAKEVKELLERIKRAAG

SEQ ID NO: 7505 - protein, 177 aa, Artificial Sequence; identical to SEQ ID NO: 7504
  Synthetic

SEQ ID NO: 7506 - protein, 177 aa, Artificial Sequence
  Synthetic
SAEDKLRELEKKLRKSIKESADRLRKLNEELRRSVRESAERLKELIREVEEVLRDVVRKRGRTEEVERLEEEVEKLRRELEKVIEDSERELEEHVKRTKEVIDDSKRLLEEMVEELKRRKATEEVEDEVRRLDEENKKLLEDLKRSVDELIERNKRLLEELTKRVKELLDKIRKTAE

SEQ ID NO: 7507 - protein, 177 aa, Artificial Sequence; identical to SEQ ID NO: 7506
  Synthetic

SEQ ID NO: 7508 - protein, 177 aa, Artificial Sequence
  Synthetic
SMEDSLRELIRKLRESVKRSAEELRRLNKRVEDSIRDSARKLRELIRRVEEVVKEVVETRGRTDKVDRIKKKVDDLREKLERLIRESEELLERHVEKTRRVIERSKEELDKVEEDLRRREARERVEDDVRRIDDENRRLLEELKKSVDELDKRNEELLRRAEKEVRDLLREIREAMR

SEQ ID NO: 7509 - protein, 177 aa, Artificial Sequence; identical to SEQ ID NO: 7508
  Synthetic

SEQ ID NO: 7510 - protein, 178 aa, Artificial Sequence
  Synthetic
DAEEELERLLRESERVSRDSARRLRELLKKLRRSVERSRREIDRLLKELEDVIREVIKRKKEVRELVKKLRDDLEDLTRKLKELVKRSEDLLRKLEEDIERLIETSRKRNKELEDRIRERKADKDLAREVEKVVKEDEDILRRAEEEVERLIETNRDLLRKVEREVKELVEKVEEDER

SEQ ID NO: 7511 - protein, 178 aa, Artificial Sequence; identical to SEQ ID NO: 7510
  Synthetic

SEQ ID NO: 7512 - protein, 182 aa, Artificial Sequence
  Synthetic
SELEELKREVDELTEEHKELLKRLTERVKELSERHKELLERLRERSERLVRRIRELAKRGEPKKDLVRELEELLKENNKLLEDVDREMKKTNDELREEIDRVRRRMEKTNKELEKTIKEVNLDDEVLRKAEELLRRNNRVIEEIEKRLRELLKENNDVIKEIRERLEKSNKELRDVAREVAK

SEQ ID NO: 7513 - protein, 182 aa, Artificial Sequence; identical to SEQ ID NO: 7512
  Synthetic

SEQ ID NO: 7514 - protein, 182 aa, Artificial Sequence
  Synthetic
SELEELKKKVDDSIRENERLLRELTEDVKRLSKEHKDLLKRLEDKVEELIRRARELAKRGEPKRDLFDELRKLLEKLRKDIEKAKREMERTNTELEKKIRDALRRTTELDKELEETIRRVNLDDDMLEKAKKVHDEHRKSVEESTERLKELLRRNNEVIKDIARRLDELLRKLEKVVKEIAK

SEQ ID NO: 7515 - protein, 182 aa, Artificial Sequence; identical to SEQ ID NO: 7514
  Synthetic

SEQ ID NO: 7516 - protein, 182 aa, Artificial Sequence
  Synthetic
DELRELEEEVRKSIETNRELLERARERVERLSEEHRKLLEKVKEDSDRLVEEVKDLERRGEPKTDLARRLDDLLRKNNDILRRLKEDMKRTNKELEDLIRELVKTTRDLDRRLKKLIDDLNLDDEVLRRARTLHDEHRRSVEESERRLKELLERNNEVIKDIERKLDKSNKELKDEAEKVKK

SEQ ID NO: 7517 - protein, 182 aa, Artificial Sequence; identical to SEQ ID NO: 7516
  Synthetic

SEQ ID NO: 7518 - protein, 182 aa, Artificial Sequence
  Synthetic
SELEEIEKKVRELTKRHRELVERVRKTVKELIETNRRLLETLTERIKRVLEEVRDLERRGEPKRDLKKRLEDIIRRLAEDIERVKRETDKLLEELKRIIEEVEKEMRETNKELDKEIKDANLDDKALEEAKRVLRENNEVIKDIKRRLDELLKELEKSVRESEERLRRLLEEVKRVIEEVAT

SEQ ID NO: 7519 - protein, 182 aa, Artificial Sequence; identical to SEQ ID NO: 7518
  Synthetic

SEQ ID NO: 7520 - protein, 182 aa, Artificial Sequence
  Synthetic
SSDREVEERVKRLTDRHRELLKRVEEEVKRSIKRNKDLLDELRKESEKLVKEARDLARKGKPKRDLARELRKLLEDNNRKLEEVDRETDELDKRLKERIEELEREAKKTNDELRELIKRLNLDEDVLRLAEKLLKDNNKVIDEIRRRLDRLHEEHKKSVDDSREELKKSNKKLEEVVREIEK

SEQ ID NO: 7521 - protein, 182 aa, Artificial Sequence; identical to SEQ ID NO: 7520
  Synthetic

SEQ ID NO: 7522 - protein, 185 aa, Artificial Sequence
  Synthetic
DDLREVEKEIRRIAEESKKLLEEIERAVEKILRDSRRVLEELARRAKRLLEELDKLKKNGLDKEDLERKLRELERRLEELLEELERISERTKEELKRLEEKLKKFSEDSDRRLRKILEDLERRGVDEDVRREVKRLVDELREVDRKIEEDLRELVRELEKVNREIRKRIEELVRRIKEVADEVRR

SEQ ID NO: 7523 - protein, 185 aa, Artificial Sequence; identical to SEQ ID NO: 7522
  Synthetic

SEQ ID NO: 7524 - protein, 184 aa, Artificial Sequence
  Synthetic
DMEEKMRRITEEWRRVTEEIERRHREVIKKWRDVSREIAETHRRVIDELRRVLERIAERNPSEDLLRKLKKEIEKLERDNRKLIDDDRRLLERVERKNERLIREDRERLKEAEKRIKEVEDRGIDKDIVDKELERLREEIRTSKKESDEVVKENEELIRDSKRKSEKVVRDNKRVIKEAEEKAK

SEQ ID NO: 7525 - protein, 184 aa, Artificial Sequence; identical to SEQ ID NO: 7524
  Synthetic

SEQ ID NO: 7526 - protein, 182 aa, Artificial Sequence
  Synthetic
DEIEELLKEIKKLVDELRKRIEELAREHKRLADELRKKIKKLKDEHDRLVRELEKLAEKGRSDDKVLKKIEDDSKRTREDLERAIREAEDRSRRTSEDLERAIKEAEDRLRKLAEDLKRRGGGKEVKDKLDKLREELKRVADKLRDDLRELHKRLKEVADRLRKLLEDANRTLREVLKETKR

SEQ ID NO: 7527 - protein, 182 aa, Artificial Sequence; identical to SEQ ID NO: 7526
  Synthetic

SEQ ID NO: 7528 - protein, 177 aa, Artificial Sequence
  Synthetic
SAEESAKRLKEELKKSLDRSREELDKLRKDNEKVLRDVEERLRRLIEELKKVLEDIKKDKGRTEEVEKLRKKVEDMARELKERLKDLERSLRELEKKLRRELERSEEEIRKLERDLDREEVREELEKRVEKLLRDDKRRLDELRKESEDHIREIEDTLRRIEEEVKRLLKEMRDKLK

SEQ ID NO: 7529 - protein, 177 aa, Artificial Sequence; identical to SEQ ID NO: 7528
  Synthetic

SEQ ID NO: 7530 - protein, 185 aa, Artificial Sequence
  Synthetic
SELETIARRVEKLNEDVERLLREAKKEADRLIKENEDLLREAERKVREIIERIRRLAERGEPKRDLLKEIEELLRELKETVERLIKTSRDLLKRLAELVEKVKRELEDSLRKLKKEAEDLIRKNDDKEVKEKLTRLLKSHEDVIREVSRRLKELLDRYREVSDRIRKTLEELLKELRRVVEEVRK

SEQ ID NO: 7531 - protein, 185 aa, Artificial Sequence; identical to SEQ ID NO: 7530
  Synthetic

SEQ ID NO: 7532 - protein, 185 aa, Artificial Sequence
  Synthetic
KDLEEIERKVRKLNEDDKKLLDDLRKEVEKALRRNEESLRKSREDAKKIIKEIEDLARRGEPKRDLLRKLEEDLKRVEDEVRKNEKRSRDLLDRLRRILEDLIRESERSADELRRDMKRLIDDKDDKEMKDALRELLRSHRKSSEDTKRELERLLREYEKVSRDVKRDHEKLLREIREVIEEVKK

SEQ ID NO: 7533 - protein, 185 aa, Artificial Sequence; identical to SEQ ID NO: 7532
  Synthetic

SEQ ID NO: 7534 - protein, 185 aa, Artificial Sequence
  Synthetic
SELDEIRRRVEELIETDKDILRRIAEEVRKALEDNKKSLRESEEEVRRLLEEIKKLADRGEPKRELLERLERLLEELRKKVEENERRSKKLARELRERAKEIKKRSDDLNRELRKRMKELIDRIDDEEMKKLLEDLLRKSEDSTRETRKRLKELLDRYEEVSKKIKKRHKELIEELRKVIDDVRR

SEQ ID NO: 7535 - protein, 185 aa, Artificial Sequence; identical to SEQ ID NO: 7534
  Synthetic

SEQ ID NO: 7536 - protein, 182 aa, Artificial Sequence
  Synthetic
RVEETLTRALKEIEEVIRRVDEESKRTIRSHREVIREVDEIHTRLLERLKKVIDDIRRRNVPDDDLRRILRELEEHIKRSKEELEKSLRDLERHSDELRRRLRELLERLRKIVEELDRAKSDDDRLLKEARDEVRKIIEEIRRLLEEHERTVKKLNEDIRKRLEESERTVEELLKRLRDRAR

SEQ ID NO: 7537 - protein, 182 aa, Artificial Sequence; identical to SEQ ID NO: 7536
  Synthetic

SEQ ID NO: 7538 - protein, 182 aa, Artificial Sequence
  Synthetic
SMEEELKRLLESHEKVIREVRKTSEDTLRSHRKVIEEAKEEHKKLLEEIKRVVERVRKRNVPDEDLKRILEEVRRHVEESKKRLRDSFEELRRHSEELERRLRESKKRLERLVRELEREDSRDETVLREARKEVEKLNEDIRRLLEEHKRVVDELNKELRRLLEESRRRVKELIRRIEEEAR

SEQ ID NO: 7539 - protein, 182 aa, Artificial Sequence; identical to SEQ ID NO: 7538
  Synthetic

SEQ ID NO: 7540 - protein, 182 aa, Artificial Sequence
  Synthetic
SVEERLRELIESHRRVIEKVERDSRRTIRSHEEVIKEVKKISEDTLREIRKVIEEAKKRGVPDDELRELLKRLKEHSEELKRRLEESLKDLKRHSDELRKRLEESLRRLKKLIEELRRADSRDETLLRDAERRVEELNEEIRRLLEKHVRDVDRLNKEIRDLAREHKERAEEIIKRIEEKAR

SEQ ID NO: 7541 - protein, 182 aa, Artificial Sequence; identical to SEQ ID NO: 7540
  Synthetic

SEQ ID NO: 7542 - protein, 186 aa, Artificial Sequence
  Synthetic
SEMERLERRARELLRRNEELMDDLRRKAEELLKRNDRLVKEIEKKVREVLRRIEELKRRGEPKREVARKIEEILRRLEETLRRIKEESDRLDEELKRELERVKRESEELDRELRKLIEDVERRVTDSKRLEELLRRLNEEHKRISDELRKLLDEALERHRELSRRLEEELERLLREIERLVEEVTR

SEQ ID NO: 7543 - protein, 186 aa, Artificial Sequence; identical to SEQ ID NO: 7542
  Synthetic

SEQ ID NO: 7544 - protein, 186 aa, Artificial Sequence
  Synthetic
DDMERLEEEIKEILDRLRRLLERNRRVNKEIDERSKELVKRLEEKARRLLEELRRLKDRVTDKETLERRLRELLRELERLIREVEERLKKLHEDHKRHIERSDEEMKRLLDELRKRIEDVKRKLERVKELEKKAEDVLREVKKVIDEVRTDSKRLNENLRESIKDVKREAERVLREVEEAIREVER

SEQ ID NO: 7545 - protein, 186 aa, Artificial Sequence; identical to SEQ ID NO: 7544
  Synthetic

SEQ ID NO: 7546 - protein, 186 aa, Artificial Sequence
  Synthetic
REAEELKKEVDRILEELKKLLKENEDLNRDLDRKSKELLKENREKVERLRKELRELKDKVTDKDKLAKRLEELLKDLADHVERSRKKLEDLHREHEDHIRKSEEELKRLLKEVEDLIRELRERKKDVKELEDEAKRLKDEVEKLIEEIKRKSDELNKNLRDSIRRVEETTRDLLRKIKKLIDEIKK

SEQ ID NO: 7547 - protein, 186 aa, Artificial Sequence; identical to SEQ ID NO: 7546
  Synthetic

SEQ ID NO: 7548 - protein, 171 aa, Artificial Sequence
  Synthetic
SIEEALEDLARRIKKILDDLRREAERLLREVEELLKRVEEANRRLRRTIEEALKRLARDKKKADEIRRRHEELEKRSKENLDKIREDLERLKKRLEDELKRIEEELRKLREEGVEVETAEREIRRILEEIRRLAEEARRRIEEVLKRIKKHLEESKRRNEESLERIEREAR

SEQ ID NO: 7549 - protein, 171 aa, Artificial Sequence; identical to SEQ ID NO: 7548
  Synthetic

SEQ ID NO: 7550 - protein, 179 aa, Artificial Sequence
  Synthetic
SVEETVDELKKRIEKILREIKRVNEELAKRNEDVNEEWRREVDKMIKDIERILRDVLRKEDSEDLRRRVEEVKRHLKRNKDEVEKKSKENKDRVRTSHERLRDLLRRIRERLEELERRLKDLDIEKLKRDAERILEEIKRAVDTSREESERTLKELRDMVKESRKDAEEVLERIDRDKR

SEQ ID NO: 7551 - protein, 179 aa, Artificial Sequence; identical to SEQ ID NO: 7550
  Synthetic

SEQ ID NO: 7552 - protein, 179 aa, Artificial Sequence
  Synthetic
SVKETLEDLIKKIRDLLKRVRDENKRLAEDNERLNREVEKRNRELIKRIEDELEEVRKREDSERVRKIIEDVKRRLDRSHEEVKRISEKNRRDVKRSTEELEKLAEDAERRLDELDKLLKDLDIRDLKREIEKILREIKKALEDSRRKSKETLDRIREVLKTSEEDIKRILKEIREAAR

SEQ ID NO: 7553 - protein, 179 aa, Artificial Sequence; identical to SEQ ID NO: 7552
  Synthetic

SEQ ID NO: 7554 - protein, 178 aa, Artificial Sequence
  Synthetic
SREEVVKEIEKRVEELNRRLEETVRRVIEEMKRLNKESKEVSKKIVDEVRKLLDDVRREKGETEELKRLEERIREAEKTSKKLNDDHERESRKLARRLEELLERHKRETRRIIEEMRRAKLEEDELRRLLERIEKTVRELKREIEKILEDATRTVEDLKRKNEELLRRLKKLADDVKK

SEQ ID NO: 7555 - protein, 178 aa, Artificial Sequence; identical to SEQ ID NO: 7554
  Synthetic

SEQ ID NO: 7556 - protein, 184 aa, Artificial Sequence
  Synthetic
RVEEILRKASKENKEVIDRDRRLAEEATELNKRVVEEDRKVMKEVTKELEDVLRRAREEGLDEEKLRRLEEELRRLTEEWREEIRKDEKTVEELRKKWEDVSRELERRHRELERELKKSLDDGNTDKLLRELEERSKKVLEESKKTSEDLLRESEKHVRDWREKSRKLEEKVKRLVKKVKDTTD

SEQ ID NO: 7557 - protein, 184 aa, Artificial Sequence; identical to SEQ ID NO: 7556
  Synthetic

SEQ ID NO: 7558 - protein, 184 aa, Artificial Sequence
  Synthetic
RAEDIIRELKRRNEEVLERDRELMERAARELREVLERLKDIAREASKELKRVLDELRKRGLDEEDLRRLEKELRDLEREIDRTLKEIEKRLRKLKREWEKVSDDLRKKHEDLIKKLKDDLRRGTSDEVVERLARESERVLRESEETSKDLKRKVDEELRRIEDTIRRLLKRVKDLVKKIEDTSR

SEQ ID NO: 7559 - protein, 184 aa, Artificial Sequence; identical to SEQ ID NO: 7558
  Synthetic

SEQ ID NO: 7560 - protein, 184 aa, Artificial Sequence
  Synthetic
RLREIIEKLRRDNEKVIEEDRRVAEEVRKALEKVLREDRKMADEVTKELERALKELEDRGLDEKKLEELRRRLRKLVEDWKRVSERVEKELRELTEEWEKVSRDLEKRHRDLVRKLEDDLRKGTTDEVIKELEKRSKDVLDESRDESRKLLERVERLLKKIREDSERLLERVEELLREAEETAR

SEQ ID NO: 7561 - protein, 184 aa, Artificial Sequence; identical to SEQ ID NO: 7560
  Synthetic

SEQ ID NO: 7562 - protein, 184 aa, Artificial Sequence
  Synthetic
SVEEIIRKLEEDNRDVLRRDREVAKKVEDENRKVAEEDDRIVRRVAEELKRVLKELEDKGLEKRELDRLRKELKELVERLEDVSRRMKETVKRLRDEWEKRSRELEKTVRELVKKLRDELRKGISEKVIEELKDESRKHLEELEKDSKRLEDESKKHLDDWRRTSEKLLEDVERRVREIEEESR

SEQ ID NO: 7563 - protein, 184 aa, Artificial Sequence; identical to SEQ ID NO: 7562
  Synthetic

SEQ ID NO: 7564 - protein, 179 aa, Artificial Sequence
  Synthetic
SSEEVVRELDKEIRKSIEDLKRIVRENEEENKRSVEDVREKAKRNEERLRKVLKEADERKRDEDLERKLRTVKRELERSIEELEKHIEKSNRDVKKSAKELEDHLRDSKRRMKELAERLKDVDIRELAKRVKRIVDENKRVAEEHHRKVERIVRENEKLLKEHHDRVEELVRRIKEEVE

SEQ ID NO: 7565 - protein, 179 aa, Artificial Sequence; identical to SEQ ID NO: 7564
  Synthetic

SEQ ID NO: 7566 - protein, 179 aa, Artificial Sequence
  Synthetic
SEEEEVRRVLEELEKKVKRLTEEHRRRLDELRKKVKDHSRKNKELLERLREEIKRIKGAPSEDIDRIEEEARRRLEESERSSRELKKDLERTLEKLRRDSKRLVEEMERVLRELRKRGGSEEAKRVLEEVEKRVRELVKTNEDVLREIEEDVRRLVKENEDSIKESKDRLRELLERLKQ

SEQ ID NO: 7567 - protein, 179 aa, Artificial Sequence; identical to SEQ ID NO: 7566
  Synthetic

SEQ ID NO: 7568 - protein, 181 aa, Artificial Sequence
  Synthetic
DEVEEIRKILEELAREAEKVVRETRKLLEDIRKEVEELNDRNRRLLEELERRVRDIKRRGTSEEKLKELEDRVEKAIRESREELKRLEDKIRKRIEEDRRKIEKLERKVKKVIDEIRKRTRRDEIRRVVEDVERRLRELLDRWRKVSEEVEKRLKELIDELRESIERSADRLRKLIEELKR

SEQ ID NO: 7569 - protein, 181 aa, Artificial Sequence; identical to SEQ ID NO: 7568
  Synthetic

SEQ ID NO: 7570 - protein, 181 aa, Artificial Sequence
  Synthetic
REVEEIKKTLEDIRREAKELLDRTRELLDRLRKSVEELNRDNERLLREAKDEVEKVKRDGTSKEVVDELMRKLKRLIEESKRKLDEHVKRTKEVIERDREELKRLKRKLDDTIRKIRSRTREEEIKKVVERVEREIEDLIRRWEEVSRDVEEKLKDLNKKVEESIRRSAKDLRELLREVEE

SEQ ID NO: 7571 - protein, 181 aa, Artificial Sequence; identical to SEQ ID NO: 7570
  Synthetic

SEQ ID NO: 7572 - protein, 175 aa, Artificial Sequence
  Synthetic
SRAEKVLKRVTDLIRELLRTVTELVRRNREVIEELLRRVAKLHRDNRELNKKVLEDVRRDGPDDRLVETLKRHNEEVTKTLERLKRELEKHLEKSARDVEKLKKDLRRVAEEVRRELGDNEVVDELRRRIREVEKTLDRLLEESEERARRVLKELDRLLEESRKSSREVIEEAKR

SEQ ID NO: 7573 - protein, 175 aa, Artificial Sequence; identical to SEQ ID NO: 7572
  Synthetic

SEQ ID NO: 7574 - protein, 180 aa, Artificial Sequence
  Synthetic
SVEELLKKLEKENRDVIREMKKLLDELEEENRRVIEEWRRITKELEDRNRRVREEIPESDELRKLVEELKKHLEDDKRRAEKAARDLKDHLRRLEETIRKMEEELKRHLDKLRRDIERGTDEEIIRRLVKHNKELVDEIRKTIERLREHNRKLVEKVREDVKRSTKHNRDLVKEVRDRAK

SEQ ID NO: 7575 - protein, 180 aa, Artificial Sequence; identical to SEQ ID NO: 7574
  Synthetic

SEQ ID NO: 7576 - protein, 180 aa, Artificial Sequence
  Synthetic
SLEELLDRLRKLNETVIRDMERVLKELEERNRKVIKEDRDVLEELARRNEKVKRDIPPDDELRKLAEDLERHLRDWEDKSRKLEERLRRHLKEVKETIEKIEEELKEHLRDVERKIREGTDEEIAKELVKHNEKKVREIKKTIDDLRKHNEELVKEIRETSERLREHNERLLREALRRAK

SEQ ID NO: 7577 - protein, 180 aa, Artificial Sequence; identical to SEQ ID NO: 7576
  Synthetic

SEQ ID NO: 7578 - protein, 184 aa, Artificial Sequence
  Synthetic
DLEEVVKDLERKLRDVARKDRKLVEDSRKILKDVVDKDRELVERSRRILEEVLERIRRRGTDETTVKDIKRRLDEVLKENDDDSKRATEELRKLLEDNKRKSDEARRRIKKILDEIKDETRKGTSRDTARKLLEDVADELRRWLEDSERLHKENKDTIEKWLRRSRKLHEENRKLIEDLLRTVT

SEQ ID NO: 7579 - protein, 184 aa, Artificial Sequence; identical to SEQ ID NO: 7578
  Synthetic

SEQ ID NO: 7580 - protein, 184 aa, Artificial Sequence
  Synthetic
SLEDVLRELKERLERSHRKLRELVRRLEEDLKRVLRELEKIVDEVRKINEDVRREVERRGVDEDTLRRITKLSEDSLREAEELLEDIRRVVEKIKRELEKMLEEHRRTLEKIEKELDEVRRRGEDEDIVRKLLEDVRKLVEELDRRAKELEERVKKVVDELLEKARRLLEKNRRTVEKILRDVK

SEQ ID NO: 7581 - protein, 184 aa, Artificial Sequence; identical to SEQ ID NO: 7580
  Synthetic

SEQ ID NO: 7582 - protein, 182 aa, Artificial Sequence
  Synthetic
SEVEKLLREVEDRDRRILKKVKELLDEVRRLIEDHLRRSEDALRRVRKRIEELKELVERGDLDEETLKKVKDELRRLIEELRKHAEELKRRLEELERTLKEELDEWKKELDKLLEDLRKDEKSERLEEMLRRLKKSIEDSVREVRKVLKEAKDIARKVIEDTKRLLEELKRIMKKVLDELRK

SEQ ID NO: 7583 - protein, 182 aa, Artificial Sequence; identical to SEQ ID NO: 7582
  Synthetic

SEQ ID NO: 7584 - protein, 182 aa, Artificial Sequence
  Synthetic
SEIEELVERVKARDEKHLRDSEKLLEEVKRRDRKLEEDSKKLLKDVKDLLRELEEVAKRGEVDEETVKDLERRVREMLKESRDRTKKWADELKELVERLRRHIEEWRKELKRELERLEEESDDERLRKLLDDLRKSIEESRKRSEEILREAEDTMRKSVETNERLLEELERELRRVVEELRR

SEQ ID NO: 7585 - protein, 182 aa, Artificial Sequence; identical to SEQ ID NO: 7584
  Synthetic

SEQ ID NO: 7586 - protein, 182 aa, Artificial Sequence
  Synthetic
DEIERVLEEVERIDRELLKRSEDLLREVRERDKELEERSKRLLEKARRLIETLRDMARKGEIDEETAKRVEETLRREVEKSREDTRRWEEELKELLKRSKEETDRWKEELRKKVERLEDKDKKERVKTIIDEARKSIDDSVRENKKVLDELKETIERSKKKNEDILREIEKILEEVREELRK

SEQ ID NO: 7587 - protein, 182 aa, Artificial Sequence; identical to SEQ ID NO: 7586
  Synthetic

SEQ ID NO: 7588 - protein, 182 aa, Artificial Sequence
  Synthetic
KDVDELLERVKRRDEELERKVEKLLKRVRDLIREHDEKVKELEDEVRDRIKKLLEMAERGEVDEETVKDLKRRLKELLDKLRKETEDLKRDLEELIKTLEEEIRRWKEKLEEDAKRLRDKEKSEELERVLRELKRSIETSTRRLRKILEELRRILEESERKVEEVLKELERIAREVEERLRT

SEQ ID NO: 7589 - protein, 182 aa, Artificial Sequence; identical to SEQ ID NO: 7588
  Synthetic

SEQ ID NO: 7590 - protein, 182 aa, Artificial Sequence
  Synthetic
SDIEDVVRKVEEEVRDHNRRVEELLKRVERRDRRLEETVEELLKEIEDKLRRLKEMAERGEVDDKTVKDLKEELERLLRRLEREIREWEKELRRLVRELERETKELEDRLRRLIEELRRRERSERLEKLLRELEETLRRSKERVKEVLEDLKRTITESKRRLKKILDEIRKRLEEVERDLKR

SEQ ID NO: 7591 - protein, 182 aa, Artificial Sequence; identical to SEQ ID NO: 7590
  Synthetic

SEQ ID NO: 7592 - protein, 184 aa, Artificial Sequence
  Synthetic
SLEEVVDKLRRDSEESLKKNETVLRRVTKELTELLKRWREASERLKEELREVLERVRKKGLEEREVRKLEDRLRRLLEEDKRLLDEVKRRIEDLRKKWEDETRKVKERHEDLLRKIEEVRKRGTTEDTLRKLAEEVKRVVRDDEEKVKRLEEEVKEEVKKLEDDLRRSEERVERTIREIEKRAK

SEQ ID NO: 7593 - protein, 184 aa, Artificial Sequence; identical to SEQ ID NO: 7592
  Synthetic

SEQ ID NO: 7594 - protein, 184 aa, Artificial Sequence
  Synthetic
SVEDLVREVERRLKTVLDEDEEVLKRVEDESRESIKENEEVLREVSERLDKVLKDVRRRGLEERLVRDLERKITELRRKWDEDTKRAKEEHEKLTREWRKRSEELRKRIEDLLRELRERLKEGTSEEDLKRLEDRVEEEVRRAKRESDELLKRVRRTVEDDKRRLRELREEVKDLLERIREAEK

SEQ ID NO: 7595 - protein, 184 aa, Artificial Sequence; identical to SEQ ID NO: 7594
  Synthetic

SEQ ID NO: 7596 - protein, 178 aa, Artificial Sequence
  Synthetic
SEVDEVRKRSEKVVEENERRIEESERRIAKLVKEVRDVIEDAKRRVEEILRRLEEEMRKGIDEKTIKDLKEEIKKVLEDLERRIREIEKKLRKVTEDDRRTLKKVREDNKRLLDDIRRKLRSKDVLEEMRKTHERVIKEWERAHKEVNEKLEKIIRELEKVLEEVEDEAREVIRRLET

SEQ ID NO: 7597 - protein, 178 aa, Artificial Sequence; identical to SEQ ID NO: 7596
  Synthetic

SEQ ID NO: 7598 - protein, 179 aa, Artificial Sequence
  Synthetic
SASEDLERVLRELAKEVEKLLRESEKLLKELEDLARELLERDRKLLKELEEKVKRLKERRADEDKIRTLEKEMRDVLRESEERIRRLEETVKRVLDENKKRTDDLKKKLEDILEELERRNSAEERVLDDVRKRIEDLVRELKKVNEDIEKKVRELIERLRRSLEKSKEDIRRLVEELRR

SEQ ID NO: 7599 - protein, 179 aa, Artificial Sequence; identical to SEQ ID NO: 7598
  Synthetic

SEQ ID NO: 7600 - protein, 179 aa, Artificial Sequence
  Synthetic
DMSEELEEILRRLEEESRRHLRTDEELLRELEEKIRRLLREIEEILERLKKRIDEVKTRNTSEETIKKLIEDAKRVLEEIEEKVKRLVDEAREVLDTSRKTLRELVEKMRETLDRARKRNSAEERVLKRVKDRIDELIRRNEESLERTRDEIRKLIEELKKVLDRVKEEIEKLVEALKK

SEQ ID NO: 7601 - protein, 179 aa, Artificial Sequence; identical to SEQ ID NO: 7600
  Synthetic

SEQ ID NO: 7602 - protein, 179 aa, Artificial Sequence
  Synthetic
EMTERLERVLEELKRKSDEHIKTDEELLRRLEKKSRDHLRELEEILRRLEREAREVKRNRTSEEVIKELAKRLRESLERLRKTLDELVKDMERVLRTSERTLEELVRDLERILKELKDADSADREALKKVEDAIDKLRRDNERSLERTKREIERLIRENKDVLDKIEKRIRELIEELER

SEQ ID NO: 7603 - protein, 179 aa, Artificial Sequence; identical to SEQ ID NO: 7602
  Synthetic

SEQ ID NO: 7604 - protein, 179 aa, Artificial Sequence
  Synthetic
SADEKLDKILREMKKRSDDHIREVEKILRDLDREVKEILKKDEKLLRDLDRRVKDVKRRRSSEETIDKLIKEAEKVLRDSEDEVRRVVEKMEKVLRDLERTLKELIERLEEIVKRLKEERSADDEVLKRVEETVRRLVEENKKVLDRVREEIRKLIEELRDSLRRSEKRIRELADELRR

SEQ ID NO: 7605 - protein, 179 aa, Artificial Sequence; identical to SEQ ID NO: 7604
  Synthetic

SEQ ID NO: 7606 - protein, 182 aa, Artificial Sequence
  Synthetic
DLEDILREIARLIERLIDENRKVLEEIARRLKELIEELKKSLKRSEELLRRLEKELKDSGKKTEELTEKLKRILDESRKEIETLEEKLRRVLKKLKESLDKLVEEMKRTLEDLERKIRRDGPDKDLLRTLEKVAEDLKRRSERHIRELRRTLEDLERDVRRLLREDEEKLKRAAEEVKEAIK

SEQ ID NO: 7607 - protein, 182 aa, Artificial Sequence; identical to SEQ ID NO: 7606
  Synthetic

SEQ ID NO: 7608 - protein, 182 aa, Artificial Sequence
  Synthetic
DLEDVLRDIERLLRDLIRRNKEVLDRIRELIKKLIDENRKSLKRSKEELERLIRELAKSGKRDDRVLEKLKKVLDDSRKTLEELAKKAKETLDRIKKSLEELAKKLEDVLRELEREIRRDGPSEELLRRLREVLERLKRESEKHLEELKKILEDLERESRRHIEEDKRLLKELKEEVDERIR

SEQ ID NO: 7609 - protein, 182 aa, Artificial Sequence; identical to SEQ ID NO: 7608
  Synthetic

SEQ ID NO: 7610 - protein, 182 aa, Artificial Sequence
  Synthetic
SLEEVLKRIEDELRRLIEENKESLERSERLIRELKKRLEEVLRRIKKLLEELIRRLEESGKRDDRVRKKLKDVLDDLERRVREAVERLKKVLDDSRRSLEELVKKLKKELDRLRERVKRDGPDKKLLEDLKRTLDELRRESEEHIRRDERLAEELAREVEKLLKDMERILRELAKEVEDRIK

SEQ ID NO: 7611 - protein, 182 aa, Artificial Sequence; identical to SEQ ID NO: 7610
  Synthetic

SEQ ID NO: 7612 - protein, 172 aa, Artificial Sequence
  Synthetic
DASRRVEEKLKEVEERVRKLLEEDRKRLKDSKRKVEELIERDKTELKKVKDRADGGVPKDEARDELRKLKEKSRRDLERLADDLRRLNEKSKEDLKKIKREAEKLLEELEREKGADKKVIDTVRKRLKELLDELKKSVEDTHRENRRVLKELEESHKRTNERLDDLLRELER

SEQ ID NO: 7613 - protein, 172 aa, Artificial Sequence; identical to SEQ ID NO: 7612
  Synthetic

SEQ ID NO: 7614 - protein, 185 aa, Artificial Sequence
  Synthetic
SLEDVVRRVREELERLLRTHEEVIRRVEEELRRLLEEYRKVSKEIEEDLRRLLKEVRDRNIEDEKLRRLEKKLRELIKRSRELLEELRRRAEEIVRRLRDSLRRLKEDIRRIVEKIDKDREDGRPVEDLLREIKKELEDVKRKVDKLNEEVERILKKAKDEVKEAIKENRDRLRRLRDEVRRLKK

SEQ ID NO: 7615 - protein, 185 aa, Artificial Sequence; identical to SEQ ID NO: 7614
  Synthetic

SEQ ID NO: 7616 - protein, 185 aa, Artificial Sequence
  Synthetic
GLEDVVRRVEKRLEDLLRRYKKVSERLEREHRRVLDEYRKVSEEIDKILRDLLKEVRDSNIDEKKLRRLEEELRRAREESKKLLRELEEDIKDNLRKSEKLLEELRREAERLREEIEELRRRGEPVEELLKEIEKLLKDIERTVEKALKENKDSIRRSKEKVDRMIKRNRELAKELEDKVRELKR

SEQ ID NO: 7617 - protein, 185 aa, Artificial Sequence; identical to SEQ ID NO: 7616
  Synthetic

SEQ ID NO: 7618 - protein, 180 aa, Artificial Sequence
  Synthetic
SIEDILRELADTIRRLTEESEKILRKAEELLRRLTEEWRKSLKDLEDLIRKLIEEIRRRGLPEKDVRKIEEELKRLIEENKERLDRITRKLEEILKELRTSSDRLREELEKLLRDLKRLKDRDGEEEIKKLMDEIRKKVEKHLREVEKVLREVEEEVKRELRKSEELARRIEEKIRREKK

SEQ ID NO: 7619 - protein, 180 aa, Artificial Sequence; identical to SEQ ID NO: 7618
  Synthetic

SEQ ID NO: 7620 - protein, 180 aa, Artificial Sequence
  Synthetic
SEVEEALRRMEETIRRVREKLKKSLEDMRREIERIRRELEKSLEEFERDIERITRDIRRRGPGDKELDDIRKELEKKREEHHRRLDEIRRKLEEDLRRHHKDLDDIRRELEKRKEDLRRAKLVSDDALRKIEELVKRLDRELREVNKEIEKVVRELKEELKRVDDEIERLVRELRKEAER

SEQ ID NO: 7621 - protein, 180 aa, Artificial Sequence; identical to SEQ ID NO: 7620
  Synthetic

SEQ ID NO: 7622 - protein, 185 aa, Artificial Sequence
  Synthetic
DEIDEIRKVAERLEKEARELVKENEDDLKRHKERVDEIVKKIEEKVRRLEETARKLKEERRDSEELERVIKRLRDELRKLKEEVRREIKRLEDNHKELRDDNKRKNEELKKKVDDLEREVRRLPETEELKKVLEDLRRVLEKVHKLNREVLDKHREIVKRLSDKIKTVLRKLEEILKRAEEELRR

SEQ ID NO: 7623 - protein, 185 aa, Artificial Sequence; identical to SEQ ID NO: 7622
  Synthetic

SEQ ID NO: 7624 - protein, 179 aa, Artificial Sequence
  Synthetic
SIEELLEEVERVVREVERRLDELLERNRRVIEEVRRRDDKLTKENEDVIRDVRRAGNISDKATDELRRSHEAERRRSEEDKKRLDDSHKELEKEVEKTKRRIREELKKERDKARRSRRPEEDLIREVEKRLEDIKDLLRRMKEEVERHSREVEDRLRRSEERWRDHSKKVKERLDRATT

SEQ ID NO: 7625 - protein, 179 aa, Artificial Sequence; identical to SEQ ID NO: 7624
  Synthetic

SEQ ID NO: 7626 - protein, 173 aa, Artificial Sequence
  Synthetic
SLEEEVRRLLEEIKRLADENRDYVRRSLETNKKTNKDNRDEIRKALERIKRLAREIERIRKEDLDRTIEKLKRELKKLREDNEKRSKENEKSDRDVTEENKRRAKRIRDELRRTGVDEKLLREVEELLRRVEEEHERLHRENRKLNDKDRETLERLIREVDDLLRKLEEEARR

SEQ ID NO: 7627 - protein, 173 aa, Artificial Sequence; identical to SEQ ID NO: 7626
  Synthetic

SEQ ID NO: 7628 - protein, 174 aa, Artificial Sequence
  Synthetic
RVDELLEEVRKLVKDVHDTTEELLKEVERRLDEVKKRVDRSNEEVKELVKEAVKRSGETEEIRRLDEELRKAIEKDKRDLEKIEEDLRREADKIRRENEELKRRLEEEEDKIKKRPTDDTKIEELLRRIEKYMRESKERIDRLLERIDEVLEKNERDVRKLLEDIRRMIEKDDT

SEQ ID NO: 7629 - protein, 174 aa, Artificial Sequence; identical to SEQ ID NO: 7628
  Synthetic

SEQ ID NO: 7630 - protein, 185 aa, Artificial Sequence
  Synthetic
DTIERLLEDIKRILDKNRRDARRVLEEIKRSNEKNREDIKRIEEEIDRLLKEIKKKAEEDRSGEEAKREEEKLKREIERLERELEKIERENRKKMKEIRDDLDRLRRDNERRRREKKKEMDRRITNKDVVKEVEELLKRVEETHRKLNKEVEELLERDERDLRRLIDDVRRLLEEVRKTLEDLRR

SEQ ID NO: 7631 - protein, 185 aa, Artificial Sequence; identical to SEQ ID NO: 7630
  Synthetic

SEQ ID NO: 7632 - protein, 182 aa, Artificial Sequence
  Synthetic
RELEEARERIKELLEEIKDEVRRWREKIKRLLEDSRRKAERLKEDIKRLLEEIKKLSDDGRLDERIEERLRRELERIKRELEKYRKELEEDTRRDEERLRKIKEDLDERMRDIRRELKERVTDEDALRDIERLLREVDDAFRRLVEELRRLNEEVHRTTDELIREVEDMLRKVEEALKREKD

SEQ ID NO: 7633 - protein, 182 aa, Artificial Sequence; identical to SEQ ID NO: 7632
  Synthetic

SEQ ID NO: 7634 - protein, 178 aa, Artificial Sequence
  Synthetic
EEIERVLEEIKRTADEIRKEIERVLEKSKKLLDDHHEEVKRMLERIRDKAKKVTDRGGGSRELDKIKKDLEDELRRLEEKSRREHEEHKKELDKIKKKLRDTERDLERKLKEITDRDGEDKVVEELRKILERLKDLVRDLERKLDELNKRVRDRVEENRKELEKLLREARDRIRELER

SEQ ID NO: 7635 - protein, 178 aa, Artificial Sequence; identical to SEQ ID NO: 7634
  Synthetic

SEQ ID NO: 7636 - protein, 183 aa, Artificial Sequence
  Synthetic
SLEDRLREVLKRYEDRSRDLERELKRVLDEYDDSSRKVAEELKKVLDEIRETVERIKKDVDEKDLRRIKELLKRLEEEVKRTVDENRREAEEIKRKVKKETDENRREADERRRDLERRKGKPRREKEVADLVKKLEDDLRRTSDKVRRVVEEIKRRLEELERRYKALVKKLRDKLREIKEEVR

SEQ ID NO: 7637 - protein, 183 aa, Artificial Sequence; identical to SEQ ID NO: 7636
  Synthetic

SEQ ID NO: 7638 - protein, 181 aa, Artificial Sequence
  Synthetic
DVEEELKKVDDKVEELVRKVIEDIRRALERVRELVERVRRKLEETNKKLKKLVEDIVRKKGRRKELEETLRRNHERLTRATERLKELEERLRKSVEEIERTLKERLDRHHRELDKVREDNGPSEKVEELLRKSEELAKRIEDDVRRVLRKLEDTVRRIKEEIDRLLKDNERIIEEVKRRAD

SEQ ID NO: 7639 - protein, 181 aa, Artificial Sequence; identical to SEQ ID NO: 7638
  Synthetic

SEQ ID NO: 7640 - protein, 181 aa, Artificial Sequence
  Synthetic
SVEEIIEDMLRKVRELVRRVRELLREVDEKLKKLVEDVRRRLEKTNKELKDLVEDIVRRSGERKELKETMKRNHEELTKVDKELEEEKEKHHRELERADKELEDIIRRLEEEVKDLKDKKGGSEEAKRVLDKLRKTAEDIKRTIDELLKRSEETIKKIEDKIDKLVKKNKELVKRIEDEAR

SEQ ID NO: 7641 - protein, 181 aa, Artificial Sequence; identical to SEQ ID NO: 7640
  Synthetic

SEQ ID NO: 7642 - protein, 186 aa, Artificial Sequence
  Synthetic
SLRELLDEVRRAVEESNRELERLLEEVDRSNRESHRELKRLLEKIKKLAEEVERELERKGTSEDEKKKLDDEKEKLDRLLRKLEEESKEAKERNDERMRRLRKESEEVKRTLEEIERRLEKQGDVSEEEVKKAVEDLKRLVDTHKKRVEEVIDELRKHSEKHSEEVRRVITELARRLEELLDEIRR

SEQ ID NO: 7643 - protein, 186 aa, Artificial Sequence; identical to SEQ ID NO: 7642
  Synthetic

SEQ ID NO: 7644 - protein, 179 aa, Artificial Sequence
  Synthetic
SAEEKVEDELRKHHEEVKRLLEEIEKTMRDHHREVEETLKDSRRELKRIEEEARKVKERRVREEELKKIEEDLEREHREHEKRLRDLRRESEKKVRELKEKLDRFRDTSRKRTEDLRREGSASEDILRKLEEEVRRNDKELRDLLEELKDLVRRNDEELRKLNEEVRKRVEELIEELRR

SEQ ID NO: 7645 - protein, 179 aa, Artificial Sequence; identical to SEQ ID NO: 7644
  Synthetic

SEQ ID NO: 7646 - protein, 179 aa, Artificial Sequence
  Synthetic
SIEEMLKRVKEESKRSNDKIRDVLRKVEETSRRSKERIDKLLRDVERTVEEVIRDVKADESIVRDLKRILEKLREDVERTKRRDDERLEKLKRDVKREEDRDREDNERLERETRKSRRPEKDVLDRLRRYVEENRRRVEKLIRDLEDAVRRNEDDARRVAKEIEDVVREIKDRVDKTRT

SEQ ID NO: 7647 - protein, 179 aa, Artificial Sequence; identical to SEQ ID NO: 7646
  Synthetic

SEQ ID NO: 7648 - protein, 178 aa, Artificial Sequence
  Synthetic
SEVDKKLEDIRRRLEKLERETEESLDRVRKELEDLEKESRESLKRLREDLERVKKTKLDERTLDDKIEEMKKRNEEHRKKSEDSARELEKRNREHTKRLEDVERELREELERLDRSGVDKKKADELRRVIEEIIRRLRELDEKHRRLVEEIIRRLEELNREHSKVVEEIARELKKTAK

SEQ ID NO: 7649 - protein, 178 aa, Artificial Sequence; identical to SEQ ID NO: 7648
  Synthetic

SEQ ID NO: 7650 - protein, 177 aa, Artificial Sequence
  Synthetic
SLLEELKRSIEESIRTLKELLDRLEELIRRIAEEIRRLLEEHSRKTEEVIRRAEKAGVPREDLEELADRLRKNNKRLEELVKELIDRLRRLLEDLKRRIEKYAEDLKRELAELRRVKDEKVIEELKRKLEEENKRLKKVVEEIAKTLKDLLDEVRRRIEDSLRKLEELLERVERKTR

SEQ ID NO: 7651 - protein, 177 aa, Artificial Sequence; identical to SEQ ID NO: 7650
  Synthetic

SEQ ID NO: 7652 - protein, 177 aa, Artificial Sequence
  Synthetic
SLLEKLEKLIRDIKRTVDKLLEDNEETIRRIIRDIERLLKRHSDETREVVRTLKERGVPDRRLEEVKRRLEKNNRDLEDEIRRVAEELKRSLKKLKEDIERLAKKLEDDLRELRRVQDKDVIERIERELRELLKKLKEDADRHNEDAERKLRRLRDTIRRSLKKLEEDLRRLSKEAE

SEQ ID NO: 7653 - protein, 177 aa, Artificial Sequence; identical to SEQ ID NO: 7652
  Synthetic

SEQ ID NO: 7654 - protein, 186 aa, Artificial Sequence
  Synthetic
SRVEETLKRLEDELKRIEEEVRKLLDELRRHLEENRRRTEKLLRELREELERVRERVEKGDRSEDELREELERIAKKLDDELRRHNEHLERSKKRLEDILRELEERIREVARRMEKTLEDLRREGVDEKLLRRLERLVREIKRRLEELLKRLADLVRELKKEHERLNRELEELVRRIKERLKEAEK

SEQ ID NO: 7655 - protein, 186 aa, Artificial Sequence; identical to SEQ ID NO: 7654
  Synthetic

SEQ ID NO: 7656 - protein, 178 aa, Artificial Sequence
  Synthetic
EEEERIKERLDRSVEELKKSADKMREEIERSEKKLKESADRVRKEIEDALRRIREEDRDKKELDEEIKRLRDRLREHERETEEENKRLRKRLEEHVRETEKNNERLRRELEKVERNGLEEDVVRRVEELLRRHEEVTKTINREIEELIKTHERSTRELNKEIKELIERLEETIKERTR

SEQ ID NO: 7657 - protein, 178 aa, Artificial Sequence; identical to SEQ ID NO: 7656
  Synthetic

SEQ ID NO: 7658 - protein, 178 aa, Artificial Sequence
  Synthetic
KDAEELERRLRKSAEDLKRSAEEMKKRLDKSREDVKRKVEEAKKIVEDLEEDLKKRDTDDELLERTLKTLEKILDELEKDLRDNNKRLREDVERHKKETEENNRRLRREVEEVERKGLSEEMVKRLRELLRTHEEITERINRKIEKLLREHEEETKRLLDDLRRLLEELRKKIEEEKR

SEQ ID NO: 7659 - protein, 178 aa, Artificial Sequence; identical to SEQ ID NO: 7658
  Synthetic

SEQ ID NO: 7660 - protein, 178 aa, Artificial Sequence
  Synthetic
DEEERIEEELRKSTEKLKESLDRMRRDIEKSAEDLRKSVEDVERDMRRLLEDIEKRDTDESELRDRIRRAEEDVRRHLRETRENNERLREKLEKHVEDTERNNERLRREVEKVERNGLDKDALERVRRLLERHERETRRINEEIERLIRRHVEETKRVNKRIKRLLDELKRRIEEKSK

SEQ ID NO: 7661 - protein, 178 aa, Artificial Sequence; identical to SEQ ID NO: 7660
  Synthetic

SEQ ID NO: 7662 - protein, 178 aa, Artificial Sequence
  Synthetic
SEEEEIKKRIDDARKELEESTREVRERLRDSMRRLDESLKRVEEEIRKLADDIRRREVDEELLKDTIRRARERLKRHERETEKNNKRLKEEVERHVEETKRRIDRLREEVEKLERNGLEEEVVRRVRELLKRLKEEVDRINDEIRKLLEDHKKRTEEVNETIKRLIDRLEEELRRRRE

SEQ ID NO: 7663 - protein, 178 aa, Artificial Sequence; identical to SEQ ID NO: 7662
  Synthetic

SEQ ID NO: 7664 - protein, 186 aa, Artificial Sequence
  Synthetic
SEVEKIIEKIRREEDRNRREVEEKLKRIREHVRRNEEDTRRIIRELRELLKEALDRLRRGDRSKEVLKRLVEKIVEDVKRLLDRHREHSERSVRELRKILEELRKHIKKTVDDLRKILRDVREKGADEKLLRELEELIRRVKKRHDELLKEVADLVKEVEDRHRKLNEELERVAREIEETLKRELD

SEQ ID NO: 7665 - protein, 186 aa, Artificial Sequence; identical to SEQ ID NO: 7664
  Synthetic

SEQ ID NO: 7666 - protein, 179 aa, Artificial Sequence
  Synthetic
SEVETLLDKIRRDNEDLNRRVREELERIRKADEDVNREIEKVLRDIEEAIRKLKRDRLDKDKLKKTLDDLRRRVKEIEDKLREHIKRLEDRLRKIKEDAERHIRELEKRIRDFKERRKEADELVRRLEKILREHEENIKRIVEELERLLEEHKKNLEDLKRRLRDILRKVEEELDRTRK

SEQ ID NO: 7667 - protein, 179 aa, Artificial Sequence; identical to SEQ ID NO: 7666
  Synthetic

SEQ ID NO: 7668 - protein, 179 aa, Artificial Sequence
  Synthetic
SETEELVKKIDKRDKEVKERAKRVVDEIKERDKRVNEEIEKVLRDIERTIKKVREDRLDEDELRRVLEELERRIREIEDRLRRHIEELKRKIDKTKRDLEKHIKDIEDELREVKEKRKEAKEMVDRLRELLERHEKTIRDLVRTLEELLERHRKNIEDLVRELRELLDRAREELKRTAD

SEQ ID NO: 7669 - protein, 179 aa, Artificial Sequence; identical to SEQ ID NO: 7668
  Synthetic

SEQ ID NO: 7670 - protein, 182 aa, Artificial Sequence
  Synthetic
SDIEEALKKIKKMTRELREEIKKTEEESERRAKELEKEVRDYLRKVEEEAKRLKDTKASTEELRRTLERSREESEEILRRLEKTHRDHKRKLDEIKKKLKDVNEKIEREIRKILKDKGEDEDIRRVLEELKKVLEENNRVIEELARRLDELNKKLRELLERIKKTLDDLNKRLEKLIRDTEK

SEQ ID NO: 7671 - protein, 182 aa, Artificial Sequence; identical to SEQ ID NO: 7670
  Synthetic

SEQ ID NO: 7672 - protein, 182 aa, Artificial Sequence
  Synthetic
SKIEKMLRDIEKKTKELEDEIREALKRLREIAEKLKDEVEKYIRELRELLKRLAETKSSDEDLKRELKKSEDRSREIVKKLERVIEKVEREVREIKKKLETTNREIEKEIREILKRDGEDEKIREALERLRKILRENNEVIRELVERLRKVLEDLKRTVKTIEDRLRKVNEDLKRLIEELER

SEQ ID NO: 7673 - protein, 182 aa, Artificial Sequence; identical to SEQ ID NO: 7672
  Synthetic

SEQ ID NO: 7674 - protein, 179 aa, Artificial Sequence
  Synthetic
SEAEKLIEDIKKLIEDHKKRTKELIDEIEEDIKKHREDVERLLRDIERLIEELERENSKDDRVVEEVEDSLRKIKRTLEELVKEHRKKLKEIKEDLKRDLDRVEEVLKRVEDDLRRRDTSEEVERKVREAVKDVRRVLDESRRRLDTAIRKVEEDLRKSREDLERAVKKLRDVLEELKR

SEQ ID NO: 7675 - protein, 179 aa, Artificial Sequence; identical to SEQ ID NO: 7674
  Synthetic

SEQ ID NO: 7676 - protein, 179 aa, Artificial Sequence
  Synthetic
SEVEKLERKTEKILKDLKDEVKRAEEETRRILEELKKMLEDMEKRTREILKRIRDLARDGRSRREDLERILRRHNDEIRKIKERLEEKLERHNRKIKRIDDELKKTDDEHNRELDEAKKRGVSEKKLRELNTELTRLIDEIRKRLEELNERLRKLVEEIEERLRRLNEELKRLVEEIRR

SEQ ID NO: 7677 - protein, 179 aa, Artificial Sequence; identical to SEQ ID NO: 7676
  Synthetic

SEQ ID NO: 7678 - protein, 178 aa, Artificial Sequence
  Synthetic
KELEDTAEESKRELEKIRDEVRKEEEESEKLLRKIEKELREYAEKTRRILEKLRRDQLDKDELRRTLEEHRRETKELRDRLERTLERHEKRSEDIREKLKELLRRHEEKSEDELRKRPDEEVARLLKKLNDELRRLIREIEERLRKLNDDLRELIERVEERLRRLNEELEKVIRELET

SEQ ID NO: 7679 - protein, 178 aa, Artificial Sequence; identical to SEQ ID NO: 7678
  Synthetic

SEQ ID NO: 7680 - protein, 178 aa, Artificial Sequence
  Synthetic
DEVEDTERRSKKKLEELEEELRRTATESKRTLEELKRRLEDEERRSRDALRRLKEANLDEDKLRKVLEEHRKRSKELKERLEEDLRRHRKKSKELKDRAEEALKRHREESKRRLDERPDEEVKRRLERLNEEIEKLIRDIERTNRELNKELEDLIKEIEDRNRKLNEDLRRLIDELRK

SEQ ID NO: 7681 - protein, 178 aa, Artificial Sequence; identical to SEQ ID NO: 7680
  Synthetic

SEQ ID NO: 7682 - protein, 182 aa, Artificial Sequence
  Synthetic
SELEEIAREVKETSKRHEEHVRRSEEEVKKTLKRLKEHVDKSSEDAERTLEELERRLRRDGKDERLEEELDKTIKRLEEHVKDNIRKLRETLDRLRRHIDRNRKESKRLLEELKKRIDEVRKRNVRDDELRRLKEELKENIERAEESHKELADRLRELIKRIKERHEELLRRLRKLLEEIRK

SEQ ID NO: 7683 - protein, 182 aa, Artificial Sequence; identical to SEQ ID NO: 7682
  Synthetic

SEQ ID NO: 7684 - protein, 178 aa, Artificial Sequence
  Synthetic
SAEEDLERLIRALKKVLDDHERLLRELLRRLEEVVRRHKELLKKLNRDLEEVLKDIKEKKRDKRELEEELKRRLERHRRESEKSKERVERALREVKKKLEKSIRKLEEELRKVEEKLRKDGATDETDKEVRDTIRRIRKHSREVAEEVRKIIEELRRHSKKMADDSKRTIDELRERAK

SEQ ID NO: 7685 - protein, 178 aa, Artificial Sequence; identical to SEQ ID NO: 7684
  Synthetic

SEQ ID NO: 7686 - protein, 185 aa, Artificial Sequence
  Synthetic
KVEEELDRLLKEIEKIIEEHRKKNKKLNDDIRRLIEEHERDLRELLKELEKLIRDLKKDLRDVEKLKRELEEILKRLAELIEESKRRLDDELRRHEKRSRDSVEKLERELKKLEDELRRLKEEGIDDRAVEEVRKRIEEILKRIRDNSKRVEEETRELLERIRRNSERLRRDVERLARELEEKKR

SEQ ID NO: 7687 - protein, 185 aa, Artificial Sequence; identical to SEQ ID NO: 7686
  Synthetic

SEQ ID NO: 7688 - protein, 178 aa, Artificial Sequence
  Synthetic
SDEERLEEKLRRVEREVEKKLKRLKEELEEYARRVKEMSDRHREEVERFEEEVRRRGGGGEDLDRRIRTLKKRSEELLRESEKRSEEIIRRLEKTLRDLEREVDKIRRELKEELERKDDDTLRKLMEKIKRALEELLKRLEDLVRRIEEELRRLNEELRKNIREAEERLRKLKEDAER

SEQ ID NO: 7689 - protein, 178 aa, Artificial Sequence; identical to SEQ ID NO: 7688
  Synthetic

SEQ ID NO: 7690 - protein, 180 aa, Artificial Sequence
  Synthetic
SADEILKEIEDTIRKLIEDNKRTLEEHERRTRKLIRELRELLKRHKTESRRLAEELKKDGDKDLSEEIRRIIEKLKKDNEKLERDVRRLEKKMRDDNRKLKEDNKRVAEEMKKTLDKLKKDRVSGEEVRKRLEELKKKVERENRRHREHLKKVAKEVKRTLDEIRRHLEEVKERVKRARD

SEQ ID NO: 7691 - protein, 180 aa, Artificial Sequence; identical to SEQ ID NO: 7690
  Synthetic

SEQ ID NO: 7692 - protein, 172 aa, Artificial Sequence
  Synthetic
SEEEELKRRVDEVRKRTKEIIEELKRHVDRNERTVREIIKRLEEEVRRVAEKVKRGELDREELRELIKRIDEKLKKTLDDVRKHLEDSLRRIEDILRRHEEESKKIEDDMRREVKNSKVVEDVRRTLKRLNDELRKVVKDARELHERLLRDLKRVIDRIRERLKRLLDEAEK

SEQ ID NO: 7693 - protein, 172 aa, Artificial Sequence; identical to SEQ ID NO: 7692
  Synthetic

SEQ ID NO: 7694 - protein, 180 aa, Artificial Sequence
  Synthetic
DEVETLAREVKKSNDDDRRKTKKTADDVEKKLEDLKRRDEEVRERVEEDLKRLREKVKGDELRRIVEEIAREVKELLDRSKDLSRRVAEELRRLLRESKEIVDRVARKTEELLKEVRKDDKKEVLDRVADEIRRLNKETNDVDRDVRRRIDKLVEDVKRVTEEVSKEIKRLAEEVDRRIT

SEQ ID NO: 7695 - protein, 180 aa, Artificial Sequence; identical to SEQ ID NO: 7694
  Synthetic

SEQ ID NO: 7696 - protein, 180 aa, Artificial Sequence
  Synthetic
DEVEELKRKVRESNKRDEDETRRTEERVEREVRRLEEEVKDVKRKVERELERIAREIKGDELRRIVEEVAKRIDDLIRRIDEIIKRVRKEVKRLLDESRKIVKDVARETEKLLRDLERDDKREVVKEVEDRIRKLNRETNEVDKEVRKRVDDLIRDLERVLREVKEEVDRLVRKVEEDAK

SEQ ID NO: 7697 - protein, 180 aa, Artificial Sequence; identical to SEQ ID NO: 7696
  Synthetic

SEQ ID NO: 7698 - protein, 187 aa, Artificial Sequence
  Synthetic
DEVEELVKRAEDILERLKREVDRLIKESEDLNRRIRKHVEDTIKEVRKRLEELRKEVEDRATEEVRKVVDELRKEVERLVRESREVVKRSLEISKRLAEEAKEVLERLRELVKKLVDELRKKKDDERAKDLLKEVVERVTRVAKAVKEKLDEVVRESREVIKRVEEKNRRVLEEVERVARELKKAID

SEQ ID NO: 7699 - protein, 187 aa, Artificial Sequence; identical to SEQ ID NO: 7698
  Synthetic

SEQ ID NO: 7700 - protein, 187 aa, Artificial Sequence
  Synthetic
DEVEELVRRAEEELKRLRKHVEETVERSKKLNDEIKKHVDRTVKEAKDELRRLREEVKKRGDERVEKVVEEVDKLVEELVRTSKEVVRDSLRKSTELAKRSRDLVDEVRRLVEELVKELRDKKDREEAKKLLEDVARRVRKVAEELKKKNKELLETSDRVIEKVRKKNEDLKRTVDEVARRLEEAIK

SEQ ID NO: 7701 - protein, 187 aa, Artificial Sequence; identical to SEQ ID NO: 7700
  Synthetic

SEQ ID NO: 7702 - protein, 178 aa, Artificial Sequence
  Synthetic
SEVDEVVERLRRISEELDRRVKKLVKDARRISKELEEAVRRVVKTAKDANKELRKEVRERRTDESVVRENHKTIEDVVRELEKVLEEDRKTVEEVVRAARKVVEDDEKTVEDIVRLAKAGVDVDTLAEDAKRSARETEEILRRLVKKLEESARDTKRIIDELDKELKDSNEEVRRRLK

SEQ ID NO: 7703 - protein, 178 aa, Artificial Sequence; identical to SEQ ID NO: 7702
  Synthetic

SEQ ID NO: 7704 - protein, 174 aa, Artificial Sequence
  Synthetic
DEAEEVVKDVEREVRRLEKENRDLVERSKRLVERLEKESRDLVRKSREDVKRLREKGVPEDVVRKLEEVSRDSARRLKESNDESRRVSDESKKKLEESLEETRRVVDRVRKLLREGVDEEELRKDVERVVKKDEDITDEVRKENDEVVKKNEDIIDELRKKNEEVLRRVDEEAR

SEQ ID NO: 7705 - protein, 174 aa, Artificial Sequence; identical to SEQ ID NO: 7704
  Synthetic

SEQ ID NO: 7706 - protein, 174 aa, Artificial Sequence
  Synthetic
SEVEDVVRKVRELVKRLRDESRRLVEESRRLVEELEKRSRDLVKTAEDIVRELKEAGVPEEAVDKLRKVVETLKDELRRSNEKSERASRESKDRLKKSNDESERVVREVEKLLRAGVDKDELDKEVKEAVKKNREIIRRLEKRNRDVVEENRKIIEDIEKKVRDVVREVRREAK

SEQ ID NO: 7707 - protein, 174 aa, Artificial Sequence; identical to SEQ ID NO: 7706
  Synthetic

SEQ ID NO: 7708 - protein, 184 aa, Artificial Sequence
  Synthetic
SSLEEVAERVKKLVRELEESTKTVEELVRRLVTELRKSTEKVRRDVDKLVKELEEIIRDVKDKRELERVIREVMKRIEEILERNSRLIDEVMRRLEKILREDEKLIEDVARRAREIAKRLLDERDTREVKRLVEEVEKLIERLRRESRRLIERVRREARELKEESRRLEEEVRKKIEELARRVK

SEQ ID NO: 7709 - protein, 184 aa, Artificial Sequence; identical to SEQ ID NO: 7708
  Synthetic

SEQ ID NO: 7710 - protein, 184 aa, Artificial Sequence
  Synthetic
RDLEEVKKKVDKLVRELEESSKKVRKDVEDLVKELEDTTRDVKRLVEELVTRLKRIIEKVDRKKDLRKVIEDVAEELTRIARRDKELIDRVAEELEEILKRNTDLIKKVADELRRILDELLRKRDTREVKKIIEDVEREMERLERDSRRIVKEVREEADRLRKESKRLEEDVKRKLKELRERVN

SEQ ID NO: 7711 - protein, 184 aa, Artificial Sequence; identical to SEQ ID NO: 7710
  Synthetic

SEQ ID NO: 7712 - protein, 184 aa, Artificial Sequence
  Synthetic
DELERVKEKVDKLVAELEKSTDDVKKKVEDLVRELERSSEKVKKDVDRLVKELEDIIRRVKDKDRLLRTIREVAKTLEKILEDNKRLIREVARRLRRILEEDKKLIEEVMRRLEEILKDVIRKRDTREVKKVVEDVRREAKRLKERSKKLEDEVRDLLRELEKRSDEITKRVREEMKRLEDEVK

SEQ ID NO: 7713 - protein, 184 aa, Artificial Sequence; identical to SEQ ID NO: 7712
  Synthetic

SEQ ID NO: 7714 - protein, 184 aa, Artificial Sequence
  Synthetic
DELEDVKRRVEKLVRELEESSKEVRKRVEDLVRELERTTEEVEKLVRDLVRRLEDIIRRVKDKDDLRRVIERVMKELERILKEDKDRIRKVMEDLKRILEENDRRIKRVAEEIRKILEELLRRRDTEDIKRLEEDVERKLRRLEEESRRIVEEVKKEAERLKERSERLTKEVRELADRLAREVD

SEQ ID NO: 7715 - protein, 184 aa, Artificial Sequence; identical to SEQ ID NO: 7714
  Synthetic

SEQ ID NO: 7716 - protein, 184 aa, Artificial Sequence
  Synthetic
RELEEVKRRVERLVRELEESLRRVRKEVEDLVRDLERVSKEVEDTVRELVRRLDEVIRRVKRKEDLLRLIDKVAKELEKILKKSLDDSRRVMERLEEILERNSRLIKKVMKEAEDILKELIDRRDTREVKTLVEEVRRLLEELERRSRKLVKEVRDEAERLKREDEEIIREVRELLKELERKVR

SEQ ID NO: 7717 - protein, 184 aa, Artificial Sequence; identical to SEQ ID NO: 7716
  Synthetic

SEQ ID NO: 7718 - protein, 181 aa, Artificial Sequence
  Synthetic
DELEEVKRTVEELLERLERVNKDVKRKVKELLDRLREVDDRVKKEVKRLIEEVKNVDTDKKDVEKIVKEVEKTLKDLVRRVEEINRRVAEDLRRLLEEVERINDEVRRRLERLIEELLKDRDTEEIKKLADRVRRELKRSEDHTKRLAEEVRKDLEESRKHTKELEKEVEEELRRLKKEVR

SEQ ID NO: 7719 - protein, 181 aa, Artificial Sequence; identical to SEQ ID NO: 7718
  Synthetic

SEQ ID NO: 7720 - protein, 181 aa, Artificial Sequence
  Synthetic
SELEEAAKAVEKLAREAEKSSEDARRAVERLAREAKRANDEAEKAVRELAERARRADRREEEADRIAEEAAKEAERLAKEAKEINDRAAEEARRLAEEDREVAERAAKEAERLAKELRDTRDAKEAKKLAKEAREIADRLRRESEEIAREAEKIAKELADHTRELAERARRIADKLKKDVK

SEQ ID NO: 7721 - protein, 181 aa, Artificial Sequence; identical to SEQ ID NO: 7720
  Synthetic

SEQ ID NO: 7722 - protein, 178 aa, Artificial Sequence
  Synthetic
SAEDLIREVRRRVKELERKLEEILKRSEDLTRRLREEAERILKESRDRVRKLEEDARREAREDKDLVEKVIRELEKAIRHDEEVVRRVEELLKKVNKEVRDVIRKIRKLLKEVDKELEKRGESKEVIKKIRDILRRLSEELEKVLEDSERILRRLEDELRESLKRTEEILRELRRELK

SEQ ID NO: 7723 - protein, 178 aa, Artificial Sequence; identical to SEQ ID NO: 7722
  Synthetic

SEQ ID NO: 7724 - protein, 176 aa, Artificial Sequence
  Synthetic
SVDEVLKEIEDALRRLKEEVERVLKENEDELRRLEEEVRRVLKEDEELLEELKRKVREIDEVDRVVDEIRKLSREILEKVKKVVKEIRDSLETVKRRVDDVVRRLKELLDEIKRDNDEKKIRDVAKEIRDRLKELEEEIEEVTRRNKKLLDDVEEEIRRVHEKTRRLLETVLRRAT

SEQ ID NO: 7725 - protein, 176 aa, Artificial Sequence; identical to SEQ ID NO: 7724
  Synthetic

SEQ ID NO: 7726 - protein, 175 aa, Artificial Sequence
  Synthetic
RLEEVVEEMERLIRDLEKKVEDARERNERLVRESRKKAEELIKELRKLLRELEEEIRKGSKKVVDEIRRVVEEVVKEIKKLLERNEEVSREVEERLRRLVEEIKRVVEEAIKLLREGIDVETVLKRVREVIRRVEETIKRLDDRNKESSEDVERRLRELLREVREIIKRVREKTR

SEQ ID NO: 7727 - protein, 175 aa, Artificial Sequence; identical to SEQ ID NO: 7726
  Synthetic

SEQ ID NO: 7728 - protein, 175 aa, Artificial Sequence
  Synthetic
RLEDVVRESKKLVEESERRVREAIRRNEELVKDSEREAREVIEELKELLRRLEEELKKGSEEVVEEIRRKIKKVVEDIKRLLDRNREVSEKVVRDLERLIREIREINRRAVELLKRGVSVEDLLREVRRVDKEANEKIEELDRRNKKSSDDVKKKIRDLKREVKKVIDEVRERTR

SEQ ID NO: 7729 - protein, 175 aa, Artificial Sequence; identical to SEQ ID NO: 7728
  Synthetic

SEQ ID NO: 7730 - protein, 181 aa, Artificial Sequence
  Synthetic
SELEKVLTESRDVVRRATKRLREVHKKTKEVVDRLREKLKRVEDEVRKAVRELEEKVRDEDVVRDVARRLEELLKELERVVREIERELERVIRETEEVIKTIDELLKRVNERVRKVIEEKKDKRLEDVLKESKKLTDDLRKDAKRVLDEDRRLVEELKKELDEARKRVEDLVREVKDRARR

SEQ ID NO: 7731 - protein, 181 aa, Artificial Sequence; identical to SEQ ID NO: 7730
  Synthetic

SEQ ID NO: 7732 - protein, 185 aa, Artificial Sequence
  Synthetic
DEVEEVRKRVEEVIRRNEERIEDVRKKVEDVIRRNEKLVDDVRREVKEVLDKLRELLERRKERVKDVVTEVEKRIRKLLDELRRSSEEVKRLIDELLRRAEKSSREVKETIDRLIEDLKRKLKDDKETVDEVAERLKKLLEESERRVKRVLDEARKLVKRSEDRSKKVLDELEELLRRVRKEADK

SEQ ID NO: 7733 - protein, 185 aa, Artificial Sequence; identical to SEQ ID NO: 7732
  Synthetic

SEQ ID NO: 7734 - protein, 188 aa, Artificial Sequence
  Synthetic
RELEELLEEARRSSEEVKKILKKLKKEVDESSERLERIIEKLLRDAKRVADEVRDILEKKREDRDVVRKVIDELRKVIEEIVKRLRDAVRENEKSIRDVIRKAEKVVEENERVIEEIVKKAKRDLKDDEERVKRVIDELRELLRRSREEVKRVVEELKKELERSKREVERVIDELRRLLETVEKEIRD

SEQ ID NO: 7735 - protein, 188 aa, Artificial Sequence; identical to SEQ ID NO: 7734
  Synthetic

SEQ ID NO: 7736 - protein, 188 aa, Artificial Sequence
  Synthetic
SELEDLKRRIRKSSEDSKKSLEDSDRTIEESSRDSSRTARESERKLEKVLREVDDILKKVKDDKDVVRRVLERLRRIIKRLVDENKRSVEENKRSIDELVERNKRSVEENERVIKEIVDRAKRDASSNEEDVERIVRELEELVRKSREDHKRVIDALREKLKKSREEHRRVIDKLRRELKRVEDEIRR

SEQ ID NO: 7737 - protein, 188 aa, Artificial Sequence; identical to SEQ ID NO: 7736
  Synthetic

SEQ ID NO: 7738 - protein, 188 aa, Artificial Sequence
  Synthetic
SILEKLEREVRKSSRESRESAKKSLREIEESSRRVEEELERLLREVRRVAEEVLDILRRKKEERETVKKVLEDLKRIIDKVVEDAKRVVEENRRVIEEAVRKNEESVRENEEVIDRVVKKARRDLDKRREEVKRIIERLRKLLEDSKRDHEEVIKELRKLVEDSRRRVEEVIRRLRELLKRVADELRR

SEQ ID NO: 7739 - protein, 188 aa, Artificial Sequence; identical to SEQ ID NO: 7738
  Synthetic

SEQ ID NO: 7740 - protein, 189 aa, Artificial Sequence
  Synthetic
DELEEALRRLKKIVEDLARRNEELLKELRRDSKRLKDEIKRVVDELRDIVRRLKEELDRVKEREEVARRILERLERVIRRLVEILKALVDHNKKSIERVVEEAERSNEEVERVVREVVDEARKRTRDERLERRVREIIRRAEELLERSRKRSEEIAREAEKSNRELEDAVRRIIRELEELLEKLERDAR

SEQ ID NO: 7741 - protein, 189 aa, Artificial Sequence; identical to SEQ ID NO: 7740
  Synthetic

SEQ ID NO: 7742 - protein, 189 aa, Artificial Sequence
  Synthetic
DEVDKVTRELREIMRKLKEDDKEVLDRLREDSERVERTNREVEKRLEAIIRDLEEKLRRKREDKDLVKRLLDELRRVVEEVRREVEELNEHNERSIRDAVRKSRELVERIRDVVREVDERLKRLTRDERLKEKVDRIREEAKRLLEELEKHVRDSEREAEDSNRRSRETSEEIIRRLRKKVKELEDKVR

SEQ ID NO: 7743 - protein, 189 aa, Artificial Sequence; identical to SEQ ID NO: 7742
  Synthetic

SEQ ID NO: 7744 - protein, 189 aa, Artificial Sequence
  Synthetic
SEVDKVEEELERIVKELKDRDREVLKRLRDDSERLVRELKKVAEELRKIAKDIDERLKEKKEDKDFVEKLVEELKRVIEEVVRRLEELVKHNNRSIEEVVRISERLVEDLERVVRRVEDTLRKLTRDERLKDRVDKIREKARKLLEELKKHVDDSIEEAKRSNEELRKTVEKIIREAEKLLRDLKEAVK

SEQ ID NO: 7745 - protein, 189 aa, Artificial Sequence; identical to SEQ ID NO: 7744
  Synthetic

SEQ ID NO: 7746 - protein, 189 aa, Artificial Sequence
  Synthetic
SEAEKVERELDKIIRELKETDKKVLEDNRRVVEKIEREMERVLRELERIMKELKEELDRKREDKEVLRRLVETIRKVVEEVEETLRRLLEESKRSSEAVERISKKLLEELREVVERVVRRLEELRRDERLKEKVDEIRKRAEELVKELARHVEKSIRESRELDKRLEEKVKEIIRRARELLEDLRRKAE

SEQ ID NO: 7747 - protein, 189 aa, Artificial Sequence; identical to SEQ ID NO: 7746
  Synthetic

SEQ ID NO: 7748 - protein, 179 aa, Artificial Sequence
  Synthetic
SEAEKVRREVEDLIRTLEEVVRKSSEEIKELLRRLREVVERIRDTTRRLIEEIEKKVKSRKADEIRRLVKKAVDEDEEVIRRVEELVRRVLEKNKEVVRRVEELLRRVVEKIEDVRRRGGREDLERVLKEVREIVKRLLKRLEESLRDVRRIAEELREMLKRSLKRSEEIIRKLLEDVR

SEQ ID NO: 7749 - protein, 179 aa, Artificial Sequence; identical to SEQ ID NO: 7748
  Synthetic

SEQ ID NO: 7750 - protein, 180 aa, Artificial Sequence
  Synthetic
DEVDTVDEKVKRLAEELRKRVRESKERTKKLARDLREAVKESLKDSERLAEDLRRKVRDEELKRRVEEVVRESRRLNEEIRRIIEKVVEDMKDSNRRIEEIIEKVVREVKELLKRVRDDDTREKLERVEREIEKLVREVEKILRDIHRDNERVVREVERRLEEITRRSRELAKRVEDETR

SEQ ID NO: 7751 - protein, 180 aa, Artificial Sequence; identical to SEQ ID NO: 7750
  Synthetic

SEQ ID NO: 7752 - protein, 180 aa, Artificial Sequence
  Synthetic
DEVDEVARKVERDAERLEDLNRRSEETSRRLAEELRRLNERSERETERLAEELRREVREERLRKLVEDVVREVRDTNRRSKEISEDVVRKSERLNRESKRITKEVRREVKKLLDEVRKDDDKKKLEDILREIEKLIRRVEEISRRILEESKRLADEVRKITKKLHDDNKRLADRVKEETR

SEQ ID NO: 7753 - protein, 180 aa, Artificial Sequence; identical to SEQ ID NO: 7752
  Synthetic

SEQ ID NO: 7754 - protein, 180 aa, Artificial Sequence
  Synthetic
REIDEIKERVDRLAEKLRRDMERSTRESRKLVEELKERAKRSKEETTKLAEELRRRVRDEEVRRIVEEVVEKVRTTNEEVRRIIEEVVKRLKETNDRVREIIEDVVRRVDRLLKEVRKRDEKEELERILREIKRLMDEVKRILEELLKTNKKLIDEVRKRLEELHKRNRELVEEVARRAN

SEQ ID NO: 7755 - protein, 180 aa, Artificial Sequence; identical to SEQ ID NO: 7754
  Synthetic

SEQ ID NO: 7756 - protein, 183 aa, Artificial Sequence
  Synthetic
SEVEAVEKEARELVREDERRDDEIEEDLRRLLEENRRKDDKVEKEVRELLKRLRDKVDDRADERLRELVEDVARKVKRLLDESRRSSEEVAERLKRLLDESRKTSKEVMEILKELLERLRRVSDKRDVKRVRDTVRDISRKNNRTTEELLKRVRDISRRNKEITEELLRRIREIAEDLARKLD

SEQ ID NO: 7757 - protein, 183 aa, Artificial Sequence; identical to SEQ ID NO: 7756
  Synthetic

SEQ ID NO: 7758 - protein, 183 aa, Artificial Sequence
  Synthetic
SEVEKVEEEVKRLVEENERRVRESSREVEKLLREDAERDERASRELKKLLEKLKRAVDKRADERAEETVRDVARKLEDLVRRSKRSSDEVAKALEKLVRDSDKSSKEVAKRLEDLLRELRKVSDKRAVEKVLRTARKISEDNKRKNDEISERLRRISERNNRESEKLLRDLEKIIEDVERKLE

SEQ ID NO: 7759 - protein, 183 aa, Artificial Sequence; identical to SEQ ID NO: 7758
  Synthetic

SEQ ID NO: 7760 - protein, 183 aa, Artificial Sequence
  Synthetic
REVEEVEKKARELVERDERTDERIRKELEDLVRENKKEVKRVRETIERLLRDLKKAVDERGDEDVRRTVDKVAREVEELIKEVDRTSKEVEELLRRLLKRSEETSREVMEILRRLLEELRRVSREEDVKRVEKTVEDISRKNNEITKRLRDTVRRLSEKNRRDLEKALEDLKRIVDDVRRKIT

SEQ ID NO: 7761 - protein, 183 aa, Artificial Sequence; identical to SEQ ID NO: 7760
  Synthetic

SEQ ID NO: 7762 - protein, 183 aa, Artificial Sequence
  Synthetic
SEVEEVEKEARELVKRDEDRDKEIEDKLRELVERNRRLVRKSSEELKKEIKRLKDEVDRRADERVEDTVRKVMEELKRLVEESRKTSEDIARKLDELVKRSKKTSKEVMKTLRDLLERLRRVTEKEKVEKVLKEVRDISRENNKTTDTLEKEVRRLSEENKRRNEEVTRRVRKILEDVERKAR

SEQ ID NO: 7763 - protein, 183 aa, Artificial Sequence; identical to SEQ ID NO: 7762
  Synthetic

SEQ ID NO: 7764 - protein, 183 aa, Artificial Sequence
  Synthetic
KEVEDVEEEVKKLVEENKKAVDDSREEVRKLLEENKKAVDDSRKEVEKLAKKLKEAVDRRADEDARREVEEVVRRARELLETSRETSDRVAKELKKLVDESEESSKRVADELRRLLRELRDVEGKEKVKRVLDEAKKISDDNKRKNEEVSKELEKISRDNLKLNEDITREIREIVERVDERLE

SEQ ID NO: 7765 - protein, 183 aa, Artificial Sequence; identical to SEQ ID NO: 7764
  Synthetic

SEQ ID NO: 7766 - protein, 183 aa, Artificial Sequence
  Synthetic
SEVEKVEKDLRKLIKDNRDSVRRVKEEAEKLVEENRRSVEEVRRTIKELLERLEKLVRDRGTEEVKKTVEDVMRRVEELLRRVRETSEEVARRLEKLVEDVRRTSEDVMRRLKKLLEELRRVSDKRLVDKVRRELEKILRDDNRIIKEVLDTVRRLSEDNLKKVKDVLEELTRIAEEVRERAR

SEQ ID NO: 7767 - protein, 183 aa, Artificial Sequence; identical to SEQ ID NO: 7766
  Synthetic

SEQ ID NO: 7768 - protein, 178 aa, Artificial Sequence
  Synthetic
SKVEDLLEKLERELEKNRKRTKELLKRAEESSEDIREKVRELRERLERLIEELERRGVPGEVVEEVERVVRRIDRELREVVRKNNEVVRKIVELLKRSDEKVKEVVKRIADLLEEKRDDDKLLEDLERLVRRVLDEARKINEELDKRVKDSVREVEKRLRELEEEVKRIIEEVEKKAQ

SEQ ID NO: 7769 - protein, 178 aa, Artificial Sequence; identical to SEQ ID NO: 7768
  Synthetic

SEQ ID NO: 7770 - protein, 173 aa, Artificial Sequence
  Synthetic
EELERLARIVDEAHKRSRDLLETSKREVEDAIDEIRARLEDSRRLVEEVTDEIRRIDKREDVRRLLEELKDHNRRVVEDVERLLRELERRNEEVVRRSKELLDDLERIIDSLDDSERLKELKKRLRDLIEENDRRAKESTKKIRDLAKELRERARRTEEEIKTLMKELEDRMK

SEQ ID NO: 7771 - protein, 173 aa, Artificial Sequence; identical to SEQ ID NO: 7770
  Synthetic

SEQ ID NO: 7772 - protein, 173 aa, Artificial Sequence
  Synthetic
KELEDLRREVEEIHKTSERLLRESDKLVEEAIRRIEELLERSKDTVTKAADEVRKADKREDAERLAKELLEINEKVVRDAERLVTEVRRHNTEVVERSKELVETIERRIDSLRDDERLKKLKEDVKRLIEENRKRAEDTKRKIEEEIRRLKEEADRTSEEIKKRADDLRRRAD

SEQ ID NO: 7773 - protein, 173 aa, Artificial Sequence; identical to SEQ ID NO: 7772
  Synthetic

SEQ ID NO: 7774 - protein, 177 aa, Artificial Sequence
  Synthetic
DELEEVDKLVKKVHEDSRKLIEDVDRKVREVVERSDRIIETVEELVERVITEVEDMLRKGESDEKVRKLAEELKRILEESMKTSEDLVRKLREIVRKSVEDSKRLVDELRDLIRRLRKDDRLRKVEKRIEDLARENEKRNRDLERKIEKLADESRKKNEDLKKRIEDLAKRLKDEAD

SEQ ID NO: 7775 - protein, 177 aa, Artificial Sequence; identical to SEQ ID NO: 7774
  Synthetic

SEQ ID NO: 7776 - protein, 177 aa, Artificial Sequence
  Synthetic
SSLETVREEVRRVKEESDRIIKEVRDRVEEVHKTSKRIIEEVEERVERVIREVREMLRRGETEEKVEKLVREVEKILEDSRRESERLAEEVRRILKESMDRSDELVRRLEELLRRLEKDERLDRVVEDIRRLAEESRRKNEELRKEVEELVKRNKELNEKLKKKVKELAKELRDEAK

SEQ ID NO: 7777 - protein, 177 aa, Artificial Sequence; identical to SEQ ID NO: 7776
  Synthetic

SEQ ID NO: 7778 - protein, 177 aa, Artificial Sequence
  Synthetic
DDLETVKRLVDEVIRTSEELIDTVRRLVEEVHRESERILKEVKKEVERVIREVEKLRRKGEDETKVRRLVEELEKILEEVVRRSRELVERLERIVRKSLEDSKRLVDDLRRLIAEMRKDKDLERVRKRIEDLAKELERRNRELEEDIKRLAKENEELARELKKEIETLAKRLEDEDR

SEQ ID NO: 7779 - protein, 177 aa, Artificial Sequence; identical to SEQ ID NO: 7778
  Synthetic

SEQ ID NO: 7780 - protein, 177 aa, Artificial Sequence
  Synthetic
SSLEEVDRRVKEVHKESDKIIREVDKRNKEVNRRSEEIIEEVEKTVEEVAKTVDDMLRRGEDERKVEKLVEELERIVEDSVRKSEELARRLKEIHKRSVEESERLAKELRDLIRRLEKSRELKRVKEEIDRLVEEDKEKNERSDKRAKETVDKNKKLNDDLEEKIRRLAEELRRRKK

SEQ ID NO: 7781 - protein, 177 aa, Artificial Sequence; identical to SEQ ID NO: 7780
  Synthetic

SEQ ID NO: 7782 - protein, 184 aa, Artificial Sequence
  Synthetic
SSLKEVERLAKELHEKSERIIREVEKLSRELHKTSEKIIRDVARRVKKLIDDVREVITRSGDEEVVRDVRRLVEEVVKEARDILDESLRVSEDLAEKSRRINRRSLEESKKIAEDMREILRRVEPDEELEKLRKRVEDLVRRNEEENKRTLRESEELVKENRKRNKELRDRVEKLVEELRRELK

SEQ ID NO: 7783 - protein, 184 aa, Artificial Sequence; identical to SEQ ID NO: 7782
  Synthetic

SEQ ID NO: 7784 - protein, 184 aa, Artificial Sequence
  Synthetic
KKLEDVKELVERLHRESEEIIRDVERRSRELAETVKKILEEVRRLSKKLVDEVREVIKRSGTDEVRDDVRRLVEEVADRSRKINKRVEEVVERVVKRSKEINDTSLKRSEEIARELKELLKRVDKDKDVDRVDREVEELVKENRERNKDTKRESERLAEKLRRDVEKSLRDSERLVKELRDRLR

SEQ ID NO: 7785 - protein, 184 aa, Artificial Sequence; identical to SEQ ID NO: 7784
  Synthetic

SEQ ID NO: 7786 - protein, 184 aa, Artificial Sequence
  Synthetic
KKLEDVKRLVDKLVTESEDIIRRVTEESRRLVEESRRVIEEVKKLSEELVRRVEKVIREKGEERVAKDVREEVERVVKTSRDINRETTELSKDIVRRARKINEDSLRVSEEIARELEKLLEDVDKDERVKKVKRDVEKLVRDSRELNKRTREESERLVEESERLNEESRKESERLVRELREKLR

SEQ ID NO: 7787 - protein, 184 aa, Artificial Sequence; identical to SEQ ID NO: 7786
  Synthetic

SEQ ID NO: 7788 - protein, 184 aa, Artificial Sequence
  Synthetic
SKLEDVERKVRELVRRSKRVIKEVERLVRELHKRSEDVLRKVKKDSRDLAREVKDVIRRKGTEEVAKEVRDLVEDVVRKSRKINDDVRKISEEIVKTLEKILKESLDLSEDIADKLRRLVDSVDKDKDVDKVRRDVEDLVRESRELNKRLKREVEELAKENRRRVEESRRESEELAKELRERLK

SEQ ID NO: 7789 - protein, 184 aa, Artificial Sequence; identical to SEQ ID NO: 7788
  Synthetic

SEQ ID NO: 7790 - protein, 187 aa, Artificial Sequence
  Synthetic
SSIEKVLRELEDIVRKIEERNKKSHDEVRRVVEEIKRRVKKSHEDVRRVVEKIDEDIKRKKDDKRVLKELLDTVKRVVERSKETSERLLREAEKAVRESKERSERSLRELEEMVRRATKRLVDERGKDDDEIRRVKERLDELIRRLEELIRRNVTELKRLIDDLRRLVEENVRRLKELIDKLREDVK

SEQ ID NO: 7791 - protein, 187 aa, Artificial Sequence; identical to SEQ ID NO: 7790
  Synthetic

SEQ ID NO: 7792 - protein, 187 aa, Artificial Sequence
  Synthetic
SEIERVLEELKKIVRRIKEKLKESHERVREVVERLKRRNEKSHRDVRRVAERIRREIEKKKSDKDVLDKLLDTIRRVVEESKKDSKKSLDELRRVVKESKETSDTLLEELERAVDKVRKILVRERGKDDKDIREVKKEADRLIKELRDLIETNEREMKKLIDELEELIRDNARRLEELIKRLEEEVR

SEQ ID NO: 7793 - protein, 187 aa, Artificial Sequence; identical to SEQ ID NO: 7792
  Synthetic

SEQ ID NO: 7794 - protein, 187 aa, Artificial Sequence
  Synthetic
SELEKVLEEAKRVVDEIKKKLEESHKDNRRTVEEIKRRNKESHERLKEAVDKLKAEIEKKRSEEEVLRELLKELERVVRTSEELSRRSLDELRKSVERSKRTSKRLLDELRRVVDEVKKILVKKRGKDDDRIREIAEELDKLIRELEKLVKRNADESDKLLDELRKLVEDNEREAERLIKELEDEAR

SEQ ID NO: 7795 - protein, 187 aa, Artificial Sequence; identical to SEQ ID NO: 7794
  Synthetic

SEQ ID NO: 7796 - protein, 187 aa, Artificial Sequence
  Synthetic
SEIERVLRELEKIVEELKRENEDVHRRVREVVKKLKDENRKSHEEVKRMVDKIREEIKRIRKDKEMLRRLLETLKRVVERSERESEESLKELRRVVEESKKRSEESLERLRRVAKRVKERLVEERGKDDDDIRRAAEKVDKLIKELEDLIRRNAEELRKLIEELEELIRRNRERLKRLIEDLKRAVE

SEQ ID NO: 7797 - protein, 187 aa, Artificial Sequence; identical to SEQ ID NO: 7796
  Synthetic

SEQ ID NO: 7798 - protein, 177 aa, Artificial Sequence
  Synthetic
SEMERVEEEIRRLLKELDKKARDVHEADKELVKENRKLADEVERDLRRLLEELRRDVNVEEVLKKVEEVIDKVRKVVEEIEKLSKDSNEKTKRVIEKVKEDLERVLRRVEEIARNNVDKKAIEDVLRKIKKLVEDLKRRIEEVLRESEALNEDTKRLIEEVLRDVRRTIDRLKKEAK

SEQ ID NO: 7799 - protein, 177 aa, Artificial Sequence; identical to SEQ ID NO: 7798
  Synthetic

SEQ ID NO: 7800 - protein, 177 aa, Artificial Sequence
  Synthetic
SDMDRVEKELEELLRENEELAKDIHRRDKELLEENRELVRRAEEELRRLLEELARDVNKEEIKETVERVIRDLKRVAREIEEESRRSNEETKELVKRVLEKTRKVIEEVRKVAKDNVGKEVIKDVLRKVRKINKETKELLRTVLEKSEKLNRDTKKRIKDVLEKIKRLIDELRERAR

SEQ ID NO: 7801 - protein, 177 aa, Artificial Sequence; identical to SEQ ID NO: 7800
  Synthetic

SEQ ID NO: 7802 - protein, 172 aa, Artificial Sequence
  Synthetic
KEREDIEDRVRKLIEELEESVRRSNETVKKLLRELEKLLEDSNRSVEELARDLRRKVKSELMEKVERLVKDLLRLSDTVAKKIRDVVKRLLEKSNESVKEIKKLLEKLEKEIRDDGDEKVLRKVEKVVEDLKRHNRKVNEEIKRVAEKLKRELEEVNKDIRRMARKLEEEVR

SEQ ID NO: 7803 - protein, 172 aa, Artificial Sequence; identical to SEQ ID NO: 7802
  Synthetic

SEQ ID NO: 7804 - protein, 172 aa, Artificial Sequence
  Synthetic
SEAEKIAEDVERLARDLERLLKESNDTVRTLIEDLRRSVEETAKEVRDLIEDLRRRVKSDKARKVEEVVRDLLRIVEESAEEIRRVLERLLEISNTVAKEIRRVVKELKEIVERRGTEEVLKELKKVADELRRILEDVNRRIRKVVDDAREHNKKVVEDVRRVAKEARDRVR

SEQ ID NO: 7805 - protein, 172 aa, Artificial Sequence; identical to SEQ ID NO: 7804
  Synthetic

SEQ ID NO: 7806 - protein, 181 aa, Artificial Sequence
  Synthetic
DEVEELERRIEKLAREVKKEIKDALRRNKRLIDEVKKIIEDVNRENRRLMEEVKRLIDAGVPKEEITEIVERVVEEVRRSDEKVARIVEDVADKIRRTNEDLERIVRKVVDEVRKMLERLPRGDELRRIAKRVEDLAEELKRLLDKSRETSERLVDELRKLLRESNETSKELVKRLDDRRK

SEQ ID NO: 7807 - protein, 181 aa, Artificial Sequence; identical to SEQ ID NO: 7806
  Synthetic

SEQ ID NO: 7808 - protein, 181 aa, Artificial Sequence
  Synthetic
SEAEKLLKEAKRLADEAKKIIKRAHEENKRAADEAKKIIEEANRENEKLAREAKKLIDAGVPKKEAADIAKKAADEARRSDEEADRIAEEAARRAKETDERAEKIARRAAEEAKEAAKKASRSDEAREIEKRVRELAEELKKLARESNEASKELAKELKELAERSNKTSEDLAKELEDRAR

SEQ ID NO: 7809 - protein, 181 aa, Artificial Sequence; identical to SEQ ID NO: 7808
  Synthetic

SEQ ID NO: 7810 - protein, 181 aa, Artificial Sequence
  Synthetic
SEVERLLEEIKELAKRVKDIIKEVNKENKRLVDEVKDRIRKINEDNNRLVETVKELIRKGVPKEEIADIVRRVVKTAEDSNRKILRIAEEVVRTARESDERVREIVRRVVEEVRELLKRLPPGKELERIEREVERLADELRKLLEESNESTERLAEELERLVRESERDSRRLAEELKRRLD

SEQ ID NO: 7811 - protein, 181 aa, Artificial Sequence; identical to SEQ ID NO: 7810
  Synthetic

SEQ ID NO: 7812 - protein, 181 aa, Artificial Sequence
  Synthetic
SELEKLKEEIKKLADDVKRIIKKVLDENRKLVDDVKKIIKKVTEENRKLVREVAELIKAGVPKKDIERIVREVVKKMEKSDKEVAEIVEEVVRRMRTSDREVKRIVEEVVRRVKEILKEAKPGKELEEIDKDVDRLIEELKRLLEDSNRDTERLAKELKDLLDESNKDSRRLAEELKRRTD

SEQ ID NO: 7813 - protein, 181 aa, Artificial Sequence; identical to SEQ ID NO: 7812
  Synthetic

SEQ ID NO: 7814 - protein, 181 aa, Artificial Sequence
  Synthetic
REVDELRKEIRRLAKEVKDIIKKATERNEELVRRVKEIIKEVNRRNRKAAEEVKELIRAGVPKEDIRRIVERVVREVRRTNDDVRRTVEEVVKDAERTDEELKRIVDDVVRRVRELLKELPRGEDLERIRKEVEELARELEKLLEESNRETKRLARELEKLLEDSRRSTEELAKELEEAER

SEQ ID NO: 7815 - protein, 181 aa, Artificial Sequence; identical to SEQ ID NO: 7814
  Synthetic

SEQ ID NO: 7816 - protein, 173 aa, Artificial Sequence
  Synthetic
REAEEVDKEIKKIVRDVRERIRKLNEDNRRIAEKVKREIEELNKRNRDTAKEIEKRGDKDLVDKVVKDVKKSNEDVKEIVKEVAKRAKESNDEAEKIVRDVVRRAKELLRRLPPGDELREIERDVDRLVEELRKLVEDSRRTTKRLVEELDELVETSDRETEKLVRKLRERER

SEQ ID NO: 7817 - protein, 173 aa, Artificial Sequence; identical to SEQ ID NO: 7816
  Synthetic

SEQ ID NO: 7818 - protein, 173 aa, Artificial Sequence
  Synthetic
SDLERVLREIKKEVDDVKRLIRELNERNRTIVEEVKKLIEKLNRDNERIVREVKKRGDEKLVEEVVRTMKKSNDELRKIVEEVARRAKRSNEELEKIVREVVRRVKELLKEVREGEEVKRIEDEVRKLVRELEELLKRSDDDTERLVEELKELLKRSEKKTRELAKELRDRRR

SEQ ID NO: 7819 - protein, 173 aa, Artificial Sequence; identical to SEQ ID NO: 7818
  Synthetic

SEQ ID NO: 7820 - protein, 173 aa, Artificial Sequence
  Synthetic
SEVDEVLKRIKEEVDRVKEEIKRLNKENNDIVRKVKKEDRDIVETIRKIAEDVKRRGDRDFVREVVKEVRRLLRESREIVKEVVKRMEDSNRRARDIVRRVMERAKKLLEDLPEGDELREIDERVEKLVKELEETLRESEKDTKRLVEELEKSLKETEDDVRRLVKELKDRDD

SEQ ID NO: 7821 - protein, 173 aa, Artificial Sequence; identical to SEQ ID NO: 7820
  Synthetic

SEQ ID NO: 7822 - protein, 173 aa, Artificial Sequence
  Synthetic
SKLEEVLRDIRRIVEEVKDEDRRIVEEIRKIAKDVKEKIKELNRENNRIVREVKERGDEDMVRKVAEDAKKSNEDVKRIVDKVVEDVKRLLERSRKIVDDVVKRAKELLERLDPGDELRRIDEEVEKLVKELEKSVEDTKREVDRLAKELEDLVRDSKRDTDRLVKELKDRTD

SEQ ID NO: 7823 - protein, 173 aa, Artificial Sequence; identical to SEQ ID NO: 7822
  Synthetic

SEQ ID NO: 7824 - protein, 174 aa, Artificial Sequence
  Synthetic
REVEEAADDLRRLIEENERSVRESKRTLEELIKENEDSVRRSEKSLRDLIRELEEEGVRERVVEELKRIVEKIVRDSRKSVDELRRIVEEVVKESKKSVEELERIVREVIRLLEEGAPVEELLKRVRDVSEESKRLDRKLNEDVKEVSKDSKRRDRELNERVRKVAEDVKETER

SEQ ID NO: 7825 - protein, 174 aa, Artificial Sequence; identical to SEQ ID NO: 7824
  Synthetic

SEQ ID NO: 7826 - protein, 174 aa, Artificial Sequence
  Synthetic
SEVEEAAERAKRLIDKLKESADRSEKTARDLIRDLNRSTEEIAREARKLIEELKKAGADSKAVKEAAEIAKRAIDAARKSDEDAARIAKRAAEASREAVKRAAEIAERAIRAAEKGADVKKALEEVRRAAEEAEKADRKLNKEVKEAADRARELNKKLADEVRKAAKEAKEKAD

SEQ ID NO: 7827 - protein, 174 aa, Artificial Sequence; identical to SEQ ID NO: 7826
  Synthetic

SEQ ID NO: 7828 - protein, 174 aa, Artificial Sequence
  Synthetic
SEVEEAAKEAKRLIEELNRSTEKIARDAKKLIEELRKSAKESADSARKLIEELKKRGAEEEAVKRAADIAKEAIDRSRKLVKEAEEIAREAIKKAERTDEEAARIAKRAIEAAEEGADVKKALEDVKRAADKAKEDNKKLLKEVEDAAREAKRADRELNKRVKEAADKAKEEAN

SEQ ID NO: 7829 - protein, 174 aa, Artificial Sequence; identical to SEQ ID NO: 7828
  Synthetic

SEQ ID NO: 7830 - protein, 185 aa, Artificial Sequence
  Synthetic
DELEEVRERIERLIRRSEELNKKVEKENKELVDRSREINRRVLDEIRRLIREVERILEEEGGETERVDRMVKEVVKRIEKLLKESKDVTEKIARDMRDTDRKSKEATDRVVTEIKRLLEEISRTVREEEVRKLEEEVRELIKKLERSNRELNKETEKLVEDLKRSNKELEEDVERLARKLEEELR

SEQ ID NO: 7831 - protein, 185 aa, Artificial Sequence; identical to SEQ ID NO: 7830
  Synthetic

SEQ ID NO: 7832 - protein, 185 aa, Artificial Sequence
  Synthetic
KELEEVEKRIEELARRVEERIKKVIEDNRRLVEESEKINEEVRREVKRLIDEVKEIIRRKGGETEEVRRVVEKVVKEIRDLLKRSRDVTREIVERMRRTDERLREEVERVVEDMRRLLEEIRRTVEEREVRRLEERVEELARRLEELLKESNTRSEKLARDLEKSNEDLEREVEELAKRLEEELK

SEQ ID NO: 7833 - protein, 185 aa, Artificial Sequence; identical to SEQ ID NO: 7832
  Synthetic

SEQ ID NO: 7834 - protein, 185 aa, Artificial Sequence
  Synthetic
DSVREVAERIDRLVKESERINREVIETNRRLFKESEKINDKVRKEIEDLIRRVKEIIDRDGGETEEVRKLVEDVVKRLEELVRESKRVTDEIVRRMEKTDEESKRVTDEVVKTAKDLLEELRKTVREEDLRRLKKKVDDLARKLEESNRRSNEDSKRLARELEESNKDLKRRVDELARELEERLK

SEQ ID NO: 7835 - protein, 185 aa, Artificial Sequence; identical to SEQ ID NO: 7834
  Synthetic

SEQ ID NO: 7836 - protein, 185 aa, Artificial Sequence
  Synthetic
DELKEVEERIERLIRESKRVNEEVKETNRRLVRESKEINKRVHDTVRRLVEEVRRIIDERGGETEDVKRVVEEVVRRARELSRRSDEVTKDIARKMRDTDRESEEITRRVVEELRRLVEEIRKRVDEKEVRRLREEVEKLAKELKRSNDESNKESERLVEDLKRSNTENSKAVEDLARELKERLK

SEQ ID NO: 7837 - protein, 185 aa, Artificial Sequence; identical to SEQ ID NO: 7836
  Synthetic

SEQ ID NO: 7838 - protein, 183 aa, Artificial Sequence
  Synthetic
RSVEELKKKVEDLVRKLEELVKDSKRESKELVDDSERLVKELEDDVRRLVRELRERVRRRRGEELEKIVDEVVRRAERLLEEVKKSSKKVADELERTNREVEEIVRKVVEDARKLLEELKRVDDERIIKRIEEEIEELIRRVEEIIRKVIKENRELVERDREIIKTVLERIRELIKEVTDRIE

SEQ ID NO: 7839 - protein, 183 aa, Artificial Sequence; identical to SEQ ID NO: 7838
  Synthetic

SEQ ID NO: 7840 - protein, 183 aa, Artificial Sequence
  Synthetic
SEVEKLEEEVERLVRDSERLNKRLEDRVKKLVEDSERLVRELEKTVRDLVKKLKDDVRRRPGEDLDKIVRKVVREAEELLKEVKKSSEDVADTLRRLLEESKKSSKRVAEEARRLLEELKRVDDERIIRRIRKEIKDLFDDDKRISEEVERRIERLFKEDKKIIEDVEREIRRLIKEVEDRIR

SEQ ID NO: 7841 - protein, 183 aa, Artificial Sequence; identical to SEQ ID NO: 7840
  Synthetic

SEQ ID NO: 7842 - protein, 183 aa, Artificial Sequence
  Synthetic
DDVERLERRVRELIKESEKLVDDLRKDVERLVKKSRDLNERLREDVERLVKELEDRVRKRRGEELEKIVKDVVDRARELLERSRRSSKEVAERLKELLERLKKSSEDVAREMERLLEELKRVDRKEIIDKVRKEIEDLVRKDKEIIDEIRKEIRRLVEEDEEISRRVEETIRRLIREVAERIR

SEQ ID NO: 7843 - protein, 183 aa, Artificial Sequence; identical to SEQ ID NO: 7842
  Synthetic

SEQ ID NO: 7844 - protein, 182 aa, Artificial Sequence
  Synthetic
SEVDELRKRVEELVRRSRKLVEEHRRKVRELVEESRRLVEELRRDVERLVKKLRDELREVREVVKRVEEELEKLVREVKRSVEESKRRLEDLDRRLRETTKEAEDLLRELLKRVEDLKDDERARDLIEEVRERADRVAKKDEDVIRKSEEDTERVVREDKKIIDRVRKDVEEVIRRVEEETR

SEQ ID NO: 7845 - protein, 182 aa, Artificial Sequence; identical to SEQ ID NO: 7844
  Synthetic

SEQ ID NO: 7846 - protein, 184 aa, Artificial Sequence
  Synthetic
STLERLTEDVKRVIREVEEVIKKLKEEVDKSLEDVRRKIEESRKETKRVIDEVKRRIKDKRKDKEVLKELVDRVVRVLEEANRTLEKVVKEHEDSLERVDRTLKKVVDDARKKLERVIERLRDENVSRVEELAKRLEELIRRLEELVDRLRKELKESIEEIRKRVRDHKEESKRLIRELDEEVK

SEQ ID NO: 7847 - protein, 184 aa, Artificial Sequence; identical to SEQ ID NO: 7846
  Synthetic

SEQ ID NO: 7848 - protein, 184 aa, Artificial Sequence
  Synthetic
STLERLDEDVKRVAREDTELIKESEERTKKSADDVRKKIEDSRRTTDKVVTDVEDIIEKKREDKRVLKEVVDELRRRLEELNRRLREVVEEHKDSLRKANRDLEESSRRSEERLRRVIETLRRNNVSRVEELAEKLKELLKDSERRVDEHRRKSEESTREIEELVKRHEDRSRELIKRLDEEVR

SEQ ID NO: 7849 - protein, 184 aa, Artificial Sequence; identical to SEQ ID NO: 7848
  Synthetic

SEQ ID NO: 7850 - protein, 184 aa, Artificial Sequence
  Synthetic
SLLEKLRRRVDEVIKRDDELIEESKRRTDEALKRVEERIRKSLEETKEAVDRVRDIIRRVRDQKEVLAKVVKELERIARELNRRLKEVVEELRRILEKLNRDLKKSSEDSKRELDRVIEALERGNVSRVDELRERLRKLLEDSEEKVKRHKDESDKLIKDIEDKVKRHEDESRRLIRELREELK

SEQ ID NO: 7851 - protein, 184 aa, Artificial Sequence; identical to SEQ ID NO: 7850
  Synthetic

SEQ ID NO: 7852 - protein, 176 aa, Artificial Sequence
  Synthetic
SEADELRKKLEETNKDIKRRVEELKRRLEESNERIEELVRRNEKKSKDLLDDVRRRGVDEKVLKKIEEVVDRNRKLLKEALDVNKKVVDEIEDRLRRVLDKNRKVVEEVERELRDSSEEVLKRLDKKLEDSRRDVERVEKEVEELLRESEERVKRVVETVDKTDEEVKKDVDDKRR

SEQ ID NO: 7853 - protein, 176 aa, Artificial Sequence; identical to SEQ ID NO: 7852
  Synthetic

SEQ ID NO: 7854 - protein, 176 aa, Artificial Sequence
  Synthetic
SEAEDLEKKAEDTNREIKKIAEELKKHAEDTNREIEKKVEDLRREAERILREVARKGVDEDVLRAIEEVIKTIEDLARKVLEDNRKVVEDVERLVEEVLKRNAKVVDEVREKARDSSEEVLERLERKLRESKREVDRLAEKIKKLNDDSRKRVDEVVERVRRLLEDVKRKVDEARR

SEQ ID NO: 7855 - protein, 176 aa, Artificial Sequence; identical to SEQ ID NO: 7854
  Synthetic

SEQ ID NO: 7856 - protein, 178 aa, Artificial Sequence
  Synthetic
DEVERLEEDVERSIRDSEKVVRDSERRVRESNEEIRRLIEESDKDVKRLIDEATKKSGESADLLRELREVVERVKRLNEKLLKENREASEEVRKINEDLVREDRRVVKEVKETVRRVDKREVIRELKERLKEISDRLKKRSEKSVRDLDDISRKIVRRSEDTVRKLREIARRLDERTK

SEQ ID NO: 7857 - protein, 178 aa, Artificial Sequence; identical to SEQ ID NO: 7856
  Synthetic

SEQ ID NO: 7858 - protein, 178 aa, Artificial Sequence
  Synthetic
REKDELEEAVRRSNKRLKDILEKSRKDVEESIKRSEELLKRSDDEARKLIEEMTRKSGEEADVLRTLREVARRAKELNKKLLEDDREVIRRVEEINRELLERNTRVSDRVREIVERTTDRKVIEDVLRELKKITDEIEKESRRSLDELRRISKELEDDSRRTLEELKKIVKELKDRET

SEQ ID NO: 7859 - protein, 178 aa, Artificial Sequence; identical to SEQ ID NO: 7858
  Synthetic

SEQ ID NO: 7860 - protein, 178 aa, Artificial Sequence
  Synthetic
DEDRRLEEEVRKSIEESERVIERSEEEVRRLIEEARTLLEDSRRKVEDLLREMTRRAGDKADLLKELKRVIEEVKRLNEKLLKELEDVIERVIRINKRLLDEDRRVVERVIRIVRRTTDREVIEKVLRELREISERLKRESERSLRELEEIARDLLRRSRRTVEELRRIAEELVKRAK

SEQ ID NO: 7861 - protein, 178 aa, Artificial Sequence; identical to SEQ ID NO: 7860
  Synthetic

SEQ ID NO: 7862 - protein, 187 aa, Artificial Sequence
  Synthetic
DELEEVLERIEREIRRVSERSEELSRRNEKIIREVEEESRRILEEIKREIDEVKKRAERVDKDTLRRIVETVVRRAKELVDRSKKITTKVVEELKRSMEESRKISEEVARRAKKLVDELRDRLRSEEAKKLVREVEETVRKLVEELREMNKRHEDKNRELSDRLREIDKRLEDEVRKLVEELRKKVE

SEQ ID NO: 7863 - protein, 187 aa, Artificial Sequence; identical to SEQ ID NO: 7862
  Synthetic

SEQ ID NO: 7864 - protein, 187 aa, Artificial Sequence
  Synthetic
DELEEVEKEMERIIREVERKLREVNERIKEIIERVIRESKEILDELKRIIDEVKKRAERVRKDELKRDAERVVKRLKDLVDRSRRITEKVVREAEKLNEDLHRDLERVVRTLKKLLDDLRRRLDSEDAERLVRELRKKVEELKRRLEELNRDDKRTIDELVKTLDKIDRELRKTVEDLVRDLERDVK

SEQ ID NO: 7865 - protein, 187 aa, Artificial Sequence; identical to SEQ ID NO: 7864
  Synthetic

SEQ ID NO: 7866 - protein, 173 aa, Artificial Sequence
  Synthetic
SKVDEVLKDVRRISEESERRIRELNDRSRKISKESEDRIRELLRRLEEIVERLKRTNDRDAVRKVVEVLRRVLEEVRRSVDEVRRLLEESLKEIERSVREVEKRAKTVLEEVKDDEKAEELRKEVERLIRENEELVERHRKTVEELRRRNEELVKRLEDTVRKLEKELKEEAD

SEQ ID NO: 7867 - protein, 173 aa, Artificial Sequence; identical to SEQ ID NO: 7866
  Synthetic

SEQ ID NO: 7868 - protein, 173 aa, Artificial Sequence
  Synthetic
SELDRAADRLRKISKRSEEEIRKLNEEVKKISKESEEKIRRLNEEVKRIVEEVKRRNDERVVKEVERRLERSLEEVEKSVREVKEVLERSLRKVEDSVRKVEDVLRKVLEEVKSDEKAKELAEIVEKLIRDNRRLVEEHEESVRRLEDRNRKLVEDHERTVRKLIKELRETRR

SEQ ID NO: 7869 - protein, 173 aa, Artificial Sequence; identical to SEQ ID NO: 7868
  Synthetic

SEQ ID NO: 7870 - protein, 173 aa, Artificial Sequence
  Synthetic
SELEKLLRDLEEIARKVEEEIRTLNEDVKRISKESKERIDRLKEELKKIVDDLKKRRIKEAVDEVKKRLEEVLREVEESVERVEREAKRSLEEIERIVRRLEKDVKKVLEEVKSDERAEDLRREVERLIRELRKLVREHERSVRKLIEENRRIVRELEELVKKLRKELEDTLR

SEQ ID NO: 7871 - protein, 173 aa, Artificial Sequence; identical to SEQ ID NO: 7870
  Synthetic

SEQ ID NO: 7872 - protein, 173 aa, Artificial Sequence
  Synthetic
SELEEAERRLREIVRKVEEDSRKLNEELKREVDEVRRRSEELNKRVRDEAERVRKENKRELVRKLEDEVRRSVEESKKISEDLKRRLEESVKESERISEELRKRLREVLEEVKKDEKAEDLARIVKKLVEDLKRLNKRHKESVDELVRRLEELDREHERTIRRMIEELRETER

SEQ ID NO: 7873 - protein, 173 aa, Artificial Sequence; identical to SEQ ID NO: 7872
  Synthetic

SEQ ID NO: 7874 - protein, 179 aa, Artificial Sequence
  Synthetic
KEVEKLLEDLKEVARRVSEEIKRLLKELKEVSKRSEDRIRTSLERVKKVVEDVLREADEFRSDKERLREVVERLEEILDRANKEVRDSVKDLEKILRDVVKEVEKLVKDLEEIVRKIIEDVKDVRELKEEIEKLLRRLRKLVKELKEEIKKIVDRNRKLVREHEARSEELKEEIRREVE

SEQ ID NO: 7875 - protein, 179 aa, Artificial Sequence; identical to SEQ ID NO: 7874
  Synthetic

SEQ ID NO: 7876 - protein, 179 aa, Artificial Sequence
  Synthetic
SEKEELLKRVAEVSKKSKDRARELNERLKKVVDEVLETIRKLNEDLKRVVERVKEKIKDKKDDKRVVKELVDKLERILERSIEETERLLRELKKILEESNRELEKSVEELKRIADRIIEAVDKVKELRKEAKRNVDENREVVKENKRTTEKLLRDLDRILKENKRTVEKLVRELREEVR

SEQ ID NO: 7877 - protein, 179 aa, Artificial Sequence; identical to SEQ ID NO: 7876
  Synthetic

SEQ ID NO: 7878 - protein, 179 aa, Artificial Sequence
  Synthetic
DEKERLLEDVKRASEDSERRIRELNDRVRRVSEESERRIRKLNKELRDEVEKVLREIDRIRKDKDVLRDLVRRLEEKLRRSNEEVRKSVEELERILRESNERVRKSVKELKERAERVIEAVDKVDELREEIEKNLRRNEELVKKNKKDSEDNKRDNDRLVKENEKTTEDLLRRAKEEVD

SEQ ID NO: 7879 - protein, 179 aa, Artificial Sequence; identical to SEQ ID NO: 7878
  Synthetic

SEQ ID NO: 7880 - protein, 178 aa, Artificial Sequence
  Synthetic
DETETVEKKLRDVLERVKKDSEDSREELKRVHKRSEELSRRSNKELDDVLDEVRRIIERSTDKREVEKVVRELREVAKRIKDKNRKSLKESEDVVRRVTERNAKAVKELEDVLRRAIEEVKDVEELKKRLDEMRKTIEKLLEDTKEELRELIERNKKLLDDTARRAEEIIKEIEDRSK

SEQ ID NO: 7881 - protein, 178 aa, Artificial Sequence; identical to SEQ ID NO: 7880
  Synthetic

SEQ ID NO: 7882 - protein, 178 aa, Artificial Sequence
  Synthetic
SREEKVLEDLDRVLKRVTDLSKESLDEVERVHEESERLIRDSNRVLRDVLEKVREIITKSTDKSTVKKVVEDLKRVLDEVKKKNEESLRRSEEVVRRVIEKNRKAVEELRKVVEEAIRRVKDVKELKDRAREVIRRIEKLVEDTERALRDLIRKNEELLKRTEEELKRAEEDIRRKSK

SEQ ID NO: 7883 - protein, 178 aa, Artificial Sequence; identical to SEQ ID NO: 7882
  Synthetic

SEQ ID NO: 7884 - protein, 186 aa, Artificial Sequence
  Synthetic
SDAERVLREIERLLEELKELVERVVRKSEELLRRAKRVNEEVNREIKKLADELEEVIRRKGGESEEVERTLREVTKEIRRLVRESEKLAEDIVRTSDKLVEDLREMLERVVREARKLVEDVERRGVPKEVVDTLRRVVEEITRELEELLERLRRVSEEIRRTLEELLERTRRLVEEIERKLREALK

SEQ ID NO: 7885 - protein, 186 aa, Artificial Sequence; identical to SEQ ID NO: 7884
  Synthetic

SEQ ID NO: 7886 - protein, 186 aa, Artificial Sequence
  Synthetic
SELDDVRRKIKRLIDELKRVNEKVNKDSEDLVREVERVNRDVNRRVKELLEELKRVIDERGGETEEVRRILKKVVEEARRLVEKSEDLARKVVKRSNELVKESKDLAKEVVERIRRLVEKVERDGVPEEMVERLRREVEKLERELRELLRRTEENSRRAKERLEDLLRRTRELVKRIEERLREELR

SEQ ID NO: 7887 - protein, 186 aa, Artificial Sequence; identical to SEQ ID NO: 7886
  Synthetic

SEQ ID NO: 7888 - protein, 183 aa, Artificial Sequence
  Synthetic
SDVERLKKRVDELAERLKRLDEELKKEVDRIETELRELLKRHEDRNRDISRRLAELLKDARERELEEIVREVVERSERTLREVEEIVRRVVEDARRLVRDSERISKEVEERMKRLVEEVKDVDKKEIVERILEELDRLMEKVERVSREILKTIEKLARDIKKRIEEVTRESERLAREVEEALR

SEQ ID NO: 7889 - protein, 183 aa, Artificial Sequence; identical to SEQ ID NO: 7888
  Synthetic

SEQ ID NO: 7890 - protein, 183 aa, Artificial Sequence
  Synthetic
DEVETLEKRVRELERRLEELNKELREEVRKIVERAKELDKRHKDDNERIEKELRELLRDVRDERLKEIVRKVSDESRKTLEDSRRISDRVKKELDKLVRTSEEISKRVADRMRELVDRIRRVDKDEIAKRILDEIDRLMEEAEKVTRDILRKVEELLRRVEDASRRVTKKSRELLKKVKEDLR

SEQ ID NO: 7891 - protein, 183 aa, Artificial Sequence; identical to SEQ ID NO: 7890
  Synthetic

SEQ ID NO: 7892 - protein, 183 aa, Artificial Sequence
  Synthetic
SEVETLEKAVRDIVERLKDLNRRLEKEVRDAVKRLRDLLREHEKRNREIAKDLTDKLRKATREELKRIVERVVEASKETLEEVDEIVRRVVREAKRLVDESERISREVVKRLEDLVREAKDVDRKEAATDILRKAEELADEVRRATEEIAKEIRRLVKEVEEVIKDVTRKSDELLKRVADAAK

SEQ ID NO: 7893 - protein, 183 aa, Artificial Sequence; identical to SEQ ID NO: 7892
  Synthetic

SEQ ID NO: 7894 - protein, 187 aa, Artificial Sequence
  Synthetic
DELETLADVVRKLIERSRDLLRRHEKRNDEIKKRLDELDRELKERAEEIKKRLEELLRRRDEDEIREVIRELEERLEKLLEDSRRVSKEVAERLDRTVKDVRKTIEESEKLLRELLEEVERKKDDERAEDVVRDVLRKAEKVVEEDERLIRRVTEESDRVLDRVEKETKKIVDEAKRMLREVEERIR

SEQ ID NO: 7895 - protein, 187 aa, Artificial Sequence; identical to SEQ ID NO: 7894
  Synthetic

SEQ ID NO: 7896 - protein, 187 aa, Artificial Sequence
  Synthetic
SLIDELRERVKEIKKRSEELLKRHEDENRRIVKRSRELLKKLRDVVRDIIRELRKELEDDKKEEIERVIRELKKRLEELVKEVERSSKELEKTLKRTLEEVRKTSKEVEETLKRLLKEVDDKKKDERAEEVVRRVLKEAEDLLRKDEKILRDVTRRSEKALREDEELAKRVLDEMRKVLEDVKRKSK

SEQ ID NO: 7897 - protein, 187 aa, Artificial Sequence; identical to SEQ ID NO: 7896
  Synthetic

SEQ ID NO: 7898 - protein, 187 aa, Artificial Sequence
  Synthetic
EELERLAESVRRIKERLKKLDREHEERNKRIVETSRKLLEELEREVRKIEEDLKRLLDERKDDEIRRVVEEVVRRARELVERIDRSSREVEKKLRETVKESRRVTEEVARRADKLLEDLERKKDDERAEEVVRDILRRLEELMRRAEEVTKKLTDDSRRLLKEDEDLVREIEERLRRLLKEVKERVD

SEQ ID NO: 7899 - protein, 187 aa, Artificial Sequence; identical to SEQ ID NO: 7898
  Synthetic

SEQ ID NO: 7900 - protein, 179 aa, Artificial Sequence
  Synthetic
DEDRDVKREVKKVHEDSARTVEKLDREVEKVHEESERTVRKSEKEAKEVLDRVKDIVKKKKDDKKVLKEVVEKLKRDLEELNKELRRSVKELKERLDKVKKDIRDSVRRLDEALKRVVKDNDKVEELKEDLKRILKENEDLVRELEKKLDDIMRENEELVREHEEKSKRIVRELEEEVR

SEQ ID NO: 7901 - protein, 179 aa, Artificial Sequence; identical to SEQ ID NO: 7900
  Synthetic

SEQ ID NO: 7902 - protein, 179 aa, Artificial Sequence
  Synthetic
EEKERADRKLEEVHKESKKTVEDSDEALERVHRESKRTVEESRKTLEDVVREVKRIVEEKREDKDVLRKVLEDLKEIVERLNRELEKSVEKLERVLEKLNRELEESVRRLKELLERVIRENSDVKELRRKVEEILKRNEEEVRKHKEKSKKIVEDNRRLVKRHKEESEEVVRDAAREVK

SEQ ID NO: 7903 - protein, 179 aa, Artificial Sequence; identical to SEQ ID NO: 7902
  Synthetic

SEQ ID NO: 7904 - protein, 179 aa, Artificial Sequence
  Synthetic
DEDREALKEVEDVHRRSEEKVRESRRRAEEVHKESKKIVDELRRRSEESLKRVEDEVRKKRSDKDTLRDLVRRHRDSNRKIIETIRRSVKEVKKLLKELDEELEKSVRELEKTLKRVVDDNDKVEELKDELRKIVETNRELVRRHHETVKKIMEENERLVRELEKRLEEADRKLEEEVR

SEQ ID NO: 7905 - protein, 179 aa, Artificial Sequence; identical to SEQ ID NO: 7904
  Synthetic

SEQ ID NO: 7906 - protein, 184 aa, Artificial Sequence
  Synthetic
SLEEEVRRIVDDIRRTNKELLDRSARRAEEIERRLEELLRRSRERADRIREEMRRMLEKAGDSERVRKLVEDVEKVLKEDIRTNEELLRRVRKVLEEDIKINEDLLRESEEVLKKVIEDVARTTDKKTVDDVLKRLKEENDRSREEIKRSNEESDRVLDEVRKRSEDSNRRLDKIVDEAKKELK

SEQ ID NO: 7907 - protein, 184 aa, Artificial Sequence; identical to SEQ ID NO: 7906
  Synthetic

SEQ ID NO: 7908 - protein, 177 aa, Artificial Sequence
  Synthetic
DELEEVLERLREIAERVIKESKEINDELKRSSERSKRESDKVNKRMREIMKELKDRGDKEVVDRVIKELEELVRRTEEILDRDNKELERLVRRSEEIARRVIEELKKLVEDVERGGIDEEDVRRIRKLVEDIARRLKEIIERNRESVRKSREENKKSIEENRRSVKKIADEAREDAR

SEQ ID NO: 7909 - protein, 177 aa, Artificial Sequence; identical to SEQ ID NO: 7908
  Synthetic

SEQ ID NO: 7910 - protein, 169 aa, Artificial Sequence
  Synthetic
EETERLIEAVKRIAEEVRKTIERLMERVEKTTRESEELNRRLNRELDREVEEVERANKEEAVKRLKEILERVLEESKRIVEEDNEEAKRVVEEVERIVRELKKFAKKVVDDRRSEELEKVVREVAERLDRLLKALRDLVEESARRNKRLIEETDRRIKEIAERLKRTSD

SEQ ID NO: 7911 - protein, 169 aa, Artificial Sequence; identical to SEQ ID NO: 7910
  Synthetic

SEQ ID NO: 7912 - protein, 184 aa, Artificial Sequence
  Synthetic
SEAERLLEELERSTRESAKRIRDLADKLRRSSEESVKDIERLTKELEEAVRRVLDKIRKKKSDKDEVRRLVKELTDILRESHKRVKESIDRDREILEEVIRRVKESIKEDKRRLDDVLAKLRKAPEEVVRRLAKVVEESRRTNEKLLRDLEKLVEDSKRRNDELLEKNARRIKEVEDELKRETK

SEQ ID NO: 7913 - protein, 184 aa, Artificial Sequence; identical to SEQ ID NO: 7912
  Synthetic

SEQ ID NO: 7914 - protein, 184 aa, Artificial Sequence
  Synthetic
KDAEDLLRRLRESTKRSEDLVRKLLEELERSSRESEKLIRELTDRLDKVVKDVERRIREKREDKEAVERLVRTLREILERSHRDVERSIREDRKIVEKVIEDAERLVREDKEELRRVLEEIRRVPEEVVKRLEKAVKESEDRNKELLDRLRKRVEDSKRRNDKLLKENRKRIEEIKRRLDELLR

SEQ ID NO: 7915 - protein, 184 aa, Artificial Sequence; identical to SEQ ID NO: 7914
  Synthetic

SEQ ID NO: 7916 - protein, 184 aa, Artificial Sequence
  Synthetic
SKAEKLLRDLEKSTEDSERRIRELLERLRESSRTSEELAKRLEEEVERATREVADKIRKKREDEKTVRELVEELRKILEEVIKDAKRLVEEDKRILEEVIRAVERSIKEDRDILEKVLEDIREVPKEVVDRLREIVERSREKNRKLLEDLRRAVEESKKRNEEVLRKLKKKVEEIEEELKERLR

SEQ ID NO: 7917 - protein, 184 aa, Artificial Sequence; identical to SEQ ID NO: 7916
  Synthetic

SEQ ID NO: 7918 - protein, 184 aa, Artificial Sequence
  Synthetic
SEIEELLKTLKRSTEKSEEDARRLLEELTRSSEESVKRLRDLTERLKEVAKEVIERIRRRKEEKETVEELIKELEKRLRDSHEEVRRLIEEDRKELDRVIEAVDRSVKRDKRILEEVLKEVRRADKKVVDRLKRMVDESRKRNEELLKRLEKRVRESRKRNDELLEENKRVIDKIREELERLRK

SEQ ID NO: 7919 - protein, 184 aa, Artificial Sequence; identical to SEQ ID NO: 7918
  Synthetic

SEQ ID NO: 7920 - protein, 188 aa, Artificial Sequence
  Synthetic
SLLEEIEELVRRAIDTVRRSSEELKRLVDRVNETNKRSTEELRELAERVDRRLDKLLKEIKEGKMVDKLRKLIETIRRVAEEVIRLSEEADRRDSELAKRVLDESRKLLREIERVAEEVRRVVTENDKSRELVEKLKRELRRILEEVRRLNEELMKEIRDTNRKSEKLNRDLKEEIKKILEDVEREVR

SEQ ID NO: 7921 - protein, 188 aa, Artificial Sequence; identical to SEQ ID NO: 7920
  Synthetic

SEQ ID NO: 7922 - protein, 183 aa, Artificial Sequence
  Synthetic
DEAEKLKERLKRVLRRVREINRKLLDELRKSNEKVRRINKRLKEELKRVLDEVEKRVREDKNKSRVKEVLKELEEVLRTVDEMSKRSLKENERSLKEVIKRSEKSLKELEDVLRKVEKDVESIDEKLVREIEEMVRRLKEEAEKLSEEIRKIVRESRETLKKLSDEVRRLVERAEEKARKDTK

SEQ ID NO: 7923 - protein, 183 aa, Artificial Sequence; identical to SEQ ID NO: 7922
  Synthetic

SEQ ID NO: 7924 - protein, 178 aa, Artificial Sequence
  Synthetic
KEDDDLRREIERLLRELEKMNRKVLEDARRLLEELRRVNKEVAERIKDLERRLKDVVEKKGGKTEEVERILRTVLKEIRDLVRRVAEENKRAVKEIEDLVRRVEELNKEVVRRIEDLVRKRLDERVKEEVDEIRDRLRKSNETLREIVRRIEEDLRKSDRELEELVERIEKRLRELVR

SEQ ID NO: 7925 - protein, 178 aa, Artificial Sequence; identical to SEQ ID NO: 7924
  Synthetic

SEQ ID NO: 7926 - protein, 188 aa, Artificial Sequence
  Synthetic
KLVEEVKRLIEESARKNEELIKEVEKEIRRSRKRDKELIEEIERLIREVKKRLEELLTEKKDDDRVREVVRRLEERLKRLLEEVEEVARRNNEILERLLKEVEDVVRTNRERMKELLEEVKTKKDREEAEELVRRVKEEIKRSTTESEKLVKEVKDRARKSHEDSERLAREVLKEIRRLLEEVEKDVR

SEQ ID NO: 7927 - protein, 188 aa, Artificial Sequence; identical to SEQ ID NO: 7926
  Synthetic

SEQ ID NO: 7928 - protein, 178 aa, Artificial Sequence
  Synthetic
KEVEDVKELIKKVNEEIKKIHERSNEEIKRVNEELRKIIKKVKDDLRRVLEEIERLSREGTDEKEARKLLERVERIVRKVKDELKKLNDELDETVKDVARKSKELNDRLREIVKKLVKGEDLLREAEKLVEDSRRSSEELVRRDKKLVKESRETSERLVRDLERLLREIEKRVREEAT

SEQ ID NO: 7929 - protein, 178 aa, Artificial Sequence; identical to SEQ ID NO: 7928
  Synthetic

SEQ ID NO: 7930 - protein, 178 aa, Artificial Sequence
  Synthetic
SEVETVAELIKDVNRRIREEVEEVKRRIEELNDRNRKIAEEVKERIRRVEDEIREARKRGESEERAKRLLEELRKIVKEVMRRVTESNRRLEETVRRVVERLKRLNDTLRDIVRRLVKGDELLTRIDRLVKDSERSSRKLVRELEELVRRSEEETEKLVRELERLVTEVARKVDEEAT

SEQ ID NO: 7931 - protein, 178 aa, Artificial Sequence; identical to SEQ ID NO: 7930
  Synthetic

SEQ ID NO: 7932 - protein, 184 aa, Artificial Sequence
  Synthetic
KDVEEALETLKRILDRVAKDNEDLIRELRDINRKITKENEDLIRDLERILREVEEEVKRRRDEEVLRELVKEVRRVLREILERSKESVKRSEDALREVLKRSRDSVKEVERVLEEIKRILDKSGGDELRRRLEALVEDVRRTLKELIEKTEKVVKEVEDNLRRLLKRTEEVVREVEKKLEEDRR

SEQ ID NO: 7933 - protein, 184 aa, Artificial Sequence; identical to SEQ ID NO: 7932
  Synthetic

SEQ ID NO: 7934 - protein, 184 aa, Artificial Sequence
  Synthetic
SEVEKVLEDLKRILEEIARRNEELNERLERINEEITRRNEKSNEETKRVLDKLADDVRKRKDKEVLEELVKDAERVLREDEKRSRESVERSEEALEEVKKRSEDSVREAKKALDEIRKIVKKRGGEELERTLEKLVDEVRKRLKELLDRSRELVKRVRENLERLEEDTRRLVERVRRELEKLRK

SEQ ID NO: 7935 - protein, 184 aa, Artificial Sequence; identical to SEQ ID NO: 7934
  Synthetic

SEQ ID NO: 7936 - protein, 185 aa, Artificial Sequence
  Synthetic
DEAEKVKRDIEEILKRVAEELKRVLEEIRRSSEEVERRNKEVLETLKRILEEVKERLKRIDKRRAAEELKRVLEEVERLVEELHRINRESIKRTKELLERVKRKLEAVIEEVRRLVEEVVKRRGEEAELVRELRELVRRIEEELRKLTEEARKLLEDNRRRLEELDRELKELVDRIREELERARK

SEQ ID NO: 7937 - protein, 185 aa, Artificial Sequence; identical to SEQ ID NO: 7936
  Synthetic

SEQ ID NO: 7938 - protein, 185 aa, Artificial Sequence
  Synthetic
DEAEKVLEDIKRSSEEVTRRNEKVARDSRKLSEDVEKKNRDVAERIKEIVDKVRRDLSRIDKKEAEKKLREVLKKVEELVKRLHEENRRSLEKSRELVERLHEINRKSEEDIRELVKDVVRKRGREAELVERARELVETNKKRLEDLDRELEELVKENEERLKRLDERLKELVDDIRRRAEEARK

SEQ ID NO: 7939 - protein, 185 aa, Artificial Sequence; identical to SEQ ID NO: 7938
  Synthetic

SEQ ID NO: 7940 - protein, 184 aa, Artificial Sequence
  Synthetic
REAEELLKDLERSSEEVDRRVKESNKESEKVSRDVEKKVKDSNKELREITREVAERAKRTDKDMVREIVERLRRTVEDVLRRNREIVDRSRKRSEDLLRRNRKIARENERLLETVLKKVTDDGIDEKMIKRAAELLKTSEDRLRKLIKESEDSIRENEKKLRELIRESEETLREIRKRLEDLER

SEQ ID NO: 7941 - protein, 184 aa, Artificial Sequence; identical to SEQ ID NO: 7940
  Synthetic

SEQ ID NO: 7942 - protein, 184 aa, Artificial Sequence
  Synthetic
KEAEDLMEELKKSSEDVERRVRESNKRSKEVSDRVAEEVKKLLERLKKILEEAARKRDRVDKEVLTKIAEDVVREVERVLREVEKILRESVRLSEKLMKENEEIVRKNKELLDRVLEEIKRRGVDEKVIRTIERLVRTSEKKLRKLLDDSRKSVEENRKRVTDLKKEARDLVEDIKRRLEEERR

SEQ ID NO: 7943 - protein, 184 aa, Artificial Sequence; identical to SEQ ID NO: 7942
  Synthetic

SEQ ID NO: 7944 - protein, 178 aa, Artificial Sequence
  Synthetic
REEEKVLKDLDDVLKEVTERVREDLRTNEDVVRRAEEEVTRLHEELKRSNDRAKEEVDRKKEDKDVLKKVVEENRRSLERILRRTEEVVERIKKVSEENRRSVEEIVKRLEEVLKEAIRRNDTEEVRKLVRELKEMLKRLEEDARRLVETTKKRLEDLKRTTDKLVKELEKTLEELRR

SEQ ID NO: 7945 - protein, 178 aa, Artificial Sequence; identical to SEQ ID NO: 7944
  Synthetic

SEQ ID NO: 7946 - protein, 178 aa, Artificial Sequence
  Synthetic
SDRERVAKKLRDVLKEVDEEAKKDHDTNKTVVKKVREDIERILRRLKEVLRKVKEEAERKKKDKEVLDRVLKELEKVLRDARRDVRRIIEEAKDVSRKNLDSSRKVVEKLKKVLDEVLEENDVEELRKLVKELRDRLRELEESSRKLVEDTRRDLERLREEIDRLVEELERRLEELRR

SEQ ID NO: 7947 - protein, 178 aa, Artificial Sequence; identical to SEQ ID NO: 7946
  Synthetic

SEQ ID NO: 7948 - protein, 187 aa, Artificial Sequence
  Synthetic
SDAETVLREIRKLNKEVNDASRETLERIEELNRRVERIVREVLKDIERLAREVEEVVRREGGKSDRVVKIAKDVLREVKELVERVVRVLRKVNKDVRRLVEELKRLAKEVNERVRRLVEEVARRLKGKEELIRRLEEIVKESEDNSKENVDRNDRIVRESERSSKELEDELRRIVKKLAREVDELIR

SEQ ID NO: 7949 - protein, 187 aa, Artificial Sequence; identical to SEQ ID NO: 7948
  Synthetic

SEQ ID NO: 7950 - protein, 187 aa, Artificial Sequence
  Synthetic
DDVERVLERIKELNRRVEEIVRRVLKTSRDLNKELNDISREVLKRIKDLMREVEEVVRRDGGESKDVEDILRRVLEEVKRLVDEVERLAREINEESRRLSERVKRTAEEVNKEVKRLVERVVEKLKGKEELIRELERIVEESKRTSDKLAKELDKLNEDSERNSRKNIEDLRRLVEELARKAEELIK

SEQ ID NO: 7951 - protein, 187 aa, Artificial Sequence; identical to SEQ ID NO: 7950
  Synthetic

SEQ ID NO: 7952 - protein, 188 aa, Artificial Sequence
  Synthetic
SLVEELEKLVEENERNMRELDKENRDIVEKNRENVERNERELRKLVERLERRIREVVRTKSDSEELKRIAEEVIRRVRELVKEVKRIAEKSIRDTDRLVKEVSEVNKKSIEDVKRLVDTVRRVTSDERLEEIVREVKERIKRSNDEANKENKRTLDEIRDSNRDVNRVSKEVLDEIRRLLKELEDAAK

SEQ ID NO: 7953 - protein, 188 aa, Artificial Sequence; identical to SEQ ID NO: 7952
  Synthetic

SEQ ID NO: 7954 - protein, 188 aa, Artificial Sequence
  Synthetic
SLIETLEELVDRNRRNLEKLDEENKDMLRKNEEDVEKNERDLRKLVKELRDEIRKLIEEKDKVEDLKRIAEEVIKEVDELVKRVTDILRESIKETERLIREVSKVNEDSIRTVEDLVRRVAEVKDDERLEDIVREVIKRIEESNRRVNKRNRETLERSKKSNKDVNEASERVLRRIKELLDELRERAK

SEQ ID NO: 7955 - protein, 188 aa, Artificial Sequence; identical to SEQ ID NO: 7954
  Synthetic

SEQ ID NO: 7956 - protein, 188 aa, Artificial Sequence
  Synthetic
SLEEELRRLVEELEKRLRELDKRNKDLLRENERNVEKLARDLEELVKKVRRVVEDVVTKKPDSEELKRIAEDVERRVEKLVRDVRRILEESIRDTKRLIDEVSDVNRKVIKEVEELVREVSKVTSDERLEDIVREVLKRVKDLLERAEEENKKTLDDSRKSNEEVNREVEKVIRRIEELVKRLEEAAK

SEQ ID NO: 7957 - protein, 188 aa, Artificial Sequence; identical to SEQ ID NO: 7956
  Synthetic

SEQ ID NO: 7958 - protein, 188 aa, Artificial Sequence
  Synthetic
DLVERLEELLKKIKRELEENIKRNRELLKKLEENLRRNEEKNRKLLEEIRKRLEDLLREKSDVEEVRKVAKEVEDKVRKVLEDSKRVVDTLRELAREHLKHSEDVVRELEERLKELLDEVRRKKDREEAEELVRRVEERMKEMVKRVHEVSEKNLRDIKKWLEDVNRISKETLDRLRELLKEAERRVR

SEQ ID NO: 7959 - protein, 188 aa, Artificial Sequence; identical to SEQ ID NO: 7958
  Synthetic

SEQ ID NO: 7960 - protein, 188 aa, Artificial Sequence
  Synthetic
SLREELEELLKRIKERLKRLIEENRRLLEDLRRNLEENIRRNERTVEELKRDVKRLLDEKSDVDKVREVIKELEKRLEEILRRSREVVEELRRRVEEHLRHSERVVKELEKRVTELLREVERKKDEERAEELVRRVKEEMERAVEEVKKTSEENLKAIKTWLEEVNRISEETLRRMREVLKELREDAK

SEQ ID NO: 7961 - protein, 188 aa, Artificial Sequence; identical to SEQ ID NO: 7960
  Synthetic

SEQ ID NO: 7962 - protein, 188 aa, Artificial Sequence
  Synthetic
RLVEELEKLLKDSHDKDRKLIRENEELLKELKRNLDENIKTNEELVDRIRKRVEDLLREKSDVDEVRKVIEDVERTVRRLVEESKRVVETLRELARRHLEHSRKVARENNERLKRLLEEVRRKKDEERAEDLVRRVEKEARDSSDESRRISEENLKEIKKWLDEVNEISKRTLEDAKRLLEDLERKAT

SEQ ID NO: 7963 - protein, 188 aa, Artificial Sequence; identical to SEQ ID NO: 7962
  Synthetic

SEQ ID NO: 7964 - protein, 184 aa, Artificial Sequence
  Synthetic
DLEEELKTVLDRARKDVKRLKEELERILEEVKRMVEELDKRLEDLDEEVREKVKRLIDEKKDVEEARKKLKEVLEDSRRLSEEAHRINRKVLKDVEKLIRDVERILEEVIRRVEKLIEEVKRITDERDVKRVLREAEELLKRVRDLVEKVLREIKRILEEVEELNRRIIRTSREILKRVEEEVK

SEQ ID NO: 7965 - protein, 184 aa, Artificial Sequence; identical to SEQ ID NO: 7964
  Synthetic

SEQ ID NO: 7966 - protein, 184 aa, Artificial Sequence
  Synthetic
SLEERLDKVRRRVEEEIKRLEDRLEELDRRVAETVKRLDDEARKLDEELRERVKDIIRKKDKVDDARRMLEEVIKRSEELSKKAHDINKRVLDESKRLSDEVRKILEEVRERVRELIERVKRITEEEKVKRVIEEMEEIVKEVRKRVDEVIKTSEEILRRVRELNKEILKESEDLAEEVRKKAT

SEQ ID NO: 7967 - protein, 184 aa, Artificial Sequence; identical to SEQ ID NO: 7966
  Synthetic

SEQ ID NO: 7968 - protein, 184 aa, Artificial Sequence
  Synthetic
KLEDELRKILEENRRIVKELEERMKRLDEAVRKAVEDLARSNEESNKRVKEVVDDLIRKKPDDEDAKRMLERVLRESKRLSDDSKRILERVLEESKRLSERVKRILERSIREAERLVEEVKRIDKEEDVKKVLDDIKESSDRVRREIEEVLKESEERLRRVEKKNEDIDRRSEEILDDVRRKAK

SEQ ID NO: 7969 - protein, 184 aa, Artificial Sequence; identical to SEQ ID NO: 7968
  Synthetic

SEQ ID NO: 7970 - protein, 183 aa, Artificial Sequence
  Synthetic
SLEEKARDVLRRSKELNDENRERAERMLDTNRRIADKLREEVERILREVEETVRRLIDEKKDSKRVRDLLRKLEEDVRKVLEDIERILKKSIEVSRRILEDSDKILKENLDLAREVLERVRRVSEDVVERLLKEVEDSSRRVHKRSEELLRESREISERVRETVKKLLEDVERLLRKVTKEVK

SEQ ID NO: 7971 - protein, 183 aa, Artificial Sequence; identical to SEQ ID NO: 7970
  Synthetic

SEQ ID NO: 7972 - protein, 183 aa, Artificial Sequence
  Synthetic
SLEDELREVLERSREKNERLRREAKKLLDTDRERVREILREAEKVLEEVKRTVEDLVREKDKVDEVRELLKRLEEAVRDVLRRLAELLERSLRVSEEVLRDVERILKENLELVKRVLERVRRVEEKVVEELLKRVEDSSKKVEDDVRRLLKEVEKISTELEELAKELVEEVRRIVKEVADRVK

SEQ ID NO: 7973 - protein, 183 aa, Artificial Sequence; identical to SEQ ID NO: 7972
  Synthetic

SEQ ID NO: 7974 - protein, 183 aa, Artificial Sequence
  Synthetic
SLEERAEKILRDSKRTNEKNEEDVRRLLERNERRVRKIEEEAKKVLEDVRREVERLIREKKDDKRVRDILARVIEEVERVLDEVRKLLEESLEMSERVLRESKKILKENLDLVKKALDDLRRVEEDVVRKLLDEVRESSERVHRKSEELLRRVEEISRTVEREVKKLLDRVRRVLEEAEKEVR

SEQ ID NO: 7975 - protein, 183 aa, Artificial Sequence; identical to SEQ ID NO: 7974
  Synthetic

SEQ ID NO: 7976 - protein, 179 aa, Artificial Sequence
  Synthetic
DESRELVERVERVVRKVEKDHERLDRANKESTDRVREAVRRLDEENREVVRKVEDEVKKVQDKKEVVKELVRDLERLSREVLRRVEELLRRNDEISRRLLEESRRLVKELEKILEDVLRAVPDSKEAERLLDDVRRKLEELVRNAERSLEESRKTNEELEKRVRESLKEVERVLRELEK

SEQ ID NO: 7977 - protein, 179 aa, Artificial Sequence; identical to SEQ ID NO: 7976
  Synthetic

SEQ ID NO: 7978 - protein, 179 aa, Artificial Sequence
  Synthetic
RETEEVIKTLEEVVKEVEERVRRLDEENKESTERVKKTVDDLDEENKRVVREVERRVKEVQDKKEVVTDLVRRLEEISRRVLREVEKLLKRNDEISKEVLERVKELVRRLKKIVKEVLDRAPDSKRMEEVLKRVDERLKELERKVTDSLRRSREVNKRLRDKVEKSLREVEKVLEDLKR

SEQ ID NO: 7979 - protein, 179 aa, Artificial Sequence; identical to SEQ ID NO: 7978
  Synthetic

SEQ ID NO: 7980 - protein, 184 aa, Artificial Sequence
  Synthetic
SLEERLREILKRNKEDVEDIRRRLEEILKRNKEEIDRLREELRRILEEVKREVKELIKRKSTDERLIRIAEDVIRRVKKLVDEVDDIARKSHERVRRLVEEVKRILKESHDTLRRLVRKVREDNDEKTAEEVIERIKKLTEDVRRDVERVIREIEKSSDDLRKVVKDVIDDIKRLLKELREEIN

SEQ ID NO: 7981 - protein, 184 aa, Artificial Sequence; identical to SEQ ID NO: 7980
  Synthetic

SEQ ID NO: 7982 - protein, 184 aa, Artificial Sequence
  Synthetic
SLEERLRKILTENERVIRKLERDLEENLERNKKTVKEIEDRLRKLDEDVERLVRELLRRKSTSKDLKKEVEDVLRKSRKLTREVEEILRRSIKRSAELVKRVRDIVRESHKELRRLVEEVRKDNDKDTAEEVIKEIEELTRRLEEEVRRVNERSDKSNEDVRRRVKEVEDESRDLARRLAERVN

SEQ ID NO: 7983 - protein, 184 aa, Artificial Sequence; identical to SEQ ID NO: 7982
  Synthetic

SEQ ID NO: 7984 - protein, 188 aa, Artificial Sequence
  Synthetic
SLEERLRKILEKVKRTVDESRKRSKRLLEENRETMDRLREEAEEILERVKEKIKELVDRKKDSERVKEVVRRVLEEVERLLEEVERVLRESIKTSEDLLRENEEMLKKLEDRAKKLVDEVRTKKDREEAEKLVEEVIRDLDRVADELRELSKRLSDRSRESNERVRRTVKEVIKEIKRVLKELEEKVK

SEQ ID NO: 7985 - protein, 188 aa, Artificial Sequence; identical to SEQ ID NO: 7984
  Synthetic

SEQ ID NO: 7986 - protein, 188 aa, Artificial Sequence
  Synthetic
DLRERMEKLLKEVKDEIDKSEKKSEDNLRTNKKDVDEIRKRLKRILDEVKEELRKLIDEKRDSERVKEVLKRVIETVADLLRRVDEVLRRSIKISKELLEENKKVLEEAKEEVDRLLKEVEDKESDERAEELVDRVAKRIRRVVEDVKRKSEDLNRKSNESNKRVRDLVERVKEEIDKVRDELRKSVK

SEQ ID NO: 7987 - protein, 188 aa, Artificial Sequence; identical to SEQ ID NO: 7986
  Synthetic

SEQ ID NO: 7988 - protein, 181 aa, Artificial Sequence
  Synthetic
SEEERIRELLERVRRRLEESKKKSKDVADEVKETNDESRERSEKLLREVEERLRELLRELDEERVKKLLKELKDRVKELLERDDKVLRENEKSVRDVLRTDEDVVRKLEEKLERVLDVVRKGEKDVEELRKEVEEVVERVRRISERLTEELRRSSERVKRISERLLEDLERVVRDVARRVK

SEQ ID NO: 7989 - protein, 181 aa, Artificial Sequence; identical to SEQ ID NO: 7988
  Synthetic

SEQ ID NO: 7990 - protein, 181 aa, Artificial Sequence
  Synthetic
SEEERIRELLERVDRRLKESEKRSTDVARRVREENKELEKAARKILEDARRELEKLLREIDDEEVRRVLRELEKIVREVLRRVEELLKRNEESVERVLREDKKVADDLRRELKKVLDVVRRGEKDVEELIKRVEDMVREVEKTSRKLIEELKRSSDEVRKMVEELLRRLERVLEEVKKRVK

SEQ ID NO: 7991 - protein, 181 aa, Artificial Sequence; identical to SEQ ID NO: 7990
  Synthetic

SEQ ID NO: 7992 - protein, 181 aa, Artificial Sequence
  Synthetic
KDEETVTKLLEDVERKNRESEKDSRKIVEDVKDENRKLEDEARKSLEDSERKLERLERDVDEERVRTVVRDLERISEEILRKIKEVVERNRKSLEDVLKKDKEVADRNRKTLKDVVELLKRGEVDVRELAKRLRESTERVEEISRRLIKELEDSSDKVRKVVEDLLRENKEAVRRVAEEAT

SEQ ID NO: 7993 - protein, 181 aa, Artificial Sequence; identical to SEQ ID NO: 7992
  Synthetic

SEQ ID NO: 7994 - protein, 186 aa, Artificial Sequence
  Synthetic
SELEKVEEDIRRLVERVKKIAEDVERLTRELVKEVRKSTEDSVRDIERLMKELREIARDVSDKEELIRRLEEVVKRVEESVRRDVDLLKRVVERSEDISRELRKEAEEVVKTVRRIVEELIRRRDKDKDAKKRLEDLLDTLRKIVEDVSRRLKELNDRLRKLVEDSKRRNEELLRRLREIVKEIAK

SEQ ID NO: 7995 - protein, 186 aa, Artificial Sequence; identical to SEQ ID NO: 7994
  Synthetic

SEQ ID NO: 7996 - protein, 186 aa, Artificial Sequence
  Synthetic
DSDKEVEKRIRELMKEVKDSTKESEDKIRESNERVKESSKRSEDEIRKLMEELDEIAKRVKDKKDLEELLRRVEETVKKLVDDDKETLRKVLEENRKSVEDDDRRLREVVERVERIVRELIRERDKDEDATRRLKKLLDDLKKEVDDSRRRNDELIKETERLIRESAKRNDKLLEDLKKRVDEIRK

SEQ ID NO: 7997 - protein, 186 aa, Artificial Sequence; identical to SEQ ID NO: 7996
  Synthetic

SEQ ID NO: 7998 - protein, 186 aa, Artificial Sequence
  Synthetic
DEREEVEKRIRDLAEEVRRIVKRVEDETRRLVEEVKKSSDDSRRTIEKLARELKEITRRVKDKRTLIEILRRVVEEVEELVRDDVDKLRRVVEESERISRRLEEKLEEVVKRVEEIVRRLIKRRKDDKEAKDRLEDLLRRLREEVKRVKEKLKKLNDDLRREVEKSKEDNERLLKKLRDEVRKSAT

SEQ ID NO: 7999 - protein, 186 aa, Artificial Sequence; identical to SEQ ID NO: 7998
  Synthetic

SEQ ID NO: 8000 - protein, 171 aa, Artificial Sequence
  Synthetic
DEVEKVLREIEKLIKEIREINKRINDRIEELIRRLRERVKKVSRESEELIRDLRRDGKEELVKEVLKRSEDLARRVKEEVKRVLEEVRELVERSVRIAEEVLREVRELVRKKLKDERKAREIIKRVEKVLEEVRRSLETSEKRVRDALREIEERLKENKRRVREVLEEIRK

SEQ ID NO: 8001 - protein, 171 aa, Artificial Sequence; identical to SEQ ID NO: 8000
  Synthetic

SEQ ID NO: 8002 - protein, 179 aa, Artificial Sequence
  Synthetic
DEKEKLIKEVEDSTETVKRLVEELSRRSKKITEDVERLVKKLSDESKKILDEVRDLVRKRGGRAKDVEEILKRVTRISEELVKRVEEILRKSNKVSRDIVKEVREILKEDEDLVRDVVRKLRNSEEADKLRKRSEDMVRRIEEHLKKNLKENKDALDKIRKELRENIETTKKTVDDIRK

SEQ ID NO: 8003 - protein, 179 aa, Artificial Sequence; identical to SEQ ID NO: 8002
  Synthetic

SEQ ID NO: 8004 - protein, 179 aa, Artificial Sequence
  Synthetic
DEKDKLIEELDKILEDVRRRVEELSRRSKEITETVKELVKRLSDESERILREVDDVVRKRGGRAEDVDRILKEVLRFSKRIVEEIERILRESNKVSKEIVDEVRKILEKLERDVEDVVRKLRDSEKAREVRRKVKETVERIEEELRRNIEENREMVERVEREARKNIKDTRKRVEEIRK

SEQ ID NO: 8005 - protein, 179 aa, Artificial Sequence; identical to SEQ ID NO: 8004
  Synthetic

SEQ ID NO: 8006 - protein, 187 aa, Artificial Sequence
  Synthetic
RVEEKLEKIKRDIEKLVEDMKESNTRSKRKLEKLVEEMRRNNEELTRRVEELVKKIEDDVRGKKLEEVKRLAKELREIAERSRKLSEELARELEKSVKDSLDESRRLARELEEVVRDVLRKIRKERENEDLVRRLLEEIRRILEEVRRTDKELLDENERILREVEKLNRDLVKEIEEILKKVEDDVR

SEQ ID NO: 8007 - protein, 187 aa, Artificial Sequence; identical to SEQ ID NO: 8006
  Synthetic

SEQ ID NO: 8008 - protein, 182 aa, Artificial Sequence
  Synthetic
SEVEKAIEEIEKVIKEVRDKNRRVLEESKKLIRTVEETNKRNIEEIEKWIKTLDELTDRNSDKKVIEKVLKELEDEVRRHVEHSERVLREAIKISEELVRRSEEVLKEVTERVERIVRKVVRTEDAAKKAKEIIDKLRTLVEEVKRTNDKSLRDTREVVRRVEETLRRVEEKVKKRVDEIRK

SEQ ID NO: 8009 - protein, 182 aa, Artificial Sequence; identical to SEQ ID NO: 8008
  Synthetic

SEQ ID NO: 8010 - protein, 182 aa, Artificial Sequence
  Synthetic
SEVEEVIRRIEEVLKELRRKNEEVLRESERANDEVRRVNEKNIRDIKKWLEDVKREVDNNRDKREIEKVLRELEKRVREHVEHSKRVLDELRETSRRLVERSEELLRRVRKEVKELVDKVVRSEDARRRAEELERRVDKVVREVEKTNKESEEESKKLVDDVRRTLREITERVKDAVEKTLR

SEQ ID NO: 8011 - protein, 182 aa, Artificial Sequence; identical to SEQ ID NO: 8010
  Synthetic

SEQ ID NO: 8012 - protein, 186 aa, Artificial Sequence
  Synthetic
SRDEEVARRVERVLEESEKLSKEVAEENEKVLREAREILEDVRKKVEDVARTLRELAKKVEDKDDLVRKVKKLVDEVEEILKDVIRRVRKLVKDLHDKNRRSLEESRRLVEEVEEILKDVIREEDKNEEAKRRLEDLRRKLEELVKRNEKKLRDLDERLKELVERIERAAEKLLRDLRDLVRKITK

SEQ ID NO: 8013 - protein, 186 aa, Artificial Sequence; identical to SEQ ID NO: 8012
  Synthetic

SEQ ID NO: 8014 - protein, 186 aa, Artificial Sequence
  Synthetic
RELEKVEKEVEDVLRDIERSSDEVRRENKRVAREMEESSRKVAEDVERVLRTLEELAKKVSDKDDLLRRVKKLVDEVRRRLEESIKRSEDLVRELHEINKRSIEETEKLLRDVEEILKDVIRKKDKNEEAKKRAEELVRRLEELLERNRETLERLDKELKDLVEKNKRTAEKLVKELEELVERIRK

SEQ ID NO: 8015 - protein, 186 aa, Artificial Sequence; identical to SEQ ID NO: 8014
  Synthetic

SEQ ID NO: 8016 - protein, 189 aa, Artificial Sequence
  Synthetic
DELERVRREVKRLADESEKVSREVEERVRDTNRKSEEISRRVEKLARELLKKVEEVERRSGTEEALRDVIRELKKVLETVKKIVEDSVRTSEKLLKENERIVEESRKTSEDIVRRIREIVEELVRRRDKDEDLKRTLDELRKTIEKLVKDNRETLERLIRESEETIKRNREKLEELKRRLETLLRRVRK

SEQ ID NO: 8017 - protein, 189 aa, Artificial Sequence; identical to SEQ ID NO: 8016
  Synthetic

SEQ ID NO: 8018 - protein, 189 aa, Artificial Sequence
  Synthetic
DELEDVRRRVDELVEELERVSRRVAELVKRIIDESRDISRRVARRVEELLRRLREVTKRSGTEEAREEVERTVERVLEEVERILRESVEISRRLVERIREIVRESLERSREVVKTIREIVKRLLEKRKDDDELRKRLEDLKRKIERLLEDNRRKLEELIRRAEKVVEENERTMRKLKEDAKRLLEEIRK

SEQ ID NO: 8019 - protein, 189 aa, Artificial Sequence; identical to SEQ ID NO: 8018
  Synthetic

SEQ ID NO: 8020 - protein, 177 aa, Artificial Sequence
  Synthetic
SVEDLVREVEERVRKVEKDLRELLDRLRRENEDAVRRSRESLRRNEEENKRVVDELRKDGVPESLVRELEESVKRVKEISDELLKRSKRSLEEVEEIIRRLEEDLKRVLDEIRKVATDGDGREEVVKKVREVLERVKETVKRVVDRNREVVKRLEDENRKVSEENKRVVEKVKEDAR

SEQ ID NO: 8021 - protein, 177 aa, Artificial Sequence; identical to SEQ ID NO: 8020
  Synthetic

SEQ ID NO: 8022 - protein, 177 aa, Artificial Sequence
  Synthetic
SVEELVRRIAEKLRKVLDEIERLVDELRKENEEVVRDIERLVEDNEREVRDVLRKLEKDGAPRSLLKTLEESSREVRKRIKKLVEDSRRSVKEVEERIRKLKEELKRVLEKIKKLAEDGDGSEDLVRDAERVLKRVTDEVRRVVKENKDVVRKVREEVERVSEENKRVLEKVTRDTK

SEQ ID NO: 8023 - protein, 177 aa, Artificial Sequence; identical to SEQ ID NO: 8022
  Synthetic

SEQ ID NO: 8024 - protein, 185 aa, Artificial Sequence
  Synthetic
DEVETLKREVERLNKEVLDRVRKVIKEIKELDDRVRRENERVIREVERLIEEVRDRVRKNSDVKELVKRLADELRRVVKESKRLTEELVRLSEEVNKRLEEEVRRLVEESKRVLREAKRVLDEDRDRRAEKIVKELREHSDEVVREMRELVERSKRHSTKVVEELKKSNKELEEKVRKVVRELEK

SEQ ID NO: 8025 - protein, 185 aa, Artificial Sequence; identical to SEQ ID NO: 8024
  Synthetic

SEQ ID NO: 8026 - protein, 185 aa, Artificial Sequence
  Synthetic
SEVEELRERIKELNKRVLDTVRRVLERVKELNEEVDRRNKEVIKEVERLLEEVKREVTREKDSKKLIDDLAKRLEDIVRKSKKDTRELVKRSKRINDEAEKLVRKLVEESRKVLEDAAEVLKKDRDRRAEKIVDDIRRHSEDVVRRMRKLVEDSRRHSKRVVEEMERSNRELEERVKRVVEELKR

SEQ ID NO: 8027 - protein, 185 aa, Artificial Sequence; identical to SEQ ID NO: 8026
  Synthetic

SEQ ID NO: 8028 - protein, 185 aa, Artificial Sequence
  Synthetic
SEVEELIKEIRRLNEEVRRRNKKVIEEVKKLNEDVKRKNDKVIEDVERLLREVKKRVEDESDSKELIKKLAKELEDVVRESEKETRRLADESRKINKESRDRTKKLVEESKEVVDRAARVIEKDRDRRVEEIVRTIEKHSRDVVREMERSNDESEKHSRKVVREMEKSNKELKKKVEKIVRDLEK

SEQ ID NO: 8029 - protein, 185 aa, Artificial Sequence; identical to SEQ ID NO: 8028
  Synthetic

SEQ ID NO: 8030 - protein, 185 aa, Artificial Sequence
  Synthetic
SEVEKLKREVERLNEEVLRRVRKVIEDSKRLNEEVRKRNEDVLKELKDLIREVKRRVEEEDKVKELVKKLARRLEEVVKDSKRRTKKLVEDSKKVNDEIRKLVRELAEESKTVLEEVRKVLKKDPDDRMRKIVEDLRRHSEEVVREAEDLVRRSEEDSRRVAREMEKSNEEIEKEARDVVRELER

SEQ ID NO: 8031 - protein, 185 aa, Artificial Sequence; identical to SEQ ID NO: 8030
  Synthetic

SEQ ID NO: 8032 - protein, 185 aa, Artificial Sequence
  Synthetic
SEVERVVKEAEDLSRENNKRVKEVVRRAEDTNRRVEDENRKLLKEIKDLLREVKETVKRIPKREAVKIAEKVLREVRELVKRSREIAKKVLEDNADLVRRVKESSEKVLKDVEDLVRELLDRKRDVERVRRLLEEVLRRVAEDVRRSEEELDKVLRDSAESLKRSDKSLRDIVREVEKVLDEIRK

SEQ ID NO: 8033 - protein, 185 aa, Artificial Sequence; identical to SEQ ID NO: 8032
  Synthetic

SEQ ID NO: 8034 - protein, 176 aa, Artificial Sequence
  Synthetic
SAEDLLRKLREDVERVMRELRKSNEESRKRVEEVVEEAERILKESRERSEELVRRLNVDRLAEELRDVDRRIDKDVKKAVEDLRRSVDRSLKDTEDLVRELREVLKRVADVVRKTRVEEVLRKLAEDVKRVLDKVKEENKRLLEENDRMLEEVRRLLKKLLEESEKVLEEVERKAR

SEQ ID NO: 8035 - protein, 176 aa, Artificial Sequence; identical to SEQ ID NO: 8034
  Synthetic

SEQ ID NO: 8036 - protein, 183 aa, Artificial Sequence
  Synthetic
DLREEIRKLREDAKRVIDESRKSVKENEKRNKKLLDESEKSVRENEERNKELIKRVKDRGVPEDIVREVKELLDRSIKKLREVTEEIERTLKDSIKKLKDVTREIERLAREVIKRLEEVERANVREVLRKVKEELRRVLEKLRRLNEEASRENERILRELRKKNRDMNEDNRRILEELDEKAR

SEQ ID NO: 8037 - protein, 183 aa, Artificial Sequence; identical to SEQ ID NO: 8036
  Synthetic

SEQ ID NO: 8038 - protein, 183 aa, Artificial Sequence
  Synthetic
DMEREVEKLERELRELIKRIRKIVDENRRRNEELLERSRESVRRNEEENRKLLEEVKKSGVPEEIVERIRKLLEDSIRKLRKVTKEIEEELRRSIEKAERVVEEVERLAEEAIRRLRDVLKANVEKVLREVKEEVRKLLEEIEKTVRDVSRENKRILDELRKKNKRADEENREILKKLREDVR

SEQ ID NO: 8039 - protein, 183 aa, Artificial Sequence; identical to SEQ ID NO: 8038
  Synthetic

SEQ ID NO: 8040 - protein, 183 aa, Artificial Sequence
  Synthetic
SMEEEIRRLEEDVRRLVDKSRKSVKENEERNRKLLEESKESVRDNARRNEKLIRDVRRKGVPEDIVREVEELLRDSIRDLKRVTDEIRKKLEESIKKLREVTERIERLLRKLITEAREVLRANVREMLEEVLRRLEDALRRLEEENKRVSEDNERILEELRRKNEEADKRNRDILDDLRRRAD

SEQ ID NO: 8041 - protein, 183 aa, Artificial Sequence; identical to SEQ ID NO: 8040
  Synthetic

SEQ ID NO: 8042 - protein, 183 aa, Artificial Sequence
  Synthetic
DMEDKVRKLERDVRELIKEVEKIVRDNADENRRVVEESEKSVRELADRARRLIDEIRKGGVPDEIVRRVEKALREVIKRLRDVTDEIRKLAKDSIDRLKKVVEDIRRELERAVKLLREVLSANSEDVLREVKERVEEVLDRVRKKVEKVSRENKEIVKEVRKKNEDAVREAEELLKKIREEVR

SEQ ID NO: 8043 - protein, 183 aa, Artificial Sequence; identical to SEQ ID NO: 8042
  Synthetic

SEQ ID NO: 8044 - protein, 186 aa, Artificial Sequence
  Synthetic
DEVEEVVRRIEELIKEVEDVDRDIERRVKELDEELRRVDDEIRRRAKKLLDDLEKRVREISDKETVVRIAREVLKEVKRLVEESRKIATDVLRENERLAKESTDIVREVKRRVEDLVKKLTDTKKDSERVRRILTELRKRVEKVVRDSEKTLRESVERSARLLKESKESLEELERRAREVVERIKK

SEQ ID NO: 8045 - protein, 186 aa, Artificial Sequence; identical to SEQ ID NO: 8044
  Synthetic

SEQ ID NO: 8046 - protein, 186 aa, Artificial Sequence
  Synthetic
DELEEAEKKVRDLIRRLREMNERALRESERLIRRLREVDEEIVRRIEDLLKKLREEVEREKDKETVKRIVEKVREDVRRLVKTSEEIVRRVLEEDKRLIKESKDIADRMLEEVRRLLREVLETKKDSREVRKTLKDLEDTVKRVLEESEESARESEKRSRDVLRESERSLRELEKKVRKLLEEVKK

SEQ ID NO: 8047 - protein, 186 aa, Artificial Sequence; identical to SEQ ID NO: 8046
  Synthetic

SEQ ID NO: 8048 - protein, 181 aa, Artificial Sequence
  Synthetic
SDVDKVAKEIDDALKDVRRKVDKVRKDNERVNREVEERVRRVTERNRDVIEEVKRRVEEVKEDKDRLDELLKEVKRSTDRVEETVKRLLERSEESVKEVVEILRKLLKDLERVVKEVRDRIGEKVSELVREIERRLEELVKELRKILDELRKRNEDTRRRLEEALKRNREEAERLEREIRK

SEQ ID NO: 8049 - protein, 181 aa, Artificial Sequence; identical to SEQ ID NO: 8048
  Synthetic

SEQ ID NO: 8050 - protein, 181 aa, Artificial Sequence
  Synthetic
KDVDEIATELDEVIDRIRKKVKEVVERDEKVNRDVNDEVDKLTERNRRVLDKVLKDVTRRKEEREVVEELLERLKKSTDDVRKTVKKLLRESEESVERVRETLERLLEEVDRVLKEVEERIGRKVDRLVDELRKRVEDAKREIREILEKLKRDNDESKKRLERLLKENEDALREILERLRK

SEQ ID NO: 8051 - protein, 181 aa, Artificial Sequence; identical to SEQ ID NO: 8050
  Synthetic

SEQ ID NO: 8052 - protein, 181 aa, Artificial Sequence
  Synthetic
DDVEKAVREVEEMLKRVDKEVERVSRENKRVSDEVRKKVKEVERKIKEVLDRIKDEVDRVKDDKEVLRELVERARDVVRKVREELRKLLKEDRESSEDVDRIVTELLRRLEEVLDDVRRRIGEKVDELVKRLEDKMRRVKEKLKRLLEKNREDSERSERELREILKKITREVEELAKELEK

SEQ ID NO: 8053 - protein, 181 aa, Artificial Sequence; identical to SEQ ID NO: 8052
  Synthetic

SEQ ID NO: 8054 - protein, 172 aa, Artificial Sequence
  Synthetic
EEVKKLLEEVRDLLRRVLEEVERSSDEDRKLNERVNEAIEKSIREVEELLRRIDREVDGGEEAVRRLRKVVKESRDLSEELVRRLEESLRDSRRRSKELVERLEKIVEDAERAGVREELVEELKRRVDEVKRRAEEINRENDERNKESKRRLEELNERLEERVRRLEEKLKK

SEQ ID NO: 8055 - protein, 172 aa, Artificial Sequence; identical to SEQ ID NO: 8054
  Synthetic

SEQ ID NO: 8056 - protein, 172 aa, Artificial Sequence
  Synthetic
DEVEDLRRRVEKILEDVKRTVETASKRDRELNEEVNRLLRESVERVDRLLDRIRREADGGEEVVRDAERIVKESEKLSTDLVRRLRDSLRRLEELVERLVRELERVVKEAEEAGVRKEIVDRLRKAVEEVSREARKILDENRRRNEESEKRMREINKRLEDKVREVKKELEK

SEQ ID NO: 8057 - protein, 172 aa, Artificial Sequence; identical to SEQ ID NO: 8056
  Synthetic

SEQ ID NO: 8058 - protein, 172 aa, Artificial Sequence
  Synthetic
REVDKLREDVRRLLEELLRALRESSKEDEKLNRKVNREVDRVLKEVDDLLEDIKKRVDGGKEAVEELERVVRKVEDLVRRLVEELEKSLRDSERLSREVVKKLEKIVEDAERAGVREEIVKRLEEEVREIVKEIKEINDKNRKKNEDSARKADEKVKELEERVRRVVKELRD

SEQ ID NO: 8059 - protein, 172 aa, Artificial Sequence; identical to SEQ ID NO: 8058
  Synthetic

SEQ ID NO: 8060 - protein, 172 aa, Artificial Sequence
  Synthetic
KEVEDLVRRVEKLLRDIDRELKRSSDEDRELNERVNREVDRVLREVDRLLKEIRETVRGGKEAKETLERVVEKVERLARKLVEELRRSVEKSRKLSEKVMRDLEKVVDDARKAGVEERIVRTLEKRIRDLVRKAEEIDRENEKRNKESSDRMERLVRELRKRVKRLVEELER

SEQ ID NO: 8061 - protein, 172 aa, Artificial Sequence; identical to SEQ ID NO: 8060
  Synthetic

SEQ ID NO: 8062 - protein, 172 aa, Artificial Sequence
  Synthetic
DEMRRLLREVERILEEVERVLEKSVRDDERVNREVNRRLDEVLRRVEDLLRRIEKEVRGGREAVELLKEVVDRVRRLVEELVKLMEDTLRRSRELSERLVREARRVVEELRAGGVEERLLERVRREVEKVRERADRIDKRLEDTNRRSKDRAEELVRELEKRVEDLKEKAEK

SEQ ID NO: 8063 - protein, 172 aa, Artificial Sequence; identical to SEQ ID NO: 8062
  Synthetic

SEQ ID NO: 8064 - protein, 172 aa, Artificial Sequence
  Synthetic
DEVRKLEEEVDRILREVKEMVEDSIRRHKEVNDEIRRRVERVLEEVKTLLDLIREKDRGGKEAVDRLRKVVTDVERTARELVRRSEKTVRESEELSRRLVERLEKVVEDAERAGVRKEIVDELRKRVEDVSREAKKLDDDLRENVKRLSEEMKKLVDDLRREVDRLEKERRK

SEQ ID NO: 8065 - protein, 172 aa, Artificial Sequence; identical to SEQ ID NO: 8064
  Synthetic

SEQ ID NO: 8066 - protein, 172 aa, Artificial Sequence
  Synthetic
DEVEELRRKVEEILRRIREDVRKSIEDHRDVNRRVLEAVRRSTKRNKDVVDRLRDEDRGGEEAARTLERTLKRSEELSRELVERSRKTVEESRRRSKRLVDELKRVVKEVKDGGVEERIVKRLEDEVRKLVDEMRKLDEELTRNVDEVRREAERLDKENRDENRKLKEELKK

SEQ ID NO: 8067 - protein, 172 aa, Artificial Sequence; identical to SEQ ID NO: 8066
  Synthetic

SEQ ID NO: 8068 - protein, 179 aa, Artificial Sequence
  Synthetic
SEMEKVVTDAKELLERLDRELERVIRESDKILDELRRKIEEVIKRSDELLEELDRRIKENKESKDLVEEIVRAAEESDKDVERVVDEIRKEVEKVNDEVRRLIKEIVDRLKDMLKKVRDAGVREELIERVRRLVEELIEKAKKLLEESERKSARLIEDLERLLEESRRKSDKLIKKARK

SEQ ID NO: 8069 - protein, 179 aa, Artificial Sequence; identical to SEQ ID NO: 8068
  Synthetic

SEQ ID NO: 8070 - protein, 179 aa, Artificial Sequence
  Synthetic
DEVEEIRKEIEDILRRLRDLLRRVIEDSRRLLDELRERNERVIKESEDLLRDLEDKIRKRKESEDLVREIVKRARESDDKSRRVSKESADRARRSDEKVERVIREVVERLRRVVKKAEDAGVDKEIVDRLRDEVRKLEEEAKELLRESNELTRELIDRLEKLNRDSNRKSRELIERLRK

SEQ ID NO: 8071 - protein, 179 aa, Artificial Sequence; identical to SEQ ID NO: 8070
  Synthetic

SEQ ID NO: 8072 - protein, 185 aa, Artificial Sequence
  Synthetic
SELEEVEERIKKELDRLEKKMEESIKRDKEINRELNEMLKKSIKDSDDILRELRKEIEDDKDSKDVVERVKRRLEELIKRDREVIEEVERRLDELIRHNEEVVREVKEELDRLIEEARDVLRKEQDKRAEEIVKKLEKEVEDLVRKAKKLVDELRKENEESKKRARELLRRSEEKVKKLVREAEK

SEQ ID NO: 8073 - protein, 185 aa, Artificial Sequence; identical to SEQ ID NO: 8072
  Synthetic

SEQ ID NO: 8074 - protein, 169 aa, Artificial Sequence
  Synthetic
DSEELVRTVKKELEDIIRESRKLVEDVARALEKIEKEIEEIVRTTDKELRKLIEEAKDVEELKKLVDDLRRENERVLRELKKTLTDLKRKLEESTRRSEDVVRKLIKELEDRGTEEVVKKVKDLLRELEKHNRTVLEEVKKALDELRRRLEEVHRRSKETLDRIRRDAT

SEQ ID NO: 8075 - protein, 169 aa, Artificial Sequence; identical to SEQ ID NO: 8074
  Synthetic

SEQ ID NO: 8076 - protein, 169 aa, Artificial Sequence
  Synthetic
REDELVDTVRKRLKELIEESERLLEEVKKKLEEIKRRVEKILRETEKELRDIIRKNKDVDELRRVLTELEKRNREVLERLEKLVRELLKEAERSLEKSRRAVTRLLEELRRDGDDKVLEKVRKVLEDLKRENKEVVERVDRVLEDAKRKLEKVHKDSRDALKKLDEDAK

SEQ ID NO: 8077 - protein, 169 aa, Artificial Sequence; identical to SEQ ID NO: 8076
  Synthetic

SEQ ID NO: 8078 - protein, 169 aa, Artificial Sequence
  Synthetic
SEKELLDRVKEKLKKIIDDVEEILRRSKKELEKIIRESEKLVEEVKRDLRRLIEENREVDELERLVRDLERILKESTEKSRRAVEELERINREVLERLRDALRKLEERARREGSEKVVEEVERVLEKLLRDVERVHRRTKEVLDELRKENKKVVEDVRDVLEKARERAR

SEQ ID NO: 8079 - protein, 169 aa, Artificial Sequence; identical to SEQ ID NO: 8078
  Synthetic

SEQ ID NO: 8080 - protein, 179 aa, Artificial Sequence
  Synthetic
EEVEDVARKIEKLLEDVRRIDKEISDRNRELLKEVRKIDEKILREIEKLLEELRDTATKDSDKRAVTEIVTRVVERVEKLLKESEDIVREVEERVRRSLKESRRILEEVVRRVKELLERKLGNTEEAERIKRELDRIRKESEETVKENEERLRRIKEESRRSVERARTELKRIEDEVRK

SEQ ID NO: 8081 - protein, 179 aa, Artificial Sequence; identical to SEQ ID NO: 8080
  Synthetic

SEQ ID NO: 8082 - protein, 182 aa, Artificial Sequence
  Synthetic
KVEDELRKLREEVRRSKEEVEKKVKELDEEVKRSKRESEKKLRDLREEVKRLEDDAERSNDDEVRKIVKEVKDRVEKLLKEVEESSKEVEERVKKLLDEVRKSSDRVREEVERLLKEVADENREKFLEEVRERVRKLLDENHKILKEAERRVEELLRRNHKILKEALDRVRKLLKELRDRTR

SEQ ID NO: 8083 - protein, 182 aa, Artificial Sequence; identical to SEQ ID NO: 8082
  Synthetic

SEQ ID NO: 8084 - protein, 186 aa, Artificial Sequence
  Synthetic
SIEEILRELREHVKENMERSEEIVRDLTRKVDESTRDSERILEKLKKDVDKLEEDAKRANSERVKKVIKEAKKRVKELLEELKKSSDDVRRTVEELVKEAKESSKRVKDEVERLLEDLERKKDREEAEELLREVRERVERVSRRNEELLKRVERDVERVLRENHELLKRVAEEVERVLKEVRERTK

SEQ ID NO: 8085 - protein, 186 aa, Artificial Sequence; identical to SEQ ID NO: 8084
  Synthetic

SEQ ID NO: 8086 - protein, 186 aa, Artificial Sequence
  Synthetic
SIEEILEKLRREVEESEKDSRRSAEELRKHVRENEKRSEDIVRKLTEDVERLERKARSRNDRRVEDLVRRVKRLVTELVKKAKESSDKLREDVERHIRHSEDSSRRVKETVERLLKRLEEKKDREEAKELVREVAERVEDVLRKNHEINKTNAEAVKKWSEDNRKLLEDVRREVERVLKELEKEMT

SEQ ID NO: 8087 - protein, 186 aa, Artificial Sequence; identical to SEQ ID NO: 8086
  Synthetic

SEQ ID NO: 8088 - protein, 177 aa, Artificial Sequence
  Synthetic
DEVRKLVEELRKINEDDKRRSDKNFDDNRKLAEDVKRVLERNVEENRKMAKRLEEVLRNNSPSKDLAELIKRWEELIKKSEDDLRRLLKEWEELIRRSAEDSKRSLDDLRRLLERIRRDGLDEKLLKEAEERIRRNAEENRKLLERSKKALEEVERRARKLLEESRRALEELKKRAD

SEQ ID NO: 8089 - protein, 177 aa, Artificial Sequence; identical to SEQ ID NO: 8088
  Synthetic

SEQ ID NO: 8090 - protein, 177 aa, Artificial Sequence
  Synthetic
DEVRELVKELRELNKRDKKRSKELRDKLEEANREDEEKTRKNKEDNERMAREVERVLRDDSPSEVVRKLLEDWKKLIKDSEDDSRKSLEELKKLLRELAEDSKRSLEELRDLLRKIAEAGLEERLLKEAEELIRRNEEENRRILREVEERIKKNEDDNRRVLKRSREELERVEREAR

SEQ ID NO: 8091 - protein, 177 aa, Artificial Sequence; identical to SEQ ID NO: 8090
  Synthetic

SEQ ID NO: 8092 - protein, 177 aa, Artificial Sequence
  Synthetic
DEVDKLRKELEDANARDREKSKENKDENDKALKELEEVLEKLKRELEEIVRRVKEVLDKNSPSEVVKRLLDDARRVLKKLADDLRRLLDEWRKLLRKSAEDSRRSLEELERLVKRIAEAGLEEEILKKIEKEIRTNREENERLLKESEDELKRLEDEMREILERIKRLIEEVEERAR

SEQ ID NO: 8093 - protein, 177 aa, Artificial Sequence; identical to SEQ ID NO: 8092
  Synthetic

SEQ ID NO: 8094 - protein, 177 aa, Artificial Sequence
  Synthetic
DEVRELVKELERINKEDRDKSRENFKRNADIAKEVEDNLERNEEENRKVEEEVRKVLRDNSPSKVIRELEEDWKRLIKESEDDLRRMLKRWEELIEESRKDSEDSLRALERLLEEIARAGLEEDLLRDAKRKIDENKEENERLLKESRKLLERVRKRAEELLRKSRKALEDLKEEAK

SEQ ID NO: 8095 - protein, 177 aa, Artificial Sequence; identical to SEQ ID NO: 8094
  Synthetic

SEQ ID NO: 8096 - protein, 177 aa, Artificial Sequence
  Synthetic
SEVDKLEKEVRDANERDRRNSERNRKENEEMLRRVERVLRELKKKLEEAIRRARKVLDDDSPSEVIKELLKELKRLLEEIARTLKRLLDEWKKLLDDSAEDSKRSLDELRRLLEKIRRDGLDERILERIEELIRDNAKRNEDLLRRSKEMLDELRKKAKEILDRIRKLIKEVEDKAR

SEQ ID NO: 8097 - protein, 177 aa, Artificial Sequence; identical to SEQ ID NO: 8096
  Synthetic

SEQ ID NO: 8098 - protein, 178 aa, Artificial Sequence
  Synthetic
DEVERVVEKLKTLIEEWKRLTEEIEKKNEELIRRIEKVLEDLFRENEKLARDIKREIDELRTDKKMVDDLRRRLEESLRRSEEAIRKLDEDLERSLRETEELSRRMLERLKRILDEARERNVDEELLRRIEEDIERLERTDREVLKRSEKKIRELRERAKELLKRSEEIIKKLEDEAR

SEQ ID NO: 8099 - protein, 178 aa, Artificial Sequence; identical to SEQ ID NO: 8098
  Synthetic

SEQ ID NO: 8100 - protein, 178 aa, Artificial Sequence
  Synthetic
SKDDELKRKIDELIDRWRRLTEEIKKKNDELVKKWEKLTKEVTDHSRDLNRKIREELERLRTSREVLKKLLEDLRDDLRRAEELSEKMTRELERSLEETRKLSEEARKRADEILDEIRKNRLDERLLEEIEERIEKLERDDKKVLDDSRKKIDDLRKRDEEVIRRNRESIDRLRREAD

SEQ ID NO: 8101 - protein, 178 aa, Artificial Sequence; identical to SEQ ID NO: 8100
  Synthetic

SEQ ID NO: 8102 - protein, 179 aa, Artificial Sequence
  Synthetic
DEVETVDDRVKKVIRKLEELLRELAKLNKDIVDDIRRRLKEVEERNRKLAEDIERLLEEGGEDTKRLLREVEEIARRLHEENERVLREIEKLARELHKLNEKVLRDIDRLLRELEEELRRTGVDEDVIKKVRDEAERIRREVRRLDEESRKTVKRLLDEVRELNRRSEEELRELRRRIE

SEQ ID NO: 8103 - protein, 179 aa, Artificial Sequence; identical to SEQ ID NO: 8102
  Synthetic

SEQ ID NO: 8104 - protein, 178 aa, Artificial Sequence
  Synthetic
SELEEVRERLRKLIEDLKRLNEESLKENREIIKALRELNERSLRENKELIKRLEDSNLTSEDAKRLVKRVEDESRKSAKRNEDVVRESRERSKRSAERNKRVVREVEERVKKLAEDIDEGDEARTIIEEIKRRVDELRKHIEESIKEVKKLNDEVEKHIRESIKESEEDLKRLKDRID

SEQ ID NO: 8105 - protein, 178 aa, Artificial Sequence; identical to SEQ ID NO: 8104
  Synthetic

SEQ ID NO: 8106 - protein, 177 aa, Artificial Sequence
  Synthetic
KDDEDVDEKIRRAIKKNEELSREIEDKIRRILKKHEDLTRDLAREIREVVRKLRELSKRGGGKEMADKVLKEAKEVIEKIERTSRKSLKEVKDLIDRLAERSKKSLDELREVIERLRERGVSEELLRKVEELLRRLEEENRKILKEVDERLKDLEKKDRDLLEEAKKLLEDVERELR

SEQ ID NO: 8107 - protein, 177 aa, Artificial Sequence; identical to SEQ ID NO: 8106
  Synthetic

SEQ ID NO: 8108 - protein, 182 aa, Artificial Sequence
  Synthetic
SELEKLIKELRDLVRESEERLRELVRKVKELIKRSEDEVERLLDRSRELAKELEEEIRRKGLEERLLREIEKELRELLKRNRDSLRRLKELYRELLRRIRKLLEDIRRKYEEVLRRLEEAPDRREVLDKLKKDAKRVNDDSERIIKRADEEVKRVNEESKRMLEENEKMNRDLVRRIRERIK

SEQ ID NO: 8109 - protein, 182 aa, Artificial Sequence; identical to SEQ ID NO: 8108
  Synthetic

SEQ ID NO: 8110 - protein, 177 aa, Artificial Sequence
  Synthetic
DLEEMLTEVERLARELEEESKKIRKEVERLARELEEESKEINKRIKDKADDLKEKLKDVREVDKLLKEIEEELRRVTEESRKVLDDVRRDLDRVHEETRRKLEELKKRAEEVRRSNVDREIIKRLVDEVKKVIDELMKKNRKLLEDVERILTELSERNRDLARKVDKLIRDLEKRAR

SEQ ID NO: 8111 - protein, 177 aa, Artificial Sequence; identical to SEQ ID NO: 8110
  Synthetic

SEQ ID NO: 8112 - protein, 182 aa, Artificial Sequence
  Synthetic
SKLEEVKERVKKLSKRNLDVAKRVLDEIDKLIKEDLKKTEDALRRIKELLDRLREMKRRGEIREEEVKRVIDDVRRLLEDIERHNREVRKRVEELLKRLKEHTEEVARRVERLLEELKKDDDDERIRRIVKEVRELVRRNDEEVDKIVEEVKRLLERSSRENEKVVREVEELLKRLEEEARK

SEQ ID NO: 8113 - protein, 182 aa, Artificial Sequence; identical to SEQ ID NO: 8112
  Synthetic

SEQ ID NO: 8114 - protein, 182 aa, Artificial Sequence
  Synthetic
DDVERLLKRVKELIDDDLRKTEKALREIEKLSRDNKKRTEDVLREIEERLRRLEEATRRGEIREEEVEKVIREVRELLKDSTRHTEELVRRVRRLLEEIKRHNTELRKEVRELLDDVRRKEDSERVRKIIRDVERLLEESTRRNEEAVKRVERLLEENKKRNEDVVREVEKELRRLREEARK

SEQ ID NO: 8115 - protein, 182 aa, Artificial Sequence; identical to SEQ ID NO: 8114
  Synthetic

SEQ ID NO: 8116 - protein, 182 aa, Artificial Sequence
  Synthetic
SDIEKVLEDIRRLSKKNVDDSKRVLDEIRELSKRNLELVKEVLERIRRLLKKLEEARRRGEVRKEAVRTVEEDIRRLLEELKRHTEEVDKRVRELLERSTRHTEEVAEEVRRLLEKLKERTDTERIRKIVEDVKELLDRNREENERIVREVEKLLDENRKEVEKILREVERLLEELEKRERD

SEQ ID NO: 8117 - protein, 182 aa, Artificial Sequence; identical to SEQ ID NO: 8116
  Synthetic

SEQ ID NO: 8118 - protein, 182 aa, Artificial Sequence
  Synthetic
KEVEDLLKRIRDLLKRVEETSREVLEEIKRLIDRDRKHSKEVLDEIKELLKRLIEAAKRGEIREEDVKRVARKVEKLLERNKKHNRDVEERVKELLKDSTRVLKEVEKRIRELLEDVRRREDSERVRTIIREVEKLLKELEDKNDEIVRRVEELLRKSHEDNRRIAEEVREMLKRLEDEMRR

SEQ ID NO: 8119 - protein, 182 aa, Artificial Sequence; identical to SEQ ID NO: 8118
  Synthetic

SEQ ID NO: 8120 - protein, 185 aa, Artificial Sequence
  Synthetic
SSLEKVEKDIRKLNDDSKKEAKRVTEENRKSNEDVERELRKIVEEVRRLIKDVEDKIRKDGTDEDVKRLVDEVKKRVEDLERKAKELIDRDDKKSEDLARKLRELLKDDARKVDKLIRDMDRETRTERVKRIVDELRKSLRKLEEDVKELIKENKESNDRLRERVERILKELRELLRELEEKVKT

SEQ ID NO: 8121 - protein, 185 aa, Artificial Sequence; identical to SEQ ID NO: 8120
  Synthetic

SEQ ID NO: 8122 - protein, 185 aa, Artificial Sequence
  Synthetic
SEVERLVEEVRKSNKKWEEESRELTERNKKLNRETTKRAEDLLERVRELVRTVTEIIKREGTDEKVEELVRRVKKALRELIETLKDLVRRDDEKSRKLIEDDRKILKEDEERVEELIKDLDRKRRDERLKRIVEEIRDSVRRLKEKSEELVRRNEESNDRLRRRVEEIAKEARDLVRRLEEEVRR

SEQ ID NO: 8123 - protein, 185 aa, Artificial Sequence; identical to SEQ ID NO: 8122
  Synthetic

SEQ ID NO: 8124 - protein, 185 aa, Artificial Sequence
  Synthetic
SEAERVLEEVRRLNDKSKKTAEKLTEENKRLNKRTTDFLKEVLERIEELVRRVEDRIRKEGTSREVKELVDRLKDRVRELIKEARKMVKEDDRRSEELVERLKEIIERDRRTVEKLIEDLKRKSDDKRVKDIVREIRDSVRKLEEEVRKLIRENEKSNKDLRRRVRKIEEDIKRIIRELEERVRK

SEQ ID NO: 8125 - protein, 185 aa, Artificial Sequence; identical to SEQ ID NO: 8124
  Synthetic

SEQ ID NO: 8126 - protein, 185 aa, Artificial Sequence
  Synthetic
SELEKILKDIEDLVRKWLEESKDLLRKLKKLNEDTTERLRRLLDELRKLIKDLLDKIRKDGTDDRVRKLVEDITRKLEELIKEARELVREDKRRVDELIRRDEEIAKEVEKEVRRLIRDMKEKRDDKRVKDIVKKIEELVKKAKEESKKIVEEVRRSVKRLEEEVRKIEKDIKDLIDELRKKVTT

SEQ ID NO: 8127 - protein, 185 aa, Artificial Sequence; identical to SEQ ID NO: 8126
  Synthetic

SEQ ID NO: 8128 - protein, 175 aa, Artificial Sequence
  Synthetic
SEVEDLRRELEEINKEWNKRTKDLVKEVEEVNRDINKKIRDLLREARRLVDEIRRLIEKGEPKEELIKTLRRVVEEIEKDIRRLEERLAAIHKKVKDDDKKLADELREMHKRVEDRVKNEEVIKELRKLLEESERRAREMNKRLDRLLEESKKDVDRVREEIKRLVDEIEDRARK

SEQ ID NO: 8129 - protein, 175 aa, Artificial Sequence; identical to SEQ ID NO: 8128
  Synthetic

SEQ ID NO: 8130 - protein, 175 aa, Artificial Sequence
  Synthetic
DEIEEVLKRLEEIVKTWDERTKRLTERVRTVNREVNERHKKLTRDLRELAREVLDLVRQGKDKDRLIKRLEDMIRDIVRRAREINKRLAEIHKRVEDEDRKLAEELRDVLDKVRRKLRSREMLRELEERIRTVEDKVRRVNEELRELLKTSNRRSEEIEKELEKILREIRERARK

SEQ ID NO: 8131 - protein, 175 aa, Artificial Sequence; identical to SEQ ID NO: 8130
  Synthetic

SEQ ID NO: 8132 - protein, 175 aa, Artificial Sequence
  Synthetic
DEVRKVLEDLRKIVREWEERTERLLRDLKRINEEINRRVEKLTEELRRLVKEIKKLTDDGKDKKKLITELEEVARRIVETLKDLLRRLAEVHKKVVREDEKLLEDLKRFLEDLKRKMKNEDVLREADKIIEDVEREARRVNKELKDLLDESAERIERIIREIERLVEKIKRDADR

SEQ ID NO: 8133 - protein, 175 aa, Artificial Sequence; identical to SEQ ID NO: 8132
  Synthetic

SEQ ID NO: 8134 - protein, 175 aa, Artificial Sequence
  Synthetic
SEIEKVLDELREINRRINETAKEILRRLKEINERTKKEIDRLLDELRKLLRRVEELRKEGRDTEELIKRLRERVDEIRRDIKRLIDEDRKRVEDVERELERLAEELRRMHEDAKRKMKSEEALKDLERLLRESEKRIREIIKRIRESVEKLERDVRRVIDEIRRRLEEIERRLRK

SEQ ID NO: 8135 - protein, 175 aa, Artificial Sequence; identical to SEQ ID NO: 8134
  Synthetic

SEQ ID NO: 8136 - protein, 171 aa, Artificial Sequence
  Synthetic
KEVEEALEELRRILREWEEVTKRLEERVEEINRRSLEELRRLKEEVEEIAKRIRDTDKADTLLKELRRLLEEIRKRSEDSLRRDEELFERIHRTDERAARELKKVLEDIARKIDRKEVLEELDKLVKDIKRKVDEVNEKWKESSKRLEDEHRKVIKELEELVKRVEEELRR

SEQ ID NO: 8137 - protein, 171 aa, Artificial Sequence; identical to SEQ ID NO: 8136
  Synthetic

SEQ ID NO: 8138 - protein, 171 aa, Artificial Sequence
  Synthetic
KEVEDALKKAEDILRRWEEVTKKLKDEARKINEDSRRKLKRLKEESREIVERIKKTDPSDELLKRLRDLNRRIAEESKKSLRRDEEVFRRIHEIDKEMADRLAELLKEIADKIDREEVLRRLEKLVEDIKRKVAKVNDEWRKSSEDLEREHRKVHRESEKLIRDVEDRLRK

SEQ ID NO: 8139 - protein, 171 aa, Artificial Sequence; identical to SEQ ID NO: 8138
  Synthetic

SEQ ID NO: 8140 - protein, 171 aa, Artificial Sequence
  Synthetic
SEVEEVRREVKRVVDDWRRVTKKLLDDIRRISEESKKIIRDLKEAAKTMIREVERTRPDETLLDRLRRLLERIAREAKRSIEDIRRLLEELHKTDKKIAEELKRLLDRIAEEIDREEVLKELEKLLEDLRREVEEVNERLKRLLDENEKRIREVLRELKKLLRDLDEKLRR

SEQ ID NO: 8141 - protein, 171 aa, Artificial Sequence; identical to SEQ ID NO: 8140
  Synthetic

SEQ ID NO: 8142 - protein, 184 aa, Artificial Sequence
  Synthetic
DELERVREEVKKLSDTSREKLERALKKARDLLEENERRLRELKKEVEELIRRIEEKLKDRKDEDLIRKIERDLDRVLRKVEKLVEEVRRRHEKVLRELAKLVKESKEELDKVLRDVEKLIRDRESEELRKVLTDIERLLRENKKELDEVLKEVEKLSREADDKNRKVLKEIKELLDELKKRAKD

SEQ ID NO: 8143 - protein, 184 aa, Artificial Sequence; identical to SEQ ID NO: 8142
  Synthetic

SEQ ID NO: 8144 - protein, 178 aa, Artificial Sequence
  Synthetic
SEVERMLEEVERISEESKRKLEEVLRRVEEIIKAIERTLEKVLKDDEEIIRRIEDTLRRRNTEEVSKRIEELSERSRRKIAKVLRDIDELLKEAERELDKLKKESRKLAEDVRRALKEINVRREVVKTIDDLLRENERRVDEALEEIEKRARDLREKVKELEERLDRTNRKLKKKVED

SEQ ID NO: 8145 - protein, 178 aa, Artificial Sequence; identical to SEQ ID NO: 8144
  Synthetic

SEQ ID NO: 8146 - protein, 182 aa, Artificial Sequence
  Synthetic
KEVEDIIEESRKLDKELEDEIRRIIEESRRLNEELEEIARRIDEEIKELLERLKRRDKDARELLRELEEVVKEVRKRMEELLKRSRDVSREHEKTLRKLLEESRRMTEKHRDDLRKLEERNGVKEDVERLVRSNREVARDVREKLKRLLEHNKEVVDRVREELKRLLDEARRVIEEVRKKAD

SEQ ID NO: 8147 - protein, 182 aa, Artificial Sequence; identical to SEQ ID NO: 8146
  Synthetic

SEQ ID NO: 8148 - protein, 184 aa, Artificial Sequence
  Synthetic
DELERIDEKIKRDVEEHKRETKRILDESERLNREVKKRLEEIRERIRRLAEEIRKEIERDKGKERLEKKVRDLEKTVRDLIRELEELVREVHERDRRLIKELREHLRRLEEDLRRLIDELRREVEERKLEKVMEDVKRLIDEARKENEDVARRMERSNKELKRKLDEIRREVEELIKELRERTK

SEQ ID NO: 8149 - protein, 184 aa, Artificial Sequence; identical to SEQ ID NO: 8148
  Synthetic

SEQ ID NO: 8150 - protein, 184 aa, Artificial Sequence
  Synthetic
DDLERAREEVADLIRKHEEKTRRILEESRRLNERHRELSKRILDEIRKLAERIEELIKRERGKDELRRKVEDLERRVEDLIRRLEEHLRRVHDKDRRLIEDLRRHLKRVVEELKRLIDELRRKVPKEELDRIEEELKRLIDTLREKNREVEKRARDSNRDLKRTNDEIAKEVRELIKKLREDLK

SEQ ID NO: 8151 - protein, 184 aa, Artificial Sequence; identical to SEQ ID NO: 8150
  Synthetic

SEQ ID NO: 8152 - protein, 184 aa, Artificial Sequence
  Synthetic
RELETIADRIRKLSRENSEVLKEIARRIERLVEEHRKESERILKEIKELADDITRLIREDKGKERLKRKVEELEKRLRELIERLKEHLKEVVKELERLIKEMRDHSERVVEEAKELIDRLRSKVPKEELDKVEEEVRRLIRTNREILRTIEKRVRDLIEELKRRNDEIARRVEELIKRLRRETD

SEQ ID NO: 8153 - protein, 184 aa, Artificial Sequence; identical to SEQ ID NO: 8152
  Synthetic

SEQ ID NO: 8154 - protein, 184 aa, Artificial Sequence
  Synthetic
SELEKVADELRKLIKDDNDLLDEILDRIRKLSKENEKRLREILKEIRKLMDEISKLIKKDRGKERLKKKVDELRETVERLIKEARDHSREVAKEIKELIREAEEHTKDIARKLRKLIEELRRRVPKEELDKIREELERLIKRNKEKLDEIRREVDELIKKNEETLKRIEEEVRKLIEDLKEELR

SEQ ID NO: 8155 - protein, 184 aa, Artificial Sequence; identical to SEQ ID NO: 8154
  Synthetic

SEQ ID NO: 8156 - protein, 184 aa, Artificial Sequence
  Synthetic
SDLEKIEKEIEDLVKRDNEVDKKVMREIRELSKENKERLRKILEDLRREAKKIKDDIERETGKEELEKKVREIEKRARELIKEAKRHSEELAKTAKDLIRRTTKHTKDVEEELRRLIEELDRTVDKEKLKRVEKKVRELIKRNRDHNERTREDVEKLIRDNEDTLRRIEEEIERLIEKLKRDTK

SEQ ID NO: 8157 - protein, 184 aa, Artificial Sequence; identical to SEQ ID NO: 8156
  Synthetic

SEQ ID NO: 8158 - protein, 174 aa, Artificial Sequence
  Synthetic
KEVEDAVKELEDLLRKNEDKTRKIVEDMRRSNKDLEDHSRKSEEEVRKLLDDLRRAGVPRDSLKRLAEDVERVTRESRELLERVHRADRELIERLKESNERLRRAIEEIRKAIKAGKDIKTLLDRVRKLAEEDNERLDRLRRESEELNERVRRVDKKLLEEIRRKAKKVEDDTR

SEQ ID NO: 8159 - protein, 174 aa, Artificial Sequence; identical to SEQ ID NO: 8158
  Synthetic

SEQ ID NO: 8160 - protein, 174 aa, Artificial Sequence
  Synthetic
DEVREVDRRLKELLRRLKETIDEIRRRMEESNRRLEDHSRKSEEEARKLLEELERKGVPRDTLERLREEIERVIEESRRLLEEVHRRDRKLIRDLEKLLEDVRRTVEEVRKKIDDGSDLEELLRRLEELAERAERKLEKALRDSEDLNRKVTEVDRRLLKEIRDLVEKVERERR

SEQ ID NO: 8161 - protein, 174 aa, Artificial Sequence; identical to SEQ ID NO: 8160
  Synthetic

SEQ ID NO: 8162 - protein, 174 aa, Artificial Sequence
  Synthetic
SEDEKVRKEAEDLLRELEKHSRDTERRARKSNRDNNEHSKESVKDLRRLLERLRKAGVPRDTLKTLEDMIRRIIEESERSNERLHREDKKLVEESRKLVKDVLKRLEDIERAIKAGSDIRKLLEEVRKLVDDLRKRDEEIMKTSERLNEEDNRKDRRLVEDVKRLADEVEKKTR

SEQ ID NO: 8163 - protein, 174 aa, Artificial Sequence; identical to SEQ ID NO: 8162
  Synthetic

SEQ ID NO: 8164 - protein, 174 aa, Artificial Sequence
  Synthetic
SKVDDVKRRIRKLLEDSKKRSRESIERVERSNRRLEKHSRDSARRAKELLDKLREEGADERVIKELEEIVREIKKRSEELLEKDKKDSEEIVRRSRKLNDELREVIRKVEEMLRGGSDIDELLERLKELAKRIKELDDRLLRELEEINKTTEKLDRDLLKEIKERIDELRKREK

SEQ ID NO: 8165 - protein, 174 aa, Artificial Sequence; identical to SEQ ID NO: 8164
  Synthetic

SEQ ID NO: 8166 - protein, 174 aa, Artificial Sequence
  Synthetic
DKVERVKKEVRDLLRRLEKHSEDSVREIDTSNKRLEEHSRRSKEELKRLLRKLKEAGLRREVIEEVEKRIRDVERESEKLLEDDKRKSERIKEESKRILKEVRDRIREIEKLLDSGADIDRVLEEVRKIIRRIEEEDRRLLKEIRDINETTERLDRKLLDELRKVVKDIEDRER

SEQ ID NO: 8167 - protein, 174 aa, Artificial Sequence; identical to SEQ ID NO: 8166
  Synthetic

SEQ ID NO: 8168 - protein, 188 aa, Artificial Sequence
  Synthetic
SELEEVKKKVEKLIRDVEKVSEDTRREVERLIREVEEATKEHLDRVRRLIEELREVRKAGSRKEELRELLKRVADKVKRLIETNREVLKEIEDRVRKLIEENRRVIEEVAKTLKKIIDDLRRRLREDRLRERLERLAKEIEDLLRRLREISRTIEERARRLLEELKKRSEDLRKTAEELLKEIDEELK

SEQ ID NO: 8169 - protein, 188 aa, Artificial Sequence; identical to SEQ ID NO: 8168
  Synthetic

SEQ ID NO: 8170 - protein, 175 aa, Artificial Sequence
  Synthetic
DEVETIKKKAEDLLRDSKRKTDELTKRMEELLERSKEDSERLIRRLRELLERLRRRGLPEEVLTRIEKTIRDIERELEKVDRDLKREIERLKKELEEVNRRLEEEIRKLVELLRRGDVREEDVDREVKRLVDESKKIIERVEEDVKRLIRESEKKSRDVERRVEELERKAREDER

SEQ ID NO: 8171 - protein, 175 aa, Artificial Sequence; identical to SEQ ID NO: 8170
  Synthetic

SEQ ID NO: 8172 - protein, 181 aa, Artificial Sequence
  Synthetic
SEVEKIKREMEKLLEEHKKLVDDIRREAERLHEEHRRLSDKIREDLKRLLEELRRSGIDKKLLDEIEEVVKEVDERSKKLDKELREIIRKVVEDSRKLHEELERIIRTVERRMEELEKRGGDRKELDRLRREVEKVVRELKERNKELLKRLEEAVEELKRRNRKLLEDARRVVEEIKERAR

SEQ ID NO: 8173 - protein, 181 aa, Artificial Sequence; identical to SEQ ID NO: 8172
  Synthetic

SEQ ID NO: 8174 - protein, 181 aa, Artificial Sequence
  Synthetic
STVERIDEELKRLHTEHKKLSDDIKREAERLHEEHRRLSEEIRERLERLLEELRRRGIDERLLREIERVVEEVERTSEKLDRDLEEVIKRVEDTSRDLNRRLKEVIDEVRERLKRLEDKNGVEEDLDKILRDLERTAKELKDRNRRLLEEVERVVRELKRRNKELLKTVERVAREIERRAE

SEQ ID NO: 8175 - protein, 181 aa, Artificial Sequence; identical to SEQ ID NO: 8174
  Synthetic

SEQ ID NO: 8176 - protein, 181 aa, Artificial Sequence
  Synthetic
REVEEIDKELRRLHEEHRRLVEDIRRKLKKLHDEHRRLSEEIKRRLEELIRKLREDGASEKLLKELEDALERVKETSEKLDEDLKRIIDTIERRSRESNRELKEVLDDVRRRMEDLERKNGVREELTKLLEEVKRVVDRLKEENKRLLKEVKEVAERLKRENERLLEELRRVAEEVRERTR

SEQ ID NO: 8177 - protein, 181 aa, Artificial Sequence; identical to SEQ ID NO: 8176
  Synthetic

SEQ ID NO: 8178 - protein, 181 aa, Artificial Sequence
  Synthetic
KEVEEIREEAKRLHEEHRRLSKRIDDELKRLHDEHKRLSDEIRKELERLIEELKKGGVSEELLDRLRRELEKVDRESKKLNEDLKRILDDVRRRSERLDRELRKVIETVSRLLEDLERKGGDRDKARKLLEEVRRMVKRLKEENKRLLEEVRKVVEDLKRRNKELLEKLKREAERVKEEAK

SEQ ID NO: 8179 - protein, 181 aa, Artificial Sequence; identical to SEQ ID NO: 8178
  Synthetic

SEQ ID NO: 8180 - protein, 181 aa, Artificial Sequence
  Synthetic
SEVDEIRKRLEDLHREHRELSREIEERLKKLHDEHRRLVEEIIRRARELLEDLRREGIDKSLLDRIREVVEKVRKESEDSNRDLKRVIDEVRDTSRKLDEDLKKVIEEVERELKKLEDNGGDRDKVERLLREVKKVVDKLKKDNEKLLRDLKRVVDELKEKNKRLLEEVKRVVDDIRRRAK

SEQ ID NO: 8181 - protein, 181 aa, Artificial Sequence; identical to SEQ ID NO: 8180
  Synthetic

SEQ ID NO: 8182 - protein, 177 aa, Artificial Sequence
  Synthetic
DEVREVERKIDKLAKDLKDELRRLLKEYEELVERLEELLERILRESEKLAEELKEELKRRKTEDVVRKIEKELRESHEAIKELIKRIDELHERANRKIDELDKRIEEVLRRVKEEVDRKNLDDKVRKRIEELVKELKDILEEIKRRVEELDERSKRILKEIADRNRKLVDELRKTLE

SEQ ID NO: 8183 - protein, 177 aa, Artificial Sequence; identical to SEQ ID NO: 8182
  Synthetic

SEQ ID NO: 8184 - protein, 177 aa, Artificial Sequence
  Synthetic
SEVEKALEDVRRLVEELKKELKEILERYKRLVDKLKKENREDHERSKELAERLKDLLRKSRTEDVVREIEKELRKSHKHSRDLARRVEKLHKELNEELDELVRRIRRVLEEILRDLDRRNVDEKVRDTLRKLLEELDDLVRRIKTTLRKLVEESRRSLRKNEEDNRKLVEELREEAR

SEQ ID NO: 8185 - protein, 177 aa, Artificial Sequence; identical to SEQ ID NO: 8184
  Synthetic

SEQ ID NO: 8186 - protein, 177 aa, Artificial Sequence
  Synthetic
DEVREVLREAREVVKRLKDRLRRILEESRRVVDELRDKNRKDHETYRKVVEELKKRLEERKTEDVMRDIRRVHEELNRHSEELAKEAEEVARETHKKIEKLAREIRKVLKELLKKVDEANLPEEVRKDIERLFKELEDILKEIKEDNRRLVEDIKRSLEKNKRDLEKLVKESEDEER

SEQ ID NO: 8187 - protein, 177 aa, Artificial Sequence; identical to SEQ ID NO: 8186
  Synthetic

SEQ ID NO: 8188 - protein, 177 aa, Artificial Sequence
  Synthetic
DEVRKVLEDARRLVEKLERDLEKVLEDYKRLVDELKERNERSHRESRRLAEELKKELERERSREVVETIRETVERILRKNEELARRAEDLHRRVNEELERLVEEIKRRADDLRRRVEEAKLDDEVKERIDRLVKRLEDLARRIKEELDKLVKESRESLERNKTEVKKLIRELEETVR

SEQ ID NO: 8189 - protein, 177 aa, Artificial Sequence; identical to SEQ ID NO: 8188
  Synthetic

SEQ ID NO: 8190 - protein, 177 aa, Artificial Sequence
  Synthetic
SEVEDVLTKIEDVVRKLEEENKRSHDESRKLADELKKENKEDHDRYRKEVERLKKELEERRTKDVVTRIREVHKKLNKHSEELVRRIEDVLRRMLEKNRELVERIKETLKRLKEEVDKANLDDKVRKRVEELVKEIEKSARDNEEAVKRLAEELRDSARRNKEELEKLVKESDDELK

SEQ ID NO: 8191 - protein, 177 aa, Artificial Sequence; identical to SEQ ID NO: 8190
  Synthetic

SEQ ID NO: 8192 - protein, 177 aa, Artificial Sequence
  Synthetic
RETEEIEKEIRRLVKELRELNDEVEDRVRKLIKELKELNDRSERTLRELADELRRSGAPEEDVRRVIDRARKLHRRNKEHSKRVMTEIDKLIKTNRRHTERVERELEDLLRKLRRSTDDDVVRKVLERAERLVREDKKHTKEVLERIKELVDRDKKHTRDVNEEVKRLVEEIKKKTK

SEQ ID NO: 8193 - protein, 177 aa, Artificial Sequence; identical to SEQ ID NO: 8192
  Synthetic

SEQ ID NO: 8194 - protein, 177 aa, Artificial Sequence
  Synthetic
SEIEEIEKRIEDLARELKELNKEVEERVKKLIEDLRRLNEESRESTDRLMDELRKAGAPREELEEMIKRLKRLNDENTRHSEEVMDTARRLIERNKEHTERVIRRIEELLEKLRRSDKDEVVRRVLEEIERLVRRDKEHTERVLRTIEKLVREDEEHTKRVNEEIRKLAKEIEERAR

SEQ ID NO: 8195 - protein, 177 aa, Artificial Sequence; identical to SEQ ID NO: 8194
  Synthetic

SEQ ID NO: 8196 - protein, 177 aa, Artificial Sequence
  Synthetic
REIEELRKEIETLIRENEELNRRSKETSEELIRRLKKLNRDVEEEVRRLVKDLRDRGAPEEDVRRAEERVKKLIEDNKRHSDEVAKTDKKLNEDSERHTRRVEERLRELLDRLSRSDKDEVVRRVAEEARRLSKRNKDAIREVNETSRRLATRDAKHTRDVLREIKRLADEIRERTR

SEQ ID NO: 8197 - protein, 177 aa, Artificial Sequence; identical to SEQ ID NO: 8196
  Synthetic

SEQ ID NO: 8198 - protein, 177 aa, Artificial Sequence
  Synthetic
SEIEKAEEDVKRLIKENEELNRRSEETSRKLVEENERLNKEVEDRVRKLIKELEDNGAPEEKLRRAMERIKKLVEDSKEHSRKVAKEDRDLNEESKRHTDRVAEEIKRLIDDLRRSTDDDVVRRILKRIEDLSRKNKRDIEEVNKESERLSRENKKKIKDVLEEIRRLVERIEREVR

SEQ ID NO: 8199 - protein, 177 aa, Artificial Sequence; identical to SEQ ID NO: 8198
  Synthetic

SEQ ID NO: 8200 - protein, 181 aa, Artificial Sequence
  Synthetic
SEIEKVLEDLRRLADRHRKRVEEILREAEDSNRKTKKKHREVEKEVKELADKLKDEIRRDRNKEELTKKVKELMDRLRELNDETRRVLEEVARRNRELLERSRRHLDEVRKTVDDILRKLEKDRRLDEVEKDLRRLIRELKRLNEEVEKRVRDLIKENEELNKRIHDDLRRLIKELEDETR

SEQ ID NO: 8201 - protein, 181 aa, Artificial Sequence; identical to SEQ ID NO: 8200
  Synthetic

SEQ ID NO: 8202 - protein, 181 aa, Artificial Sequence
  Synthetic
SDIEKVLDDLRKLAEEIERAHEEVAREVRELSKRNKEVIKDILRRAKELAERIKELIDRSDRKEELRKKIEELARELEKLLKELEDHSRDVVRRLRELNDETRKMVEDLERRVRDILRKLRPDDDLRKVEETLRELIRKIRKKNEEIRRDLRRLIEENKELLERVRREVERLIEDIKRKLK

SEQ ID NO: 8203 - protein, 181 aa, Artificial Sequence; identical to SEQ ID NO: 8202
  Synthetic

SEQ ID NO: 8204 - protein, 181 aa, Artificial Sequence
  Synthetic
SEIEKMLEELRRLSERNKRTTEEIEKRLRDSNRDTKRKHEEALRTIKELIDRIKRAIREEKDKEKLRKKVEDIERKARRINEETRRTLARAERTNEKLNKDNSDHSRKVEREMEEILRKLRPDDKLRKAADDVRRLIEENRRLDERLHEEVKKLIEENRKLNEDINERVRRLIEELRRETK

SEQ ID NO: 8205 - protein, 181 aa, Artificial Sequence; identical to SEQ ID NO: 8204
  Synthetic

SEQ ID NO: 8206 - protein, 181 aa, Artificial Sequence
  Synthetic
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 8207 - protein, 181 aa, Artificial Sequence; identical to SEQ ID NO: 8206
  Synthetic

SEQ ID NO: 8208 - protein, 174 aa, Artificial Sequence
  Synthetic
RELEELEKELRELLRELRRLSEESRKELKKLLDELEELSRRSAKKLKDLLDDLRRRGVPEDELRRVAKRVEDLIRTSKRLNDETRRKVEEVERESKKLNEDTEETLRRVTELLKAGKDIDEVRERLRELIERDKKLNKKLTDDLRRLAERDKRENEKLSKELEDLARKLREDAR

SEQ ID NO: 8209 - protein, 174 aa, Artificial Sequence; identical to SEQ ID NO: 8208
  Synthetic

SEQ ID NO: 8210 - protein, 174 aa, Artificial Sequence
  Synthetic
SEIEELEKRIDELLKELRDLSRRIAEEVKRLLEELKKLSKDSEDKLRELLERLKRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 8211 - protein, 174 aa, Artificial Sequence; identical to SEQ ID NO: 8210
  Synthetic

SEQ ID NO: 8212 - protein, 174 aa, Artificial Sequence
  Synthetic
SEIEDLERRIRKLLEENRKLVDDVAKKLRELLRELRKLSEESRKRLEDLLRKLRKDGVPEEILRRVAEEVRRLEEESKRLNDETEKELRRLLEELKRSTEDLEKKADDVRKLLRAGKDVEEVLRRLEKLSRENKDLIRRIDERIEKLIRDDKRRNREISERARELARKLEDEAR

SEQ ID NO: 8213 - protein, 174 aa, Artificial Sequence; identical to SEQ ID NO: 8212
  Synthetic

SEQ ID NO: 8214 - protein, 174 aa, Artificial Sequence
  Synthetic
KESEELEKEIRRLLRELREISRKIEEDARRLIEELRRLTEESERELEELLEKLKRDGVPEEELREVLKDLKRLIEESRRSNEEVERRVREVLKRARDSNKKVEDRAREVKKLLEDGKDVREVLERLKKLVEEDKRRLKELLDRIRELMERDKRKNKEISERVRKLIKELEDKAR

SEQ ID NO: 8215 - protein, 174 aa, Artificial Sequence; identical to SEQ ID NO: 8214
  Synthetic

SEQ ID NO: 8216 - protein, 174 aa, Artificial Sequence
  Synthetic
DEEDRLREELRRLLEELRELSERSRDEVKKLLEDLERLTRESEEKVRRLLEKLKRDGVPDEELKKVIDKLRKLIKESRDSNRRVKEELKKLIDDSKRSNDRVEEAVREIDKLLRAGKDVKRVLEELRRLVEEDKKLNEEITEDARRLIEEDRRLNKKISDEAEKLARELRERAR

SEQ ID NO: 8217 - protein, 174 aa, Artificial Sequence; identical to SEQ ID NO: 8216
  Synthetic

SEQ ID NO: 8218 - protein, 174 aa, Artificial Sequence
  Synthetic
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 8219 - protein, 174 aa, Artificial Sequence; identical to SEQ ID NO: 8218
  Synthetic

SEQ ID NO: 8220 - protein, 174 aa, Artificial Sequence
  Synthetic
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 8221 - protein, 174 aa, Artificial Sequence; identical to SEQ ID NO: 8220
  Synthetic

SEQ ID NO: 8222 - protein, 174 aa, Artificial Sequence
  Synthetic
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 8223 - protein, 174 aa, Artificial Sequence; identical to SEQ ID NO: 8222
  Synthetic

SEQ ID NO: 8224 - protein, 174 aa, Artificial Sequence
  Synthetic
SRIEELEKRIRELLKENRDLVKESEDRVEELLRRNEELVRRSKEKVERLLEELRRKGVPDEELRRVEERLRRLLEESKRSSDELRERAEKLVRDSRRSTEELEERAKRVLELLRAGKDVDEVLRRLKKLSDDNKELNERLTRTLEELSRRNADINKKLSDEAEKLIRDLEKRAT

SEQ ID NO: 8225 - protein, 174 aa, Artificial Sequence; identical to SEQ ID NO: 8224
  Synthetic

SEQ ID NO: 8226 - protein, 174 aa, Artificial Sequence
  Synthetic
KEIEDAERELRRLLEELKRLLDDVAREVKRLLDENKRLVEKSEEDVKRLLDELREEGVDEKILRDVAREVKRVVEDSRRSSKELEERAKRLLDELKKLVDKIREKLERVRKLLRAGKDVEEVLRRVRETVERVKKKIKDVLKEIEDLSRENKKLNRDLSERLKKLADDLREKAR

SEQ ID NO: 8227 - protein, 174 aa, Artificial Sequence; identical to SEQ ID NO: 8226
  Synthetic

SEQ ID NO: 8228 - protein, 174 aa, Artificial Sequence
  Synthetic
DELEELSREIKKLLEENRRLVRESEEDLRRLNEENRKLVEDSERRVRELLKDLRDRGVPEELLRKLEEDLRRLIEESRELLDRLTKRDEELTKRSRDSTKELEDRAKEVREKLKAGSDIEEVRERLRKLSKENKDLNRELTKRSRELNARTKERNEEISRRAEELARKIREDAR

SEQ ID NO: 8229 - protein, 174 aa, Artificial Sequence; identical to SEQ ID NO: 8228
  Synthetic

SEQ ID NO: 8230 - protein, 174 aa, Artificial Sequence
  Synthetic
DEKETLARKLDELLRELEKLVRDSAREVEKLNEENRRRLEESRDRLRKLLEKLKRDGVPEKDLREVKKEVEKVEEESKKLLKELHDEDRRLIEESRRLLKELADEVRRVRKLLEDGKDIERVDRELKRLAEEIKELNKRITDESRKLNEDTKRVNDKLSRDLEELARDLERRAT

SEQ ID NO: 8231 - protein, 174 aa, Artificial Sequence; identical to SEQ ID NO: 8230
  Synthetic

SEQ ID NO: 8232 - protein, 178 aa, Artificial Sequence
  Synthetic
SEIERIERENDRLNEENKKITEDIERELKRLLEENRELSRTIEEELERLLRELRKRNGGREEVLKEVEDRLRRIVEEIRRSDKRLEDIAREVKKRIRESDEELRRVSEEITRRLRKVRDEKTLRELLKRSEELSKENKDRLKKLLDDLREVSKKNKEDLKRLLREVREVARKVKERAN

SEQ ID NO: 8233 - protein, 178 aa, Artificial Sequence; identical to SEQ ID NO: 8232
  Synthetic

SEQ ID NO: 8234 - protein, 178 aa, Artificial Sequence
  Synthetic
DDIERILREMERLLEENKEISDEIRKELKRLLDENRKLSEDVVKALEDLLRDLERRKGVEEEVLKRVREVLERIKRELDRSDDELRKVAERILRDAERSNDELRKVIEEIEEELRKVRDKDTLRELARKIRKLSEENKERLKELLRELKKLSDENKERIKKLLKDAEKIIEDVRRRAK

SEQ ID NO: 8235 - protein, 178 aa, Artificial Sequence; identical to SEQ ID NO: 8234
  Synthetic

SEQ ID NO: 8236 - protein, 178 aa, Artificial Sequence
  Synthetic
SEIERIDEDNKRLNDENRKLSDRVRRENERLNKENRELSKRVEETLKRLLDELRRRGGGDDRVIKTVEDIAREIKKRLDDSDDRLRRESKRILEAAKESNEELRDFSRRIVDTMRKTRDKRTLTELLKESRELSKRNKDKIRELLRRSEKLSRENKKRIEDLLRELRRVVEKIKREAD

SEQ ID NO: 8237 - protein, 178 aa, Artificial Sequence; identical to SEQ ID NO: 8236
  Synthetic

SEQ ID NO: 8238 - protein, 178 aa, Artificial Sequence
  Synthetic
KEIEDLRRDLDRLLRENRELTREVKEELEKLNRELEELVRRIKRTLDELLKDLERRNGADKKLLDTIRRALEEATKEIKELLDDHKRLTDEVVKELEDSDRELEKRLREVKRELERTRDREEIERLREELRKLSEDNKDRIRRILERLRKTVEEIKKRLEDILRRLTEIAKEIEERAR

SEQ ID NO: 8239 - protein, 178 aa, Artificial Sequence; identical to SEQ ID NO: 8238
  Synthetic

SEQ ID NO: 8240 - protein, 182 aa, Artificial Sequence
  Synthetic
SELEKLLEDLRRLSERSERELRRLRKELEEIIREIKKKMEENLERNRKVIDEIDKVIKDDSKSKELEELLRRLEKLIEESKRDLERLLRELEELIRRIDDDLRKSLKELRDLIEDIRRKLGDESEEAKRLKEDAERLLRENERRIDELRKEADELIKELKKRIEDLVKESRRLLEELDRRAK

SEQ ID NO: 8241 - protein, 182 aa, Artificial Sequence; identical to SEQ ID NO: 8240
  Synthetic

SEQ ID NO: 8242 - protein, 182 aa, Artificial Sequence
  Synthetic
EELERLEERLDRLIEEAERRLKDNLKKNEDMARKWEEDTKRNEKRNRDLIRRIRKVIKDDSKSEELERLLEELRRLIEESKRDNERLLRELRELVERSDRDLRRLLREIEKLIKEITDRLGEEDRKVKELKRRARELLERLARLIDELRRRSEDLIRRLAEKSERLERESRKLLRDIAEKTT

SEQ ID NO: 8243 - protein, 182 aa, Artificial Sequence; identical to SEQ ID NO: 8242
  Synthetic

SEQ ID NO: 8244 - protein, 184 aa, Artificial Sequence
  Synthetic
RELEELKKEAEKVSKESKDLIEKVIRDNEDVSRRSEELIRELMREVKEVIDRLRELIERRNDEEVKKRVEDVLRELREKIKKIEKDSRELLERLKELNKRLEETSRDLARRLREKLKRLEEAGVPEDKVRRIKEELERLIEENEKLLEESKKRSEDNARRNEELLERLRRELERLARELEEELR

SEQ ID NO: 8245 - protein, 184 aa, Artificial Sequence; identical to SEQ ID NO: 8244
  Synthetic

SEQ ID NO: 8246 - protein, 176 aa, Artificial Sequence
  Synthetic
REKEELKKDIERMVEELKKLNKESRDRTRKLIKELEDLVKESDDDTERLARKLEKEVKDDEDLLRKVKKIIDELKKSNEDVERTVRTIAEDLKRSNDEDHRRIEEIIRRIEKLLREGGDRVEDLLREARKLIEELKRHTEEVIKRNKKLIDELKEIIEDVIRRNRKLVKELEDTAK

SEQ ID NO: 8247 - protein, 176 aa, Artificial Sequence; identical to SEQ ID NO: 8246
  Synthetic

SEQ ID NO: 8248 - protein, 176 aa, Artificial Sequence
  Synthetic
SEKEDLKRRLDKLAEDLRRLNKEVDDEVKELARRLRKLNKDSRKRTEDLIRELEKRVKDNKELLEKVKKIAEDMKRSNDEDHKLIEEIIRRIKKLLKEDHDLIEEIIKRAEDLIRKGGDRVDELREEIKELIDRLRKHTEEIIRRIRRLFEELRKHSKKVIDDNKRLFDELEKTAR

SEQ ID NO: 8249 - protein, 176 aa, Artificial Sequence; identical to SEQ ID NO: 8248
  Synthetic

SEQ ID NO: 8250 - protein, 176 aa, Artificial Sequence
  Synthetic
KEKEDLKRKVDELDKELKKLNEDSRRKTKELIKRLKDINKRLREELEKLADELRKKVKDDEDLVKKVEDIIREAEKLLEEDHELIERIAERMRRSNDRDHELIKRIREEIERLLREGGDRVEELDREITELIKELRRHTEEVIRRNEKLARELEKHSRDIMETIRELIRDLERTAK

SEQ ID NO: 8251 - protein, 176 aa, Artificial Sequence; identical to SEQ ID NO: 8250
  Synthetic

SEQ ID NO: 8252 - protein, 176 aa, Artificial Sequence
  Synthetic
SEKERLEKRLREVVRELEKLNEDLDRRLEELARDLERLNEESRRESRKLAEDLKREVKDDEELLEKVKRIIDEDRRLNDEDHKLIRDIIRRAKELLEEDHKRIREIIKRAKELIDRGGDRVEEVEERIERLIRDLKRHTEEIKKTIEELMKELREHSREIIKRSRDLFKELKDTTK

SEQ ID NO: 8253 - protein, 176 aa, Artificial Sequence; identical to SEQ ID NO: 8252
  Synthetic

SEQ ID NO: 8254 - protein, 182 aa, Artificial Sequence
  Synthetic
SELEKVIEEIREISERSLEKIKRLMEKIKELSDRTAERLRRVLEEIRKIIEEIKELRDRGELRREKVKKLVEELERKLDELRKESEKVIETIRRLIETLMKESEDLIRELEERLRDLLRKKDKKELAKKITEDLKRNEERNRRAIEELERTLRKLEEENRRLIREAEDTLRRLVEELEKKDE

SEQ ID NO: 8255 - protein, 182 aa, Artificial Sequence; identical to SEQ ID NO: 8254
  Synthetic

SEQ ID NO: 8256 - protein, 185 aa, Artificial Sequence
  Synthetic
SELEEVLKEAKRLIDEIRKHTRDVSERSKRLLEEDLKHTEEVIKEIRKLIKEILDRIRARETSEDLRRDIERATREIRKLLEDNTRESRRVIEESERLARDNKEKSKRVIDELRELVKDIARRDKSEDDLRRLKETIERLAKDLERLNREHDETNKKLAKDSEDLNRELKKRVEELEEELRRALK

SEQ ID NO: 8257 - protein, 185 aa, Artificial Sequence; identical to SEQ ID NO: 8256
  Synthetic

SEQ ID NO: 8258 - protein, 185 aa, Artificial Sequence
  Synthetic
KELEDVLKEIRDLARRIEEHSKKVLREIEELIRRLEEENREVLRRMREEIKKIKEDIRNREPDKELEKKIEDVIRRLKELVDTLHERNRRVIKEIEDLLRDNSRKTEEAIERVRRLVEDVARRDRDKRKLDELRRDVRRLERRLERLNETLKERIDRLAERLEEVDRRLDEELKRLAEELKEELR

SEQ ID NO: 8259 - protein, 185 aa, Artificial Sequence; identical to SEQ ID NO: 8258
  Synthetic

SEQ ID NO: 8260 - protein, 186 aa, Artificial Sequence
  Synthetic
DKLDEIKERIERLVETDLRVIKRILEEADELIKENEKLIEKILRDNRRLIEEVEEIIRRDRDKRRLERIVEEVERRLDESTKELKKSSDRLTERLEELLERSRRHSERIDRTAKRLTEELRDKVVQDEKKLRELKKRVDELREESKDLNDKLEKRIRDLKRELKKLNDRHEEELRKLKERLRRATK

SEQ ID NO: 8261 - protein, 186 aa, Artificial Sequence; identical to SEQ ID NO: 8260
  Synthetic

SEQ ID NO: 8262 - protein, 186 aa, Artificial Sequence
  Synthetic
DELDEILKTADKLAEDDLDTIRRLLEEVRDLVRKDKEVIKRILEEIDRLIKEVEDIIRRDRDKERLKEIVREVVERARELLRRSKKHSKEVAETLDELLKRLREHSREVVEELKRLLEELRRRVVQDEKKLKELEDRVRELKRRSEELLKKVEETLRRLKEESRRLNEELERTIRELEERLRRATK

SEQ ID NO: 8263 - protein, 186 aa, Artificial Sequence; identical to SEQ ID NO: 8262
  Synthetic

SEQ ID NO: 8264 - protein, 174 aa, Artificial Sequence
  Synthetic
SKEDRAREELKRLKEELEKLLEEHRKTLEDLNRELKRLVDEHEKSIRELRKELKDSNVEERVVREIARDAERSLKELRDLVREVHERDRKTHEDLRRLIKRVKEKLEEVEKLIRDGEDIDDVIRRVRETIDEVVRRIEELLEENRKLIEDLEEKIRRLNERLKRLVEEIKERDR

SEQ ID NO: 8265 - protein, 174 aa, Artificial Sequence; identical to SEQ ID NO: 8264
  Synthetic

SEQ ID NO: 8266 - protein, 174 aa, Artificial Sequence
  Synthetic
SERERVREEVRKLLERLRELLERHRRKLEKLNRELEKVLEDHRRTLERLKEELERSNVDEKVVREAKRRLDETHKKLRRLIEEVKERDKRSHDELRELIREVEEKLREILELLERGKDIDTVLEEARKLIEKAERDIRRLAKENEKTIEEVKERLKKLMEENKRLIEEIKERTR

SEQ ID NO: 8267 - protein, 174 aa, Artificial Sequence; identical to SEQ ID NO: 8266
  Synthetic

SEQ ID NO: 8268 - protein, 185 aa, Artificial Sequence
  Synthetic
SEIEDLLRRLKEVADEIKERLKKLSEESEELVRRVKRRIEELNKENREVMKEIKRRIDSGQPEESLERLVREADKRLRDSIKEVEDLLRELEEMLRRTNEKARRLVDEIRRRLERVLEEVKKRGAPEEDVRRLAEDIRRLLEEIEKLLKEHEEKNRKLKKELEDLVRRHRKSVEDLKREIRERSR

SEQ ID NO: 8269 - protein, 185 aa, Artificial Sequence; identical to SEQ ID NO: 8268
  Synthetic

SEQ ID NO: 8270 - protein, 177 aa, Artificial Sequence
  Synthetic
DDEERLEETLERLERELKKIADEHRRRNEELRDTLRRIAEELRKTHKDLLERLEEENIPEEARKRVEDHVRESDRLLRELKKELEELHERVDRVAKDLLKKLKDIVREVRKLLKETKEKRVVEEVERKLRRLMDRIREELKRLTDESEDLVTKILDTVRRIVESIKKLVDELREERK

SEQ ID NO: 8271 - protein, 177 aa, Artificial Sequence; identical to SEQ ID NO: 8270
  Synthetic

SEQ ID NO: 8272 - protein, 181 aa, Artificial Sequence
  Synthetic
DEAERLLERVDKAHERSEELLDRVLKENRKVLEEIRKLADDLRKLLDDIMRRIEDLVRKENSEEVVKEARRLLEELKEMIDRLVRRVEELLRDTNRKNKRVVEESKKLLDEVREEIKKLNVNDRDLREIERRLKEIEEENRKLVKRLEDENRKIAREVEKLVERLERRLREIARRVEESVR

SEQ ID NO: 8273 - protein, 181 aa, Artificial Sequence; identical to SEQ ID NO: 8272
  Synthetic

SEQ ID NO: 8274 - protein, 174 aa, Artificial Sequence
  Synthetic
REKEELKKSIERVKRELERLLEEHRKRSEELKRRLEELLKDHKRRTDEVLKEAKDKNVPEDLLRDIKRRLDELNKRLAEILKDWTDKSRKLNEDLERIIRKVAKELDKILKDLEAGKDVDTLEEEIKDIIRDVKRAVKESLEEDDRLAKEVEDMVRKSKEEVERLIEKVKRDTD

SEQ ID NO: 8275 - protein, 174 aa, Artificial Sequence; identical to SEQ ID NO: 8274
  Synthetic

SEQ ID NO: 8276 - protein, 174 aa, Artificial Sequence
  Synthetic
REKEELEKEIERIKREIKKMLDELKRHSEELKRRAERLLEEHRRETERIIREMRESNVQREILEEVEKKLRRLNEELARILEDWERKSRRLLEDLKRVVEEVERRLDEILKLLEAGSDVKTLLEEIRKILKEVEDRIREILREDKRLADELEKAVRDSLREVKRILDEVREAVR

SEQ ID NO: 8277 - protein, 174 aa, Artificial Sequence; identical to SEQ ID NO: 8276
  Synthetic

SEQ ID NO: 8278 - protein, 174 aa, Artificial Sequence
  Synthetic
DEDKRLADEIKRVLDELKKSVKEHRDHSEELLRRAKELLKRHEDETRKIEEEARRNRVPEDLLREIVKRLRKLNEELKEILKRWKKRSDELDEENRRIVDDIRRKLEEILKLLKAGKDVETLKREIEELIRRAKKVNKESKEDDRRLADEVRKVVERSEETVKRLRDEVTERVR

SEQ ID NO: 8279 - protein, 174 aa, Artificial Sequence; identical to SEQ ID NO: 8278
  Synthetic

SEQ ID NO: 8280 - protein, 174 aa, Artificial Sequence
  Synthetic
REKEELEKELRRIKRELEKILEEVRKRSKELLDRLRELLRRHEAETEKAIEEMERANVRKELLEEIKRRLEELNERLRKIIEDWERKSEELNEELKRIVDEITRRLEEILRRLEAGKDVDKLLRDVREIAREAKRVIRRILKTDEDLARELEEIVRRSLKKVEDLIRKVKEDAR

SEQ ID NO: 8281 - protein, 174 aa, Artificial Sequence; identical to SEQ ID NO: 8280
  Synthetic

SEQ ID NO: 8282 - protein, 180 aa, Artificial Sequence
  Synthetic
SEEEKLEEIIRRSRKRLKELIDRLRELVKKIDDDLKRLLDEHRRRLEESERRAEELLKKVRDERIKDLVRRHREELRKSHEELEELAREVRRRLERLLRELEKILERHAEELDEIRKMIRAGKDVEKVLKELEESSRRVVELIKKLMRELEKLLRDVEERAKDLLRKNTRSSEELEKRIE

SEQ ID NO: 8283 - protein, 180 aa, Artificial Sequence; identical to SEQ ID NO: 8282
  Synthetic

SEQ ID NO: 8284 - protein, 180 aa, Artificial Sequence
  Synthetic
SEEEKLKKLLDESEKRLREILKRHEEIVRDIKRRLEELLKRHKELLDRSLKRLEELLKENRDEELERLIREHKRKLDESHKTLARIVTTLKKKLDETHRRLEELVRRHKRLLDEIRKLVRAGADVEELLERVKKSSEDVAREIRKLARDNERLLEEVKRLIRKLLEENRESSKDVEDKIR

SEQ ID NO: 8285 - protein, 180 aa, Artificial Sequence; identical to SEQ ID NO: 8284
  Synthetic

SEQ ID NO: 8286 - protein, 180 aa, Artificial Sequence
  Synthetic
SKEEELRDKLRKIRKRLEELLERLAREIDRIRRALEDLLRRHKEELDRSRKRAEELLKEIRDEDLRRLIKKHEEDLRKSHKELEDLARRVKEEADRILRRVEELVRTLEERLREIEKLVRDGSDVDRVLEELDRLLKEVEETIRDLARKLRELLKRVEDTLRKLLKENKDSSRRLEEEIR

SEQ ID NO: 8287 - protein, 180 aa, Artificial Sequence; identical to SEQ ID NO: 8286
  Synthetic

SEQ ID NO: 8288 - protein, 180 aa, Artificial Sequence
  Synthetic
SKEEELARMIEESVKRLKKLLDDLRKVIKESKDRLKELIDDHRRILEEIRRELEELLKKKRDERLEKVIRELEKRLRDSHEELKRIVEEHVREAEKVLREVEKLLRDHRKELEDILKLVRDGADVDKLLKEIEDSSRKLAEEIKKLIDEIRESSKEVIERVRRLLERNKELVRKVKEEIR

SEQ ID NO: 8289 - protein, 180 aa, Artificial Sequence; identical to SEQ ID NO: 8288
  Synthetic

SEQ ID NO: 8290 - protein, 184 aa, Artificial Sequence
  Synthetic
SEVEKLEEEIKKINDEIRRLSDKNLEDLKRILEEIEDLSRRNLKKTKDILREIEEEAKRRRTEEVVRRVRELIRRSKEHSRRVAEEIKKLIKESKDHSREVSERAEKLNREMEERVRRVIERTRLDEFAERLKRSLEDSKRTSKELVDENRKLNEELERTVRKLIEDNKRLNDRVEKRVKELAD

SEQ ID NO: 8291 - protein, 184 aa, Artificial Sequence; identical to SEQ ID NO: 8290
  Synthetic

SEQ ID NO: 8292 - protein, 176 aa, Artificial Sequence
  Synthetic
SLEDEIRRLIEEIKRKLKELLERLKEEIDRIREELKKSNRKLDELSRRIEEEARKRVGDDKEVEKVLTESKRSLDENRELDKRSLERIEDLLRKLEKIAREVERRLERLLEALKDGDEEKIERVLREMEKLLRELERIAREVLKEIEKILRENKKHNEEVMERNKRLAKELKEKAD

SEQ ID NO: 8293 - protein, 176 aa, Artificial Sequence; identical to SEQ ID NO: 8292
  Synthetic

SEQ ID NO: 8294 - protein, 176 aa, Artificial Sequence
  Synthetic
DLEREIDELIKDIARRLEESNRELEKLVRRIEEELRRSNKELEDLSRRIKTELRKEVGDQKEVEEVERDSRRSLEENKKLDKESLDRIRELLERNRELDERSKDRLRKLLEALKDGDEEKAKRVADEIRKILRENEEHNEEVARRIEEILRRNKKHNKEVADKNRELLKKLKEEAR

SEQ ID NO: 8295 - protein, 176 aa, Artificial Sequence; identical to SEQ ID NO: 8294
  Synthetic

SEQ ID NO: 8296 - protein, 178 aa, Artificial Sequence
  Synthetic
KLVEEIRKSAEDNRRRLEKLVRESKKSLDDNERENRKLVDELRKIATKIKEDLERDNIDEEVKRRLDRLIEEIRRVLKESHDHTRELAKRIKEVHERLNEHSKRLVDRLEEVLERLKNVKEAVDKLEEENKRDHDEYKKVVDELKKENKEDHERSRKLAEDLKRLLEDIRRRIKETRR

SEQ ID NO: 8297 - protein, 178 aa, Artificial Sequence; identical to SEQ ID NO: 8296
  Synthetic

SEQ ID NO: 8298 - protein, 182 aa, Artificial Sequence
  Synthetic
DEVEKLIEDLKEVTKKHAKRVEETNRHNEDVLRKVAKEVKRILDDVKRVVDEVKKVVDAGGPIDELMKRLEEVLKEVEERLDRLVEEAERVSKEHEDDNKRLADHNEEVLREAKERLERKGVDDKAKKKLEDVLKRSREEIERLKDDSRKSVDETRERLKKLKEDLKRLLEEVRKEVEKLKR

SEQ ID NO: 8299 - protein, 182 aa, Artificial Sequence; identical to SEQ ID NO: 8298
  Synthetic

SEQ ID NO: 8300 - protein, 182 aa, Artificial Sequence
  Synthetic
SEVEKLIKELRDVLKKVAEDVEKTNRDLEEVSKRSAEKVKKLEDELEKVLREVEELVKNGEDIDRLLEKLKEDLKRVRETIEDLIRENERVLREVKERNKKLVKELEDVLKEVEDRLRERGVDRKAEEDLRKVLTEIRKRAEELRRESDESVKRSRKELERLLREIEKRVEEIEDRARKAKK

SEQ ID NO: 8301 - protein, 182 aa, Artificial Sequence; identical to SEQ ID NO: 8300
  Synthetic

SEQ ID NO: 8302 - protein, 172 aa, Artificial Sequence
  Synthetic
EEVERIIEEIRDEVKKAAEKVEKVLKESREISKRAEDEVRRVLDEIRKLDETLRDARRSDEELKRVLDRIREEIKKLAEEMDRLNEESKRLTKTLAEELEEILRRIKEKIERVNGDREKLRKVLDEIRREIERLKERLDRLDEESDRKSEKLKEDLERLLREIEKRIRDERR

SEQ ID NO: 8303 - protein, 172 aa, Artificial Sequence; identical to SEQ ID NO: 8302
  Synthetic

SEQ ID NO: 8304 - protein, 172 aa, Artificial Sequence
  Synthetic
DEVRKVLEEIKELLKRLAEKVKKLIKESREISKRAAEKVKRLIEKSRRLLDTLEKANLDKDELRKALEDSKRETEEVVEELKRLNEDSKRKTEELERELREALKELERKIREINGDKDTLKTVLDTIKKKIEELVKELREVDEESKKRSKELKEEMDKVDEDIKRAIERRTR

SEQ ID NO: 8305 - protein, 172 aa, Artificial Sequence; identical to SEQ ID NO: 8304
  Synthetic

SEQ ID NO: 8306 - protein, 172 aa, Artificial Sequence
  Synthetic
DEVRKVLEDIKRDLDRLAKRVKDVLREIEELTKEAARTVKKVIEESRRLLRKLKEANLEEKDLRRALEESKKKSKEAKEKLDKIDRDIERKIRKLKEELERLLRELEKRIRTINGRREDLTELLKRIEEKIKRLVEELERLLKRSREESKRLVEEMEKVNREIEEEIKKRAT

SEQ ID NO: 8307 - protein, 172 aa, Artificial Sequence; identical to SEQ ID NO: 8306
  Synthetic

SEQ ID NO: 8308 - protein, 186 aa, Artificial Sequence
  Synthetic
EEVERLLKEIKDLLDEVARENKEALKRSKELLEEVAEDNKRVLREIEKLLEDVERKVKDEKGDEEVERKLKKVIEEIDKLVKEVHEKNRRLHERSEELIRRLHERNRRVIERMEKLIRDLKERKKEAKELLKELEDLLRKARKTVEDLDRELEELNEEIRKALEELDKELERLVREIRKRLEDARR

SEQ ID NO: 8309 - protein, 186 aa, Artificial Sequence; identical to SEQ ID NO: 8308
  Synthetic

SEQ ID NO: 8310 - protein, 186 aa, Artificial Sequence
  Synthetic
REAEELLKEIERLLREVERENKKALEDSRRLLEEVAEEVKKVLREIEELLKTLEELVRKEKGDKEVAERLDKVLKDVEKLIKDVTDRLRDMHRRSAELIKELHDRNRKVIEEVEKLIREVKERKKEMEELLRELKRLLEEIERRVRELDEELRKLNEDIKRELERLIRELEELLKRAEETLRRLKD

SEQ ID NO: 8311 - protein, 186 aa, Artificial Sequence; identical to SEQ ID NO: 8310
  Synthetic

SEQ ID NO: 8312 - protein, 186 aa, Artificial Sequence
  Synthetic
SEVEDALRRLKELLRRVAEENRKVLEESKKLVEDARRKNEEVLKEIEKLLEDVAREVKDRKGDDEVLERLKEVLKRIEDLIRKVTRDNEELHKRSKKLIEEVHKRNRELIERAEKIIREIKERNKEMEELLRELKKLLEEIKKSVEDLDRELKKLNDEIRDESRKSKEELERLLEDIERALRELAR

SEQ ID NO: 8313 - protein, 186 aa, Artificial Sequence; identical to SEQ ID NO: 8312
  Synthetic

SEQ ID NO: 8314 - protein, 186 aa, Artificial Sequence
  Synthetic
SEAEEVLRRIEELVERATRTVEKLAEESKRLLEKLAEENKRVLEEIKRLLDEVADKVRKKKGDKEVLEELKKVLDEIRELLERVHRENKRAHDESKKLIDDLKKELDRVREEIKRLIDEVRERLKEMKELLDELKTLLDEITKRLKDLTDKLERLNDKIRRELERLDEELRELLERIREEMEKLTR

SEQ ID NO: 8315 - protein, 186 aa, Artificial Sequence; identical to SEQ ID NO: 8314
  Synthetic

SEQ ID NO: 8316 - protein, 183 aa, Artificial Sequence
  Synthetic
DLEEELKELLERIRKAHEELIKELEDLTEKIERDHEKLIKRLEDLLKRIEDEMRKLLEEIDRDELKKLLEEVLREAEELVKRLRKTSEDNIRESRESNKEARKTSEDNIRDIARLLEELKRRTDSRTVKEILKRIEDSLRRAAKKVKDLAEENKDSLRRVAEKVERILEELKRLLEEIARRVK

SEQ ID NO: 8317 - protein, 183 aa, Artificial Sequence; identical to SEQ ID NO: 8316
  Synthetic

SEQ ID NO: 8318 - protein, 183 aa, Artificial Sequence
  Synthetic
SLEEKLEDLIRRLKESNERLKRELERLIEELRKNNERLLKELDDLVEEIERALRDLLREKDDEELRRLAEEVKREVERVKREVKKLSDDDKKILDDLLREVERLSREDERTLDKLKKDVSRLTDSRKVEKILKDAKDSNKKVADTVREILKRARDSNKRVAERVKDLLRRLRELLKELAERVK

SEQ ID NO: 8319 - protein, 183 aa, Artificial Sequence; identical to SEQ ID NO: 8318
  Synthetic

SEQ ID NO: 8320 - protein, 183 aa, Artificial Sequence
  Synthetic
DLEEELKELIKRIRDAHRELKERLDKLVEEIKRNNEKLSDDVRRLVREIEKELRRLLEEIKDERLKRLADDVRRKVEELLRRLRKLSEEDKTRVDEIRKELEEISRRNEEELKKLEEDLRRLTDKEKVKKLLKELEESLKRVADEVKRLLEELERSNREVEKRVRELLEEARRLLKDLADKVR

SEQ ID NO: 8321 - protein, 183 aa, Artificial Sequence; identical to SEQ ID NO: 8320
  Synthetic

SEQ ID NO: 8322 - protein, 185 aa, Artificial Sequence
  Synthetic
DLERELRELIKRIEDDIRKNVKRNEESIRKTEDELRKNVRENERLIEEMRKELEKLRRRNRDKELVRRVEELVDTVMKESRRIIEEAEKRVRDSAKRSKEVIERVKRELERVVKKIEDLVRKLDKVEEVARKLLDELREIKKRINDTSRTTLEDNKRLAKEIHDSSKESLKRLKKILDDIREEAR

SEQ ID NO: 8323 - protein, 185 aa, Artificial Sequence; identical to SEQ ID NO: 8322
  Synthetic

SEQ ID NO: 8324 - protein, 185 aa, Artificial Sequence
  Synthetic
RLAEELRKLIDKVRRDLDRNRETNRELIKRAKDELRKNEEENRRIIDEIRRALEDLTRKNKDEELVKRVEREVEKVEEESRRLIEDLKRKVDEVKERSDRVIRELEERVKKAEKKVEDLIRELDKVEEAVRKVKKEIEDIVREIHKLSKRTLEELERIVEKIHEDSKRMLERVKKLLDKIRRDAE

SEQ ID NO: 8325 - protein, 185 aa, Artificial Sequence; identical to SEQ ID NO: 8324
  Synthetic

SEQ ID NO: 8326 - protein, 185 aa, Artificial Sequence
  Synthetic
SLAEELRKLIKRVEDEIRRLAEENKDLIRKARETIRKNEETNREVITRIRREIEKLEKDNRDRKKVEEVKKELEELADRSRRVIKEVKEKLERLMRKSEELIERVERLLEEVRRKVEELIRDLDKVEEVVRELLKEIRKVLEDIRRESKTSLDDIRRLLKEINDLSEETIREAEELLDRIRKKAT

SEQ ID NO: 8327 - protein, 185 aa, Artificial Sequence; identical to SEQ ID NO: 8326
  Synthetic

SEQ ID NO: 8328 - protein, 185 aa, Artificial Sequence
  Synthetic
SLREELKRLIDESRKSLRENEERNKKSIDDTRRLLRENERRNRETIKELKKTLDELRRRSKDKDLLRTIEKLIREAERESRELIKKIEEDIRRSEERSKRAIDDLRRKNDELEKEVRTLVRDLDKVKEAVDRLLERIRRINEEINRTSEKTLEENDRLVKELHERSERLLRKLEELLRKIDETIR

SEQ ID NO: 8329 - protein, 185 aa, Artificial Sequence; identical to SEQ ID NO: 8328
  Synthetic

SEQ ID NO: 8330 - protein, 185 aa, Artificial Sequence
  Synthetic
SLAEELRRLIEEVKKRLKELEDRNRKLIKEARDELKENEETNRKTIEDIERTLEKLERDNKDKELVRRIREEIDKVREESERLIKRVREKVKKVEEESEELIKEIRKEIKRLEDEVEELIKRLDKVEEAVRDLLRRIRELLRDLERLSEESLRKLKEIVEDIHRKSKTMLDKLRKMLEELRREAT

SEQ ID NO: 8331 - protein, 185 aa, Artificial Sequence; identical to SEQ ID NO: 8330
  Synthetic

SEQ ID NO: 8332 - protein, 185 aa, Artificial Sequence
  Synthetic
SLAEELKRLIEESRKSVEELERRNRKLIEDARRDLERLARENRKLIEEIRRRLKDLAKDNKDERLVRRVARLVDKAMKESEEVLDRIRRKIDKVAKESEKIIRDIKRENDDLERKVKELIDRLSDVEEVVRRLLEEIKRLNDEAKRKSKESLDRLREILKEIRKTSERTLEKLKRILDRIREEAT

SEQ ID NO: 8333 - protein, 185 aa, Artificial Sequence; identical to SEQ ID NO: 8332
  Synthetic

SEQ ID NO: 8334 - protein, 188 aa, Artificial Sequence
  Synthetic
SEIEELLERIRDLMRRINKKSEDHLRELEKILREIRRLAEKSNEEIERLLRELEDLAEKRRTDEVRKEVRRILEEIERRSKEVIDEIRRLLDDLRKTVDKVEREVREILKRIEEEVRDLTRKLKDDKDMKDLKKTLDDLLDELRKDIERNVKENRDTLKRIEDDIRRLAEENKKLLEEVRKKIEELET

SEQ ID NO: 8335 - protein, 188 aa, Artificial Sequence; identical to SEQ ID NO: 8334
  Synthetic

SEQ ID NO: 8336 - protein, 188 aa, Artificial Sequence
  Synthetic
SEIEELLRRLEDILRRIEELIRKVLKELRDLVEKSNDLSRRHLEDAKRILKEIEEEVKRRNTEEVRTRIRKLLEDIKRTLDEVTKEDRELLDRARELAERIIRRIRKLLDDARREVEKLARELKDDERVEELRRRLRKILEDIRKRIEELVEELRRLLKEWEEESKKNDETNREVLKRIEDRIRELER

SEQ ID NO: 8337 - protein, 188 aa, Artificial Sequence; identical to SEQ ID NO: 8336
  Synthetic

SEQ ID NO: 8338 - protein, 177 aa, Artificial Sequence
  Synthetic
DEAEEIKERIKKVVEDLERKVRELLRRSEKLAEDLHELSKENIERMKRLLEELEDLVRKRRTEEVIKTAEKVLRDSRRSSKEVADRADRVLEESKRLTREVTEEMRRVLEKLRDEVRRANLDEEIEDLLRKVEERIRELEEELRRLNKKIEEEVRRNKDENRRVNEEIERRIRELAR

SEQ ID NO: 8339 - protein, 177 aa, Artificial Sequence; identical to SEQ ID NO: 8338
  Synthetic

SEQ ID NO: 8340 - protein, 177 aa, Artificial Sequence
  Synthetic
DESKEILDRIRKVNEDLRRLAEELLKDSRRVVEEAHKLSEDNIRRLEELLKEIEKEVRRRRTEEVIRRLEEVLKRSRESSEEVVRRLERLLERSRRLTEEVAERVREVNERLKEEVDRANLDDKIRKLLEDSKKTSDELKEELDRLNEEIERSVRDNKRRNEEVNKRIEDEIRKLAT

SEQ ID NO: 8341 - protein, 177 aa, Artificial Sequence; identical to SEQ ID NO: 8340
  Synthetic

SEQ ID NO: 8342 - protein, 177 aa, Artificial Sequence
  Synthetic
SEAETILEKIRRANEELNRLSEENIRKSRKVVKELHELSKENIKRARDLLREVKKLVEKRQDERVIKTLEDVIRDSKRSSKKVAEELEKVLEDSKRSSERVAREMERVLRELEEEVRRANLDESIKELLKEVEDDVRKNKEENKKVNKEAEDEVRENKERNTRVNKEMEEEIKRLAK

SEQ ID NO: 8343 - protein, 177 aa, Artificial Sequence; identical to SEQ ID NO: 8342
  Synthetic

SEQ ID NO: 8344 - protein, 182 aa, Artificial Sequence
  Synthetic
SERERLERLVREAAKELKRLLEELERLHKKIDEDLKRSNDRLRELHERIKKDIERLLRRIGDDEKLERLRRIAEEVKKRSRESLEEHRKRNEDSKRRSRKSLEDVERTMREVRRRIEDLLRKGGDRVEEILKEIEDILRKVKEDVKRVLDENRRVLEENKEHAERILRENKRMLEELRREAK

SEQ ID NO: 8345 - protein, 182 aa, Artificial Sequence; identical to SEQ ID NO: 8344
  Synthetic

SEQ ID NO: 8346 - protein, 182 aa, Artificial Sequence
  Synthetic
DSEERLRKLMREAREELKELLRRLRELHEEIRKRVEELLRRLEELSDKLRRDLERLLREIGKDEKLKDLAKLVKEVLERSRESNDRLRKIIEKVLTDSKKSLDDVARIADEVIRRIEKLLRDGGSRVEELLKTIKELVDRLRRIVEKVLDENRRLLKRLEEEIKRVLDENREMLDRLRKAAE

SEQ ID NO: 8347 - protein, 182 aa, Artificial Sequence; identical to SEQ ID NO: 8346
  Synthetic

SEQ ID NO: 8348 - protein, 182 aa, Artificial Sequence
  Synthetic
SKEETLEKLVREVKDRLKKLLEEVRRLTEELERELKKLREELEELSKELEKDLRRLKKRVGDDEKVKDLDRRLREVLRRSKKSLDDLRRIAEDVIRRSRKSNRELEEEARRVIEEIEDILRRGGERVEELLKRIKELLEELERRVEEVLRRNRELLKRLEETIRKVLEENKKLLKEVREDAK

SEQ ID NO: 8349 - protein, 182 aa, Artificial Sequence; identical to SEQ ID NO: 8348
  Synthetic

SEQ ID NO: 8350 - protein, 182 aa, Artificial Sequence
  Synthetic
DKEEELRRLVEEVEKRLRELEKELEDLTDKIEKRLRESNERIKKLSDDIRRRLEDLLRKVGDDSRLDDLRRDLKRVLDESEKSMRDHAERNKKSLERSKRSLDELRDIARRVLETIKRILEKGGERVEELLKRIRDILKRVEEIVKEVLERNRKVLEDNERHAEEVLRRNKRLLEELEKRAT

SEQ ID NO: 8351 - protein, 182 aa, Artificial Sequence; identical to SEQ ID NO: 8350
  Synthetic

SEQ ID NO: 8352 - protein, 182 aa, Artificial Sequence
  Synthetic
SKEDDLRKIVKEIEEEVRKLLKELEELTKELEDRLRESNKTLKELNERIKRRLEELLRRIGKDEKAEELKRSVEDVERKSKETLDRHEKKNRDSLKTSRDLNERLREILREVLETIRDILRRGGSRVEEVKKELEDLLRRLREEVKRVLDDHRRILKENEDHAREVLKRNKELLRKLEEEAK

SEQ ID NO: 8353 - protein, 182 aa, Artificial Sequence; identical to SEQ ID NO: 8352
  Synthetic

SEQ ID NO: 8354 - protein, 182 aa, Artificial Sequence
  Synthetic
SKEERLKKLVDDVRKTAEKLKRDLERLTKEAEETLERLKRELDRLNREIAEEIKKILDRVSEDEKVKELKKLADDVLRKSKETLDELKRILERVLEESKRLNDELRKDLERVLKDIERILREGGEDVETLLEEIERKLREVEKRIREVLKRHRELLRRLRETIKRVLERNKELLDRLREAAR

SEQ ID NO: 8355 - protein, 182 aa, Artificial Sequence; identical to SEQ ID NO: 8354
  Synthetic

SEQ ID NO: 8356 - protein, 182 aa, Artificial Sequence
  Synthetic
SKEETLKKLMDRAEEELRRLKRELEELNDRIREALKKLNEDLRRLHEKIKEDIRKLLEEVDKDEKFEELKRLAEDVLRRSRENLRDHERVNKESLEESEKSLRELEKTLDKVRKDIRKILEDGGERVEELLETIERILEEVRRRIEKVLEENKRLLDENKKHAEESLKKNKELLKRLRDAVK

SEQ ID NO: 8357 - protein, 182 aa, Artificial Sequence; identical to SEQ ID NO: 8356
  Synthetic

SEQ ID NO: 8358 - protein, 185 aa, Artificial Sequence
  Synthetic
SEVDEVRERLERLLRTVERVVERILRELKRLNDELRKIAEDLLRENKDLLRELAERVRKGLEKRELERLLKELRKRSKESNEELRRVAEKAKEDHRRLLDELRKILKTIEDEIRRLLEDLRRRGVPSEALKDIEKLVRKIKEELKRLLKEVAETLERSERSLDKLIEDHRRLVEDIERALKELRK

SEQ ID NO: 8359 - protein, 185 aa, Artificial Sequence; identical to SEQ ID NO: 8358
  Synthetic

SEQ ID NO: 8360 - protein, 185 aa, Artificial Sequence
  Synthetic
SEVEKVLETIKDLLRKLEEIVKKILDEDRKLMEKVTKIVEDLLEENKRLLEELERLAREGQPKEELTKLAEELERRSTKSNEDLKRVVEDWERRSEELLRRAEDVLRKIERTVRELLKELEKRGMPSELLKRIRELVKEVKDRLRRLREELEESVRRARKTLEDLERRHRKLLKDIRETIKELIR

SEQ ID NO: 8361 - protein, 185 aa, Artificial Sequence; identical to SEQ ID NO: 8360
  Synthetic

SEQ ID NO: 8362 - protein, 181 aa, Artificial Sequence
  Synthetic
DLDREIERLVEELERRLRELLRRNEELVKRVEDELEKLKRESEKLLRELRKKLEEAKKSKELDDLKKRLEDLADKIRRVHERLNRELKELVERSRRLLKKVEEELKRLVEEIRKVLERLKNVKEAVDKLLKELKDILKKLEELSRKSMEDIKDILRRYEKLVKELLDELKKILDELDRADK

SEQ ID NO: 8363 - protein, 181 aa, Artificial Sequence; identical to SEQ ID NO: 8362
  Synthetic

SEQ ID NO: 8364 - protein, 181 aa, Artificial Sequence
  Synthetic
DLKDEIEELVKRARERLERLREESEEIVKELEKVLRDLEKENRDLARRLRDELRKIEPSDKLRELRKRLEELLKESEKLLRKIAEEVKRLVDDIRRVHEELNKRLEELVRDIRRVLEELKDSEEAVRRLKDELRRILEEYERVVEELKKRLKDLLREAERLSKESLDELKRILRKLKEDAK

SEQ ID NO: 8365 - protein, 181 aa, Artificial Sequence; identical to SEQ ID NO: 8364
  Synthetic

SEQ ID NO: 8366 - protein, 184 aa, Artificial Sequence
  Synthetic
SLEDELRRLVEEDERNIRKLNDENRKSVRKLEELLRRLNKRNRETIERIKRLLDRLREESTDEDLLRKIEERIDDVRRKLEELDRRLEEVIRRLEKKVKDLDDKWRRLSEEIKKELERLAREGADKEEIDRILRKVERLSRKAHEDVRRINEELEKLLEKLKREVKRENDRVEEEAKRLADEVK

SEQ ID NO: 8367 - protein, 184 aa, Artificial Sequence; identical to SEQ ID NO: 8366
  Synthetic

SEQ ID NO: 8368 - protein, 182 aa, Artificial Sequence
  Synthetic
REVDELVKRIEELLREMKKKNDESLKDSRDLLRELEKRVERVIEEIEKLLRDLEELVRKEKGDDEVRKKLEDVLRKIEKLVRDLARELEEALRRSKELSDRNRKDNEDLLRDVERLVDKAKKDGLDEKRLKKLLDELRDMSRKADRALRELNKDVARKIEELRRRLKKLLDEVKERADELTK

SEQ ID NO: 8369 - protein, 182 aa, Artificial Sequence; identical to SEQ ID NO: 8368
  Synthetic

SEQ ID NO: 8370 - protein, 186 aa, Artificial Sequence
  Synthetic
SEAEKLLEDLKRLVEDLRRKNKKLNDDNERLTTELEKTSRKLLEELKRLLEKVADDVRRTRDKKRLKELAKELRDRVRKVEKDNRDLLRELEERSRRLLEESKRLLKELLDRARKLVRELERDNKEEGELKERLDRLLEEVKKTIRELEKRNRESHKRTKDVARRSAEETKRVLEKIEDDLRKLDK

SEQ ID NO: 8371 - protein, 186 aa, Artificial Sequence; identical to SEQ ID NO: 8370
  Synthetic

SEQ ID NO: 8372 - protein, 186 aa, Artificial Sequence
  Synthetic
SEAEKLLKEIKDLVDELRKRSKELIDENKRLTEEVEERARRLLTELRKLLKRLEELVRREEGKEKLDELLKDVDRKVKEVLKELEDLAEELRRRSRELLKRNDDLLRELEKRVKELLDELKERNKEEGELEERIRRLLREIEKEAKRSRDRSREVHRRTDEELRRLEREIKEILKEIKRKLDELRR

SEQ ID NO: 8373 - protein, 186 aa, Artificial Sequence; identical to SEQ ID NO: 8372
  Synthetic

SEQ ID NO: 8374 - protein, 182 aa, Artificial Sequence
  Synthetic
SDVDRLLKENRDVSKKVEDDVRRLLEELKRISEEIARRVKRLLEELRRILREIEELVKKGEDIDELLTRLEEALRRVEETLKRLVDESRKVSKEVLTDLRRLIEESKEISRRLLERLERRGISDELRRRAEKSIEDNERKLRKLEEDAKRIIDDNERILRDLERRAKDVIREVRKALEDLKR

SEQ ID NO: 8375 - protein, 182 aa, Artificial Sequence; identical to SEQ ID NO: 8374
  Synthetic

SEQ ID NO: 8376 - protein, 183 aa, Artificial Sequence
  Synthetic
DEAEKLLEEVKEENRRVNEDIKRVIEEIKKLIDESRRLMEKIIRDVEALLTRIRDVVEKLKTSEEVLERLKREIEDIDRRAKELLDDSRRKTRELIERVRERIEELRRRHDDLIRRLEERLKDDEDVRREIERIMRELKKNLDRLEEEIRRIADELRRVNTRLEEEIKRVIDEARKTLEELRR

SEQ ID NO: 8377 - protein, 183 aa, Artificial Sequence; identical to SEQ ID NO: 8376
  Synthetic

SEQ ID NO: 8378 - protein, 178 aa, Artificial Sequence
  Synthetic
SKEERLEEILRRHKKSLDEIRKELRKLLEDHRKSIEDLIRKLRELLERLKELLERLERSGVSDEARKRLEEIIDEVRRLVEKITKELEDTLKELEDLVRTITRELEKTLRELEDLVRKGGEDVDRLITEIKRINEELRESVRRLLERAKRIDEELRRTAEELVKTIEKLAKELEETVR

SEQ ID NO: 8379 - protein, 178 aa, Artificial Sequence; identical to SEQ ID NO: 8378
  Synthetic

SEQ ID NO: 8380 - protein, 187 aa, Artificial Sequence
  Synthetic
DEIEEVVERIRRIDKELNKRAEEVIRRNKELDERLNREIERVKEEIRRLIKRLEEVTRRDLKDKETLDRTARRVLEEIEKLVRDLERKMRESLKRSRETVKRVKDRLDETRERVRRLLDELRKRNTDLEEAKKKLEDLLEEHERNLRKIERDLEELNERHERNLRKLKRELEEILKRAKEVLDELRK

SEQ ID NO: 8381 - protein, 187 aa, Artificial Sequence; identical to SEQ ID NO: 8380
  Synthetic

SEQ ID NO: 8382 - protein, 187 aa, Artificial Sequence
  Synthetic
SEIEKVLREIEEIDKRLNKEVEDVLRENRRVDEELNRHSERVREEIERLVKRLDDVAREELKDKETLRRTLDEARRRIEKIVRDNKRELERSIKRSRETLDTLERRAERTKEEVKRLVEDLRRKKQDKEEMKKTLEKLLREHEENIKELKRRLEELNEEHERNIRRSEETLKKLLKEAEDRLREIKK

SEQ ID NO: 8383 - protein, 187 aa, Artificial Sequence; identical to SEQ ID NO: 8382
  Synthetic

SEQ ID NO: 8384 - protein, 182 aa, Artificial Sequence
  Synthetic
EEAERVLKRIADLIEELKRHSEEVSRRSKKLLDDLSRHTEKVSKESEDLLRRLEELARRGEIRDEVLKTVLEDSKRLSKEDKERLEKVTRESKKLSDDDRKKVEEVEREIEKLARDVKRKRDEREIEERLRTLRRRLERMVEEIERLNEENLRRVEKRVRELEKENEDNLREAKKLLDEIRR

SEQ ID NO: 8385 - protein, 182 aa, Artificial Sequence; identical to SEQ ID NO: 8384
  Synthetic

SEQ ID NO: 8386 - protein, 182 aa, Artificial Sequence
  Synthetic
SEVEEVLKDIERLIKELREENKRSLDRSRRLAEDLERRNRESLRRIEKLLRELEKIARDLRDKDELRRILKELREEVERISEEDERLAEEVLREHEKINDEDRKKLRALLDTVRKLIEDVIRTEEVRKRAEDVLRRLEEVIKELEKTNEDAKRELKRLIDELRRTNEEVNKRLEERLDKIRE

SEQ ID NO: 8387 - protein, 182 aa, Artificial Sequence; identical to SEQ ID NO: 8386
  Synthetic

SEQ ID NO: 8388 - protein, 182 aa, Artificial Sequence
  Synthetic
SEVERVLKDIERLLKELEERNRRSLEESAKSTRKVEEDNKRSLDKSTELLKRLEEDAKDDRDKDRLRKRADELLETHRKINRDDDELLKKNHEDHERINRRDDELLRDVERKIRDIIRRVIRDEEVRKRAEDVRRRLEEILKRLKETNEDMKRENKRVLDELRKTNEDAEKKLRDLIRKLRE

SEQ ID NO: 8389 - protein, 182 aa, Artificial Sequence; identical to SEQ ID NO: 8388
  Synthetic

SEQ ID NO: 8390 - protein, 182 aa, Artificial Sequence
  Synthetic
SEVEKVLKEIDELIKDVERTNRESLEESERLLEKLKRENERTVERSERLAEELERLARELKDKDSLEKLLEEVERTHRKLNEDDRRKLEDILRRHKKINEDDERLLREVLKRVEDIIRRVIRTEEVKDRADKLLRRLEEMVEKIRRTNETLLRALEKLIRDLKRNNEEVEKRLREIAKKIRD

SEQ ID NO: 8391 - protein, 182 aa, Artificial Sequence; identical to SEQ ID NO: 8390
  Synthetic

SEQ ID NO: 8392 - protein, 186 aa, Artificial Sequence
  Synthetic
SEVDELLKRLKKLLEDDKRLAEELLKTIEKVNDDTRKRSEELLRRLERALEELEKLVRKVRGREELEKVLKDIEEELRTLLEDNERLLREDDKVVKDLIREVEKLNRETEEEVRRVVEEVKKKLKDVEEVKRRLEEVLREIKRLVDETRKELRRIDEESKRLAEKSRRDSRRVEERLRTLLEELRK

SEQ ID NO: 8393 - protein, 186 aa, Artificial Sequence; identical to SEQ ID NO: 8392
  Synthetic

SEQ ID NO: 8394 - protein, 186 aa, Artificial Sequence
  Synthetic
SEVEKLLEDMERLLKEDEELVRRLSKRSEEIVRDDRRRNKEILDEIRKLLEELKRLADRLEGREELEKLLKELEDRVDKLIKESEELNEESERRNKKLLDDLERLNRDTERKIEEIVKKVRDRLDKVKDVEERLRRAEERIRRAVERTRDHARRNHEKLKELVKETRESNDRLKKEIRKLLEELRK

SEQ ID NO: 8395 - protein, 186 aa, Artificial Sequence; identical to SEQ ID NO: 8394
  Synthetic

SEQ ID NO: 8396 - protein, 180 aa, Artificial Sequence
  Synthetic
EEEERIREVKKRSEDLLEELKRSNERVERESDKLAEEIRRKLEELARRADEVIRRLRARKETEELKKLADELRKLVDEVRKRAERLIREDKRMVEEVKRRSRELIERDKRVVETIERLLRAGEPTEKLLEDLKRINKETERLNRELLRDLERINEETRERIDRLLRELERMIDELRKRVD

SEQ ID NO: 8397 - protein, 180 aa, Artificial Sequence; identical to SEQ ID NO: 8396
  Synthetic

SEQ ID NO: 8398 - protein, 180 aa, Artificial Sequence
  Synthetic
SERERAEEIRKRSEDVVREMRESNKDVSRKSEELAKKLREDLKRVEKKVRELLEEIKREKRTEDIERLIEELKRVVEEVAKTLEELIKEDRKVVEDIIRRSEKIIRDNEKLVREVIELVKAGEPTEELLKRLEEISRRSRELNRRLLEDLKRINKETKERADKLLEDLERLLEDIKRRVD

SEQ ID NO: 8399 - protein, 180 aa, Artificial Sequence; identical to SEQ ID NO: 8398
  Synthetic

SEQ ID NO: 8400 - protein, 180 aa, Artificial Sequence
  Synthetic
DEDERLKEVEEESKKVADELRDRLRRLMEESRRRLKRLREEAEEIKRELDTIAEDLKREKDTEEIKKIITDLKRIIEKVRRDLERLIREDEEASKELKDRLEKIIEDNERVVREVKKLIKKGEPTEEILRRLEEISEESERRVEKLLRENKEINEETDRRVKELLERLKEVLERIERRVK

SEQ ID NO: 8401 - protein, 180 aa, Artificial Sequence; identical to SEQ ID NO: 8400
  Synthetic

SEQ ID NO: 8402 - protein, 180 aa, Artificial Sequence
  Synthetic
DERERLREVLERSRKLAEDLRRSNEELERRSRELAKELRKTNKELEKRLKDKADDLRREKNTKEIEDIIRRLEEELERVIRDSEDLIKKDEDISEEIKRRSEEIIRRNEKFVKEVEELIEAGEPTERLLEELERISEESKRRNDELLEKNERVNEETRRRNEELLDELRRLLEEVERRVK

SEQ ID NO: 8403 - protein, 180 aa, Artificial Sequence; identical to SEQ ID NO: 8402
  Synthetic

SEQ ID NO: 8404 - protein, 187 aa, Artificial Sequence
  Synthetic
DIEERIREVLRKARRVLERSEERSRELVERLRRVLEDSRRRTKRLTEEAKELLDEVRKRLDKDEAREKLRKLEELIKRLKEKLDEVDKRLADKVRRLSEMAKEVNDRLRKKIEDVERKLDEVRRRGGDKKLVEDLLREIEKIIKEIEDTTKRVVDELRRLLEEIKRTSDELEKEVRKLLEEIKRATD

SEQ ID NO: 8405 - protein, 187 aa, Artificial Sequence; identical to SEQ ID NO: 8404
  Synthetic

SEQ ID NO: 8406 - protein, 177 aa, Artificial Sequence
  Synthetic
STREALKELIDRLRDLVRRIRDKHRKLLEEIKRVLDESERRHRELIKRVEELLRDLARRVSEDILRELKRVLEELTKLSKKNIDDIRDVVRRLEELLRDNIRRIDEVLKRIRELAERGGEDVETIIRRAEEALKRLEDSSRKVEETIRKVLEDLRRSSEEVAERVRRVLERLEEKAQ

SEQ ID NO: 8407 - protein, 177 aa, Artificial Sequence; identical to SEQ ID NO: 8406
  Synthetic

SEQ ID NO: 8408 - protein, 177 aa, Artificial Sequence
  Synthetic
SSEERLRKVIEDLKRLAEESRKRHKELIDELRKAVERIERRHKKLLDEIKKVVDDIRRRVSEELLKRIEEVLDEIRKELEENIKRIRKVLDELRRTSEENIRRIEKVLRELEDLVRKGGEDVDTIIEEVKRVLEELKRSTEEVEKRVRDAIEELERSSEELARRIKEVLKRLEEETR

SEQ ID NO: 8409 - protein, 177 aa, Artificial Sequence; identical to SEQ ID NO: 8408
  Synthetic

SEQ ID NO: 8410 - protein, 181 aa, Artificial Sequence
  Synthetic
SAEEKLDRLRKEVERLSDETRKELERILKKVEDVIRETRRRAKELEEELRRLIRDIEEKLKDDERLKEALRRISEELRKLLEDLERINEKTRRDVERLIRELEKINEETKRRVDDIIRLVEAGVDIETVIREIERLLEEDRKAVEEILRRIEKLIEDDKRAVDRIVKEIKDILDKLREETR

SEQ ID NO: 8411 - protein, 181 aa, Artificial Sequence; identical to SEQ ID NO: 8410
  Synthetic

SEQ ID NO: 8412 - protein, 188 aa, Artificial Sequence
  Synthetic
DIEDELRKLEEEIRRVIEKWKRLTEENRRENERVIRKWDKLSKDLADEIRRVIEDARRKLKDERLKRKLEKLVRDLERILKKDKETVDKVRKELDDLDRRDEETMRRLEKELRDILKEVKRVIEEKKDIKELVKELVDRVKRLIREIEKEARRTSEENKDLLKKIEDDAKRSEDELRELIKEIKKRID

SEQ ID NO: 8413 - protein, 188 aa, Artificial Sequence; identical to SEQ ID NO: 8412
  Synthetic

SEQ ID NO: 8414 - protein, 188 aa, Artificial Sequence
  Synthetic
DIEDTLRKLAEDIKKVERDMEESNRRNREKNREVIEKWKKLSDDLERELEEVIEDARRKLKSRDATRKLEELVKELKDILREDRETVKKVKEELDKLDRESEELVRELVERLRKILEDVRREIEKKDKIRELVRKLIEDVRRLIEEIRRENKESSDRNKRLVEEIDERAKRSADELKRLLKEIRDRID

SEQ ID NO: 8415 - protein, 188 aa, Artificial Sequence; identical to SEQ ID NO: 8414
  Synthetic

SEQ ID NO: 8416 - protein, 188 aa, Artificial Sequence
  Synthetic
DIEEALDEVRKEIEEVIRRWKKLTRENEEENRKVIEDIRRRLDELRREIEKVIRDARRKLKSRDAKEKLDRLEEELRRILKDVERVIRELEERLKKLDEDDRREMERVVRELKRALDEMRKVIRDKTDIRELVKKLIDDIRKLIDEIRRDAERTSRDNKRLVEEIERTIEKLIREVKELLERIKEEID

SEQ ID NO: 8417 - protein, 188 aa, Artificial Sequence; identical to SEQ ID NO: 8416
  Synthetic

SEQ ID NO: 8418 - protein, 188 aa, Artificial Sequence
  Synthetic
DIEEILKKVEDDAREVIKEMRKSNEDNKRKNKKVIEEIERTLKKIEDDARRVIDEIEKKLKREELKKRVEELREELKEILDRMRREIEKLAEELKKLDEESDRLVKKLEDELKKVIDELEETIRRKDKSRELVKKLDDELKELIKKIRTDNKRSSERNDELVKEIRKRIEKLVREAKELLKRIREDID

SEQ ID NO: 8419 - protein, 188 aa, Artificial Sequence; identical to SEQ ID NO: 8418
  Synthetic

SEQ ID NO: 8420 - protein, 188 aa, Artificial Sequence
  Synthetic
SIEETLDELRKKIEEVIRRMKKSNDDNEKENREVIDRIRRTNEEIRKRAERVIEDARRKLKSEELTRVLKKLAERLEKILRESEKRVRELAEELKRLDEESKRLVEELVRELETILRELEKEIRRKRDVKERVDKLIREVEDLIRRIEEENKKSSEENKRLVRRIEKDNEDSIRELEKLIEDIRRTID

SEQ ID NO: 8421 - protein, 188 aa, Artificial Sequence; identical to SEQ ID NO: 8420
  Synthetic

SEQ ID NO: 8422 - protein, 185 aa, Artificial Sequence
  Synthetic
SLEELLEKVKREIDKVLERIERIVRKNAKENERVIREDERLLRELVKEIKEVEDRIRKRGLDKKDVDKLKEDLKRIIEEWKRLSEKLKRDSEKSLEELKELLKRIAETLKRVIDELRRVLREKKEDGDLMRKLLEEVKELIKRLEEEIEKASREDRRLVEEAKEKSKELAKRIKEELKRIEDEVR

SEQ ID NO: 8423 - protein, 185 aa, Artificial Sequence; identical to SEQ ID NO: 8422
  Synthetic

SEQ ID NO: 8424 - protein, 186 aa, Artificial Sequence
  Synthetic
DEVDDIIRKLKELIKELREKSKRISEENKRLVRRLEELSRRIIKEIKDLLEELKDRARKDRDKETLRKILREIEERVKRLAEESRRLSKTVTDESKKLMDKSRETSRRLEETVERLIRDLEEKLKDVEEVKDKLRRIKEEADKAIKDNEDLLRRNERENREAVKRNEELLKEVRREVEEVIRRTRK

SEQ ID NO: 8425 - protein, 186 aa, Artificial Sequence; identical to SEQ ID NO: 8424
  Synthetic

SEQ ID NO: 8426 - protein, 186 aa, Artificial Sequence
  Synthetic
SEVEEVIKRIKKLNKETEDAVREVIKRIEDSNEKLLRDVEELIKKIEKALRDLEDKARRVREREELERLLRELEEALEEIERRIRRLLEEDKRRLEELVRRVEKMLDDDRREVERLEKEVRERLKNVREVEELLRRVKRHTEEVVRRVERELRRIAEHVKEVEKTVRELVRRIREKIREVVERVRK

SEQ ID NO: 8427 - protein, 186 aa, Artificial Sequence; identical to SEQ ID NO: 8426
  Synthetic

SEQ ID NO: 8428 - protein, 178 aa, Artificial Sequence
  Synthetic
DEARELVKELEDLIREITKTVRRLLEESEELIKRIDDAVDDLRRRDEDLNREIKEEIEKRKRKEKLEKLIERLKESLERVKRTIEKLIRDLERLNEKLRRDVERLVAELEKILKKIKDAGLEERILRELEERVKELEKEAREILKRSEDETDKLREKAERILEDLERKNRRTMDEARR

SEQ ID NO: 8429 - protein, 178 aa, Artificial Sequence; identical to SEQ ID NO: 8428
  Synthetic

SEQ ID NO: 8430 - protein, 178 aa, Artificial Sequence
  Synthetic
SEVEELVERVKRLIDEIRKRVTDSVEESKRLIKEIKEEVDRLAEEDKRLNERIKETIRRRKEKEILERLREELDKSLERVEREIEKLIRRLEKLNKESKDRSEELVRELEKLLEKVKTDGLEERIVKKLEEEIRKIIKEIRELNKRSEDETKKIVDEARKILEDLRRENEDTKRKITE

SEQ ID NO: 8431 - protein, 178 aa, Artificial Sequence; identical to SEQ ID NO: 8430
  Synthetic

SEQ ID NO: 8432 - protein, 178 aa, Artificial Sequence
  Synthetic
SEVEDLAKRIEDLIRRILRENERSLEESKRLIDEIRKRIEDLLRRSKELIDRIREEVRERKREELLRKLKEDLDRANREVEERIKKLIKDLEDLNKRSKDESRRLIEELERILEELERRGLEKRILDELRKAVKKLEDDSRRLNRESEERTKKLKKELDELLKKSKDETKKLVEDLRT

SEQ ID NO: 8433 - protein, 178 aa, Artificial Sequence; identical to SEQ ID NO: 8432
  Synthetic

SEQ ID NO: 8434 - protein, 172 aa, Artificial Sequence
  Synthetic
SEVEKLLRELEDVIRRLREDVKRIVEEDERLNKRLNDELRRLSEKNDRLNDRIRREVTDKDKAMKALDDSNKELEKVIREILELLKRSLDKARKVLEDIEKTLRDILRELEKRLEDKEKVKRLRELVKKVIEDMERILRRLEKANRESAERAKDVLRRNHKKDEDSKRELER

SEQ ID NO: 8435 - protein, 172 aa, Artificial Sequence; identical to SEQ ID NO: 8434
  Synthetic

SEQ ID NO: 8436 - protein, 172 aa, Artificial Sequence
  Synthetic
DRVREIVERVERVIRDILRTVEKLSEENKDLNRRLTEKIRDLERRDRELNKRLRDEVTDKDEAKKRLEDSLKRAREVVERIRKTLEDSNEKIRKVIEDLVRRLEELLDRARKELSVKEIVEDLRRKVEKVKRDAEKLLEDNHRRDRRNLREIEKIVEELKRRNEKTLRDLTK

SEQ ID NO: 8437 - protein, 172 aa, Artificial Sequence; identical to SEQ ID NO: 8436
  Synthetic

SEQ ID NO: 8438 - protein, 172 aa, Artificial Sequence
  Synthetic
SEVEKLEEEVKEVIERLLRTVRDLSRRNEELNKRLTEDNERILKEDEDLNEELERRVTDADDAERLLRDSIRRWRELSKRIKDKLDRSNEELRRVIEEIKRELERILEELRKRVEDKDVLRKLKKEAEDAIKEAEDILRENHEKDKKNKEDSEKLLRDLERRNEETLRRLRK

SEQ ID NO: 8439 - protein, 172 aa, Artificial Sequence; identical to SEQ ID NO: 8438
  Synthetic

SEQ ID NO: 8440 - protein, 182 aa, Artificial Sequence
  Synthetic
RIEEILETLREELRTVLKKSKEILDELRKENKESIDRSKEILDRLRDEIRRILREIREKRVSRADEIERKLREAIKRAERLHEESKKRSEKSIRELEKLHEETRRRLKEAADELEKLAREGIDDEELKRAADKVKKLIKELDEENKKARDDDKRLNKKLNKDNDDLRREVEELLKRLRDEAE

SEQ ID NO: 8441 - protein, 182 aa, Artificial Sequence; identical to SEQ ID NO: 8440
  Synthetic

SEQ ID NO: 8442 - protein, 184 aa, Artificial Sequence
  Synthetic
RIEDLVRDNKRKNDENTKRHERIVERLEEELRELVKRHEEDVRRLRKELEDLKRDAERKGIDERVLRKIEKLIREIEERLRRSNETLRKLAEDLIRELEKSNRDLRTLSERLKERLDELRRNNADDKKVEDLDRDNERLNRELTRHLEDLVRRVKELLRRMEEHLRELAERVKKLLDELRKEAT

SEQ ID NO: 8443 - protein, 184 aa, Artificial Sequence; identical to SEQ ID NO: 8442
  Synthetic

SEQ ID NO: 8444 - protein, 185 aa, Artificial Sequence
  Synthetic
SDVEELAERVRRLSEEHAELVKRIVETSKRLNDDLRRMVKEIADRVRRLLEDIERKVREDRDKDTLKKLVDELEERIRRLIDELRRLVRKVEELDRRLAEELRRTLEELIRRVRELLEDLKRRVDTEDVRKIIEDLRRHLEENRERVERIIRELRRLTEKTKKELEDIARELEKLVDELREEVRR

SEQ ID NO: 8445 - protein, 185 aa, Artificial Sequence; identical to SEQ ID NO: 8444
  Synthetic

SEQ ID NO: 8446 - protein, 185 aa, Artificial Sequence
  Synthetic
SEVEKAEEDIRRLLKEVKDMDKKIVDDDERLNRELERTVRELAKEIEKLIRDLEERVRKERDKRTLDDVLRKLEERLREILERIKKAVEDVKRASEKLERESKELVDRLRKEVERIVKEIRDRVDDKDVKKIIKELEEELEKIAKESEESIKRLRKENRDSEERLRKILEKLKKDLEDVKRELER

SEQ ID NO: 8447 - protein, 185 aa, Artificial Sequence; identical to SEQ ID NO: 8446
  Synthetic

SEQ ID NO: 8448 - protein, 185 aa, Artificial Sequence
  Synthetic
SDVEDVVRKIRELIRENLKRSKEIADENRRLNTENRERSKTLEEEVRRLLEEVKERAERLRGREEIKRLVDELRKAVEDVVKRIEDIDRRSEEESKKLEERIRRLDEESERRLRTLIEELKKREDREEVRRILEKLRDDLRKLNETNRRIIKELRERNEKSNRDNRKILEELKDRLKKLEDELRR

SEQ ID NO: 8449 - protein, 185 aa, Artificial Sequence; identical to SEQ ID NO: 8448
  Synthetic

SEQ ID NO: 8450 - protein, 179 aa, Artificial Sequence
  Synthetic
DEVDEVDKRSKETLKKIEDDARRVLEEYERTLEKIKRDVDRVLKESEETVRKLRADGRLKEEVADTVRRVHEKAKRKIEEAKKDSERVLEEVKRTIERLKEELEREHTRVREEIKAGRSEKELEDLVRELEEINKRLEEELRKLVEELRRHLEELRDELRKLVEELRKINEELEDRLTK

SEQ ID NO: 8451 - protein, 179 aa, Artificial Sequence; identical to SEQ ID NO: 8450
  Synthetic

SEQ ID NO: 8452 - protein, 188 aa, Artificial Sequence
  Synthetic
SEMEDLKRVSDEVKKELEDLNRKSAKVSKEVEEEAKRLNRESREVVRRLKEELEKLERDRASEEELKRVIDKVKEVLDDLKRKHEDLNRRNRELLRKLEKEHRDLNEKNKELLERLDRKVKEGNLKKEVADELKKILDTHRKVDKEAKDRSEKLVRDHREVDKDVKRESDEILKRAKDTLDEIRERLR

SEQ ID NO: 8453 - protein, 188 aa, Artificial Sequence; identical to SEQ ID NO: 8452
  Synthetic

SEQ ID NO: 8454 - protein, 176 aa, Artificial Sequence
  Synthetic
SELEKILKEIEEELKRVKERLERLHREHERLLRDVTRKLRKLLRDHREVLERVREELRRRRKDVREVEERNRKTHEDLEREVRKAERELEERNERLKRELDDIARKLEEELEDLKRRNLPREDLERTLRRIKEEVRKVERKAKEVLRETREKLKRLLERAREVLDENKKRLDDVAT

SEQ ID NO: 8455 - protein, 176 aa, Artificial Sequence; identical to SEQ ID NO: 8454
  Synthetic

SEQ ID NO: 8456 - protein, 184 aa, Artificial Sequence
  Synthetic
SLEDIRRRLRELVRRLEEELRRSHEELERLVRDLERRLRESLRKLEELVDRLKKEIEKRGRDRRELEKIERDIKKILDEYRERLKELVTRLRDLLRRHRERLEELRKRIEELLRRIEEELRRGTDDDTARRLLEEAKKELDRIKEENERALRKIKDVIRKIDEESKRLNKEVADLVKKIEDRIR

SEQ ID NO: 8457 - protein, 184 aa, Artificial Sequence; identical to SEQ ID NO: 8456
  Synthetic

SEQ ID NO: 8458 - protein, 184 aa, Artificial Sequence
  Synthetic
DLEDIVREIEKLLRDLERKAREIHERDERLARDLERKHRDIIREIERLLDELRERVERLPVDDELRKEIRKRLEDIKDLLRRSTEKLKKLKRESEEKNKKLIRELKKVLDDIRREVEDIRRKPVDRKKVEEELERVRRIIKELERRLRELHKENKKLLDEILEESKRLAEEVRKTIEDIKRKIK

SEQ ID NO: 8459 - protein, 184 aa, Artificial Sequence; identical to SEQ ID NO: 8458
  Synthetic

SEQ ID NO: 8460 - protein, 183 aa, Artificial Sequence
  Synthetic
SEVEDLLRRDRELNREHKRLLEEASKKNKEELERVLEKVKELLERVKKRLDEAKEALERGEVDDEVLKALEEELRKLLKELKDTLRKLNDDTKKLIDKLKEHNKELEERSRELEKRLRDKTGDDERLERVLRESRKLNKESHETLKELIDRNRKLNKELEEAVKKIEEEIKKLLKELKEEKDR

SEQ ID NO: 8461 - protein, 183 aa, Artificial Sequence; identical to SEQ ID NO: 8460
  Synthetic

SEQ ID NO: 8462 - protein, 183 aa, Artificial Sequence
  Synthetic
SEVEKLLREDRELNKRHVEKVRELSERNKELLERHEEKLKKVAKEIEDRLRRLEEMLRRGEADEKVLKDLAKRIRDLLRDLTRHNKELNEETERLLRELEDHNRRLKETSDRLRERLRRKTGDTDRLKRVEEESEELNKRSHETLRRLVEENKKRNKELHERVERIKRRLEKLLRELEEEIRK

SEQ ID NO: 8463 - protein, 183 aa, Artificial Sequence; identical to SEQ ID NO: 8462
  Synthetic

SEQ ID NO: 8464 - protein, 183 aa, Artificial Sequence
  Synthetic
SEVEELLDEDRKLNEELTKSAKRLTDENKKLLEDMKRKAEELKKRVDELLKEVTDVLRRGELDEEKLKTLADEIKKLLDKLREDLKRLDERSEELLKRLREEVERLERRSKELAKRLEDKTGKTDRLERVLRESRKLNEDSKKRLEELIKENKDDNDRLREDLERIVRELEKRLDKLRKDTET

SEQ ID NO: 8465 - protein, 183 aa, Artificial Sequence; identical to SEQ ID NO: 8464
  Synthetic

SEQ ID NO: 8466 - protein, 184 aa, Artificial Sequence
  Synthetic
KELEDLLRRIKRLIDENRRLSKEVLEEVRKLSEKHKKEVEDILKEIKELIEEALRRIERDGPREELLRRLAERVRKLTEELRRSLKELRKRIEDLERDLDRLDKESEKELRKIEEKARRDNSVPKERLDRILKTLRELLRKLREDNERIRREIREIVKRNSDELARIEEELRKLLDDLAKKAEE

SEQ ID NO: 8467 - protein, 184 aa, Artificial Sequence; identical to SEQ ID NO: 8466
  Synthetic

SEQ ID NO: 8468 - protein, 184 aa, Artificial Sequence
  Synthetic
KELEDVLKEVEELSRRHKRRAERVSEENRKLLRRLKEEARKILEDIRRLLKKLEERVRRDGPRKEELDEARKRLKDLARRLKELLDRLDRTTEELARDLERTLRELEERIRRIAEDLRRRQSVDRERLKRILDEIRRIVEKNKRDLERLLRENEELNKRLREELRRILEEIEELLRELEERLRK

SEQ ID NO: 8469 - protein, 184 aa, Artificial Sequence; identical to SEQ ID NO: 8468
  Synthetic

SEQ ID NO: 8470 - protein, 176 aa, Artificial Sequence
  Synthetic
SEAEEALKELKETSDRHKEDLDRLHEEDRRTNEEVEKELRKLVDEAKKKLDRVREIVEEGRGREELLKKLREDLRRIEEEIKRTLDELKRKSEEIEERVKRTTRELEKKLEDLERANLVDEELLRRLEEIVRDNKRRVEEILERNRRLNEESEKKVRDIIKKLRDDLERLARELEK

SEQ ID NO: 8471 - protein, 176 aa, Artificial Sequence; identical to SEQ ID NO: 8470
  Synthetic

SEQ ID NO: 8472 - protein, 176 aa, Artificial Sequence
  Synthetic
SEAEEALKELKRTSDEHRKRLEDLHRRDKKLNDDSKRRLDELLKRDEDTNRTVLDIARQGKAREELLKELKERTRRLHEDNKRLLRELEKRSKEIEDEIRDTLEKLKRKLDELRKANVVDEELLRTLEKIVEDNAREVTEIIKKNRKLNDDSRREHERINDESRRLNEETEKRLRD

SEQ ID NO: 8473 - protein, 176 aa, Artificial Sequence; identical to SEQ ID NO: 8472
  Synthetic

SEQ ID NO: 8474 - protein, 183 aa, Artificial Sequence
  Synthetic
DELEEILRRVDELIKTIEEELKKIEKRVKELLETHRELNKRLLDDHRRLAEEVKKANLDRRDAERLMREMEKKNEEVRKRLEESLERVKDTLRKIEKKLRELAERLRRELEKLRDDLRRRGSDRDRVEDVLRKIAEKIKRLEDRIKEVLDKLRKLAKELEDESRKVLDDSNKLIERVKRELKR

SEQ ID NO: 8475 - protein, 183 aa, Artificial Sequence; identical to SEQ ID NO: 8474
  Synthetic

SEQ ID NO: 8476 - protein, 185 aa, Artificial Sequence
  Synthetic
DTERVVTEIKKTNDELKRRHEKVVEDDRRLLEELRRRHERVVREVERLLRELKERVDRRAKDKRELKKRLKELKDRIRKELEDLTRKHEDLDRRVEDEHRKLSEEHEKVHREIRERLEDIRRKKVPREVLKKLLDDNRKIIEDLTRKNEKLHEDSKRIIEKIDDENREILRRVEEIVRRIEEELN

SEQ ID NO: 8477 - protein, 185 aa, Artificial Sequence; identical to SEQ ID NO: 8476
  Synthetic

SEQ ID NO: 8478 - protein, 180 aa, Artificial Sequence
  Synthetic
SAEDVKRRIKESADRIRKRLREALERAKKLHTDNEEENKRVNDEIKKRVEEIRRRIPDGEKAKELEDRLRKLLEDSKRDDDRSRKESRELIERTREVLERLARLLDELERRLDEVRKKPTDEKLLRELERDVRRLEREITEVVKRLEDEHKRASERNKRLLEEIKDRVRKLIEEAEERRK

SEQ ID NO: 8479 - protein, 180 aa, Artificial Sequence; identical to SEQ ID NO: 8478
  Synthetic

SEQ ID NO: 8480 - protein, 178 aa, Artificial Sequence
  Synthetic
EEVERVRRTIDELSKENEKALKEVEERIKKLSDENEKAVRKAEEDNERLNRTAERLKRSNVSEDTLRRILEEVRRATEDLRRKLEDINRELRERVKRLIEEIREINKRLDDELRRIEEEGVDEKVLRDIRKKIKENHEKNERVIREIERLLKENEERNEEVIRRIKESNRKTEKDLTD

SEQ ID NO: 8481 - protein, 178 aa, Artificial Sequence; identical to SEQ ID NO: 8480
  Synthetic

SEQ ID NO: 8482 - protein, 178 aa, Artificial Sequence
  Synthetic
SEVEEVERRIDRLSKENRRVLEEAKRRIKKLSDENKRMLEEARKRNEKLNREVKKLKKSNVDEETLRRKLKEVKERTDKLRKEIKEINEKLAEDVKRIEDEIREINERLDRSLKKIEDDGVDEKVLRDIREKAKRNHDANEKVIREIRDILRRNNEENKRVIEEIDKSNKDTEDELRK

SEQ ID NO: 8483 - protein, 178 aa, Artificial Sequence; identical to SEQ ID NO: 8482
  Synthetic

SEQ ID NO: 8484 - protein, 178 aa, Artificial Sequence
  Synthetic
REVEEVKKEIKKLSDENKEVLERARKRIEDLSRENEDVLRRLKERNEDLNRRVRELKERNVSEDELEKILRELEKKTEELADEIRRINEDLDRKLREIEKEIEEINEKLKKKLEEIERRGVDEEVLRDIRRELKENHDENRKVIEDVRRIAEENHRRNKRVIDEIRRSNKETVDELRK

SEQ ID NO: 8485 - protein, 178 aa, Artificial Sequence; identical to SEQ ID NO: 8484
  Synthetic

SEQ ID NO: 8486 - protein, 184 aa, Artificial Sequence
  Synthetic
RAEELRKEIEEIIKKNKKENEDVLREDRRRLKELKEEIEKVVREDRRTLEELEERLRRSGLPEEEVERIIRELRDEHRRVEERAEELRRKLDERHKEVEEESERLRKEVRDDKRRLDERLKRNSTEEVLKEIRERVEKLSEKNKRALEKWKRDSERLSREVERELEEWKKRSKRLAEEVEEATR

SEQ ID NO: 8487 - protein, 184 aa, Artificial Sequence; identical to SEQ ID NO: 8486
  Synthetic

SEQ ID NO: 8488 - protein, 186 aa, Artificial Sequence
  Synthetic
DLEELEREVEKKLKELEDRVRKVIEESKTELKKLEEELRENSREVRDILRRLEEDVRRKVKDDEDLKRKLRKLKEDMERVNEEVEKRFRDLARELRKHARDLEREAKRLKEEVEETLRRVRKKNVEDKRLLEELRRRLDRVRKEVERLIKEHRETTDELRKRVEKLSEDHRREVEKLAKTVKDELK

SEQ ID NO: 8489 - protein, 186 aa, Artificial Sequence; identical to SEQ ID NO: 8488
  Synthetic

SEQ ID NO: 8490 - protein, 178 aa, Artificial Sequence
  Synthetic
SRAEKIREDIRRLRKENEDRIKEIEDEFRKLLEEHERKNKEIEERVRRLVKRIEDEIRRKNVPKDEVKRIRDDIRRLEKRAKEVHERSKRRLDELRERFKRLEKRLREIHEEIERELRKRGLTDELAKRVREVSEDVNRRLDKIMKDLRRVIKELDEESKRLLEEIKRRMEEILEELR

SEQ ID NO: 8491 - protein, 178 aa, Artificial Sequence; identical to SEQ ID NO: 8490
  Synthetic

SEQ ID NO: 8492 - protein, 180 aa, Artificial Sequence
  Synthetic
SEEEKLAKDNERLVREHEEESKKLLKTIRDLSEEHKRDLKRAMEENKEKVDRLRDMLKRGEVDDRVIEELKRDSERLLEELRKRSKELKDEIKKRLEDLKKHLDDLKRDSRRLLKELVDKKKRRPEEIATKSEELHKELEETNERIAREVEKLEKENDEILEEIADRSRRLHEDLDRERK

SEQ ID NO: 8493 - protein, 180 aa, Artificial Sequence; identical to SEQ ID NO: 8492
  Synthetic

SEQ ID NO: 8494 - protein, 178 aa, Artificial Sequence
  Synthetic
DELEEVLRTIEKLVEDHNRELERVLRRVKELADRHREESERVAREIKKLVDDARRLVEERGPDEEVLRDLERRVRELVDRLRRHLEELEKELDKLKKDLKRSLEELERRVKEIADRLPETDEVRRIRERVKELLDRNRERLERIEREIDRLLEDLKRKNEKIEREVRRLLAKLKEEAR

SEQ ID NO: 8495 - protein, 178 aa, Artificial Sequence; identical to SEQ ID NO: 8494
  Synthetic

SEQ ID NO: 8496 - protein, 178 aa, Artificial Sequence
  Synthetic
SELEKIVEENRRLVKEHNERLKRILDELRELAKRHEDRSRKAMKENEELVRTVLELMKRDGPDERVLRELRKRSKDIVDDLRRHLKELSDTARKLIEEIRKSLEELERRTKKLADDLPETEKVRKIREESKRLHETNRRRVEKIEEEIRRLLKRLEDTNRDIERRSKKLHEDLEREAR

SEQ ID NO: 8497 - protein, 178 aa, Artificial Sequence; identical to SEQ ID NO: 8496
  Synthetic

SEQ ID NO: 8498 - protein, 178 aa, Artificial Sequence
  Synthetic
SELDKVMRDNDRLVKEHAEVSKELLDRLKKLAEDHKKRSEEVLRENKRLVDEVRRLAKERGPRDEVLDTLRKESKKIKEELEKHLEELSREAEKLIRELEEHLKKLREETKRLRDALPETEKVRKIARRSDDLHRELKERNDRIKREIERLLEELKRTNDKIVEDSKRLHDDLEREAR

SEQ ID NO: 8499 - protein, 178 aa, Artificial Sequence; identical to SEQ ID NO: 8498
  Synthetic

SEQ ID NO: 8500 - protein, 178 aa, Artificial Sequence
  Synthetic
DELEEIRKTIEELSKENKKKLEEVMKEVEELARRHEKRSRDLLRRLKKLVDELRDRVEKTGPDKDDLKRLEDELRRLKEDLKRHLTELEKRLRRLSEEMKKHHEELEKRVRDLERALREEERVRKISEDVRKLLEDNKRIAERIDERIKELLKRLEDTNRRIEEEIDRLLEELKREAD

SEQ ID NO: 8501 - protein, 178 aa, Artificial Sequence; identical to SEQ ID NO: 8500
  Synthetic

SEQ ID NO: 8502 - protein, 179 aa, Artificial Sequence
  Synthetic
DELDDLLRRAKETSDRHKETLKKILDEMREEVKRHNRDLERILEEVKRLIDEVRKANSKDETLIRELRKRIEELRERIERSLRELRRKLEELERRIRDTLRKLEETLRRLEEELDRRGVPREDVKRIKETMKKLLDENRTEVEKIKREADRLLEENRRLVKEIEDTIRELLKRLEDERR

SEQ ID NO: 8503 - protein, 179 aa, Artificial Sequence; identical to SEQ ID NO: 8502
  Synthetic

SEQ ID NO: 8504 - protein, 178 aa, Artificial Sequence
  Synthetic
SKKETIKKDAEEALKRSKKKLDELKERLRKVMRETEERLRRLEKELRDLAREIREKIKKRRVDEDKVKKIEERLKRLEDKLREVEKRLREKYRELEKEVDKVVEKLERDYRRLKDKLEKEPADDRLRKEVEDLNRETDKVIEKLREDIDRLDKESEEVIRRLKDEIRRLFEEIDRRLR

SEQ ID NO: 8505 - protein, 178 aa, Artificial Sequence; identical to SEQ ID NO: 8504
  Synthetic

SEQ ID NO: 8506 - protein, 183 aa, Artificial Sequence
  Synthetic
SELEEVKERVDRLIREVEKMNRDSERRVKKLIDDVRRENRRTEEDVRRLVKRAEEIVRKDGKIDEKVLRELEERLRRLKEENDKLLTELEKRLRKLKRENDELLRELKKRLEDLKRELDKDGLEKEKVDRLKKEADDLLRKIKEDNERITEKVKELLERLRKNNEEIKREADRLLEELRRRVK

SEQ ID NO: 8507 - protein, 183 aa, Artificial Sequence; identical to SEQ ID NO: 8506
  Synthetic

SEQ ID NO: 8508 - protein, 176 aa, Artificial Sequence
  Synthetic
SELEELDKRITELSEEIKRRLEELLRRNEDLSRRIEEAIRRILKRNEDVIRDIKRKNKKDERLLRELKKLSDENRKRLEELHRRHAEHVKRTEDELRELHREHKEAVDDIRRRMGREDKKVRDIEEKIERLNRELEKIAKEIRERTERLNKRLEELIREVDERNRDLLRRLEEEVK

SEQ ID NO: 8509 - protein, 176 aa, Artificial Sequence; identical to SEQ ID NO: 8508
  Synthetic

SEQ ID NO: 8510 - protein, 182 aa, Artificial Sequence
  Synthetic
KDEEDARRKLEELRELARRDIERNKRELERLRREIEKDEEDNEEVIKRLRERVEELRRRQTDKDRAREVLEELKRLIDELRRRNEETKEKLKRIIDEIRKRNEEMEERLRRIIEEIEKKLGREDESLKRLKEELEKLLRDYKKKLDDSDKELRDLLAEYDDRLTRSDKRLRDLLKEAREKSK

SEQ ID NO: 8511 - protein, 182 aa, Artificial Sequence; identical to SEQ ID NO: 8510
  Synthetic

SEQ ID NO: 8512 - protein, 186 aa, Artificial Sequence
  Synthetic
DTAERAEEELERSDRELKETLRRAEEELKRSHKELERIVERARRELRRLAEELEEVIRRKKLDEKEVRKLEEILKDVERRVDELLDTLRKISKELEDRMRELDKELKKDSDDIRRRLDELKKREKEEETLRRKLERLLERHKKVVDDVERTLRDLLERHKEVVERVREKLTDLLRKLKKVIDDVRR

SEQ ID NO: 8513 - protein, 186 aa, Artificial Sequence; identical to SEQ ID NO: 8512
  Synthetic

SEQ ID NO: 8514 - protein, 179 aa, Artificial Sequence
  Synthetic
SELETIKKRAEELSKESEDILRDIERKLRKLSEESKDILRRLKEELEKLHKELVDKKGRETERIRELKKRNRENLERLRDELRKLNEELERKLREIEERLKELNRKLEKKEEELRRRPTDEELEKELEEVLTEYREVVERLADELRRLLKKYEDDVRRLEEHARRDLEKLDRDIKEEER

SEQ ID NO: 8515 - protein, 179 aa, Artificial Sequence; identical to SEQ ID NO: 8514
  Synthetic

SEQ ID NO: 8516 - protein, 179 aa, Artificial Sequence
  Synthetic
SKLDDLLRKIERLVTESLRRLRKTNEDAKRLLERSVRELEKSNKEIRDLVKEIKERNSKDERLLREAERVLDELRKRHEENHRRLEEELRKLLEDHEKNHRELKKVLDKIDEDVKADGVDKKKVDELRERLRELLKRHRDAVEKNRRDLEKLREDHRRLVEKNKRDLDKLKEELDRTKK

SEQ ID NO: 8517 - protein, 179 aa, Artificial Sequence; identical to SEQ ID NO: 8516
  Synthetic

SEQ ID NO: 8518 - protein, 179 aa, Artificial Sequence
  Synthetic
SELDELLKRLEELVREIIKRLRDSNRRAKEVVDRSVKRLEESNRTLRELIKDVKDKNEEDERLDRELEERVRELEEEHKENHKRLEETLRKLEKEHRDLLREAKEMLKKLEEELKKRGAPEEKLRRIKRRIDELEKTLRKIIKDNTDNLRKLTEDHRRLVEKNKRDLEKLEEELKRRRK

SEQ ID NO: 8519 - protein, 179 aa, Artificial Sequence; identical to SEQ ID NO: 8518
  Synthetic

SEQ ID NO: 8520 - protein, 179 aa, Artificial Sequence
  Synthetic
SKLDELLERIREEVKRSVKRLEDSNKEIKRLMEESADELRRSNKELRDAVRDLKRKNSKDETLTRRLEKLIEDLERRHKRNHEELKRVLDELAEEHKRNHKELERVLREIKERVKADGAPEEKVRRLDKVLEDLRREHEKIVRDNEENLRRLLERHKRLVDKNKEDAERLLRELRETVR

SEQ ID NO: 8521 - protein, 179 aa, Artificial Sequence; identical to SEQ ID NO: 8520
  Synthetic

SEQ ID NO: 8522 - protein, 183 aa, Artificial Sequence
  Synthetic
SELEELLKRLRDLIERIVKRLRELSKESEDLIRRIERTIEKLSEDSERAIEEILRRIDKGTSEDTARRLLERFKELNKRSEDELEKLKRELEKLDKRSDDELREIKEELRRMVREVRERVRKVTEDRLREVEEEAKKLEKRIEDMIRKHKETNKRLKEELDKLVKEHKDRNRKLLEELKKRAT

SEQ ID NO: 8523 - protein, 183 aa, Artificial Sequence; identical to SEQ ID NO: 8522
  Synthetic

SEQ ID NO: 8524 - protein, 178 aa, Artificial Sequence
  Synthetic
SEIEEVIERLDDTMRRIEERIRDTNRRLKKVIDDSKRRNERTNREVRKTIEKLTRELERDGRGGELAKRIREVLEELKRRSEELEKENRRLLDELRKESEDLADEIRKTERKLEDDLRKADAREEVKRRLEELRRRIEKMLEEHRESLRRLEEELEESHKRHKDTLRKLSKELEEKLK

SEQ ID NO: 8525 - protein, 178 aa, Artificial Sequence; identical to SEQ ID NO: 8524
  Synthetic

SEQ ID NO: 8526 - protein, 182 aa, Artificial Sequence
  Synthetic
DEVDEVLKRVDELLKRHEETNKRLEEEIRKIHEENKRTIEELLKEVRKRAEEVERLVRRDGPREEEIRKIEEALKRLLRELEKHLDRSRKRLKKLLDENRRHLRELERELDKIEEDLRRNRVPEEELKRVKERLKEIRKRAKESHDRLRETVKELIDRNRKLLRELEEELRKIEEKIREDAR

SEQ ID NO: 8527 - protein, 182 aa, Artificial Sequence; identical to SEQ ID NO: 8526
  Synthetic

SEQ ID NO: 8528 - protein, 173 aa, Artificial Sequence
  Synthetic
SEEDELRETAKRIREEVKKSIEENRELAKRITDEVRELLERNKRRIEEVKERLERSGVDERVLREAERVLRELKKRHEDLLEELKKAIKRLEDKHRKVLKELEDEIRELERLSKRKDEDDLRRRLEELLKRLRDESRKVNEDLKRLVDELRRLSKEMNEELKELEDRVREKER

SEQ ID NO: 8529 - protein, 173 aa, Artificial Sequence; identical to SEQ ID NO: 8528
  Synthetic

SEQ ID NO: 8530 - protein, 182 aa, Artificial Sequence
  Synthetic
SEEDEVREDNKRIVEEVERLLKEIEDNNREITREAEELLKRLEEEARRLMEEIRRSKSGDKRLLEELIERLKEVLTELERRLRELKEENEEVLTRLRREVEKIKRENKELLDRVRELRKKVRDEELLRRLRDMNRRSKERADRLIEEAKKENDRSSKRVRDLIREVDEILKEVKKRVEDVTT

SEQ ID NO: 8531 - protein, 182 aa, Artificial Sequence; identical to SEQ ID NO: 8530
  Synthetic

SEQ ID NO: 8532 - protein, 177 aa, Artificial Sequence
  Synthetic
SEAEKVVEELKKLLREVEKKIRDHTEDVKRILEELERRLRKHSEEVRRTAKELKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 8533 - protein, 177 aa, Artificial Sequence; identical to SEQ ID NO: 8532
  Synthetic

SEQ ID NO: 8534 - protein, 177 aa, Artificial Sequence
  Synthetic
SEVEDVIRKLRRKAEDLTRRLKEHTDDVKRLMEELSKDIKDHTREVKRIAREAKEKNRDRETLRRILEELRRSNEELKRRLDEALEELRKSNEELRERLERVLRDMRRLLEELKDRVDEEVLRDLERVLRDIERRLRELLRRNEEVLDRIRRTLEDLHRKNEEVLREIERDLRERER

SEQ ID NO: 8535 - protein, 177 aa, Artificial Sequence; identical to SEQ ID NO: 8534
  Synthetic

SEQ ID NO: 8536 - protein, 177 aa, Artificial Sequence
  Synthetic
SEVEDVIRRLKKKLRELVERIREHTKRVRDLARKLEEEIKRHTEEVKRIADEAKKRRSDEETLRRIEEELKKSNEKLERKLRKVVKELAESNKRLREELKKVVDELRKEVESLRDRVSDELLKRLEDVLRKIRKDLEELLRKNNRDLEEIKKRLEELHRRNRETLERIRKDLEEDER

SEQ ID NO: 8537 - protein, 177 aa, Artificial Sequence; identical to SEQ ID NO: 8536
  Synthetic

SEQ ID NO: 8538 - protein, 182 aa, Artificial Sequence
  Synthetic
SEIEEVLERIKKLLDELRKESRKLLEDHKKRAEELEEKARRLSERHKELLDRLKEVVDRDGPRDETLERLRRESEKTKKEMEDTIRRVEEESEETIRRHRRSVREVRERLKELRRELDKANLPEEMLKRAEDLLRRIDEELKRSHEELKELSDRIRERLERLLRTLEELSKEIDKRADDLRK

SEQ ID NO: 8539 - protein, 182 aa, Artificial Sequence; identical to SEQ ID NO: 8538
  Synthetic

SEQ ID NO: 8540 - protein, 182 aa, Artificial Sequence
  Synthetic
SEIERVLEELRKLLEELRRESKKLLDELRKLLEDARRESEKLLRELKDLLRRAEELVKRDGPDKDTLDKVRKRMEELHRTHEKILRELKRRADELREDHRRKLETIEKRLKEIEDELRKANLPEKVLDELRRELDKIREDLKKSHRELEELIKKIRTELDKSNRKLEELLKRIEERLDEMRR

SEQ ID NO: 8541 - protein, 182 aa, Artificial Sequence; identical to SEQ ID NO: 8540
  Synthetic

SEQ ID NO: 8542 - protein, 182 aa, Artificial Sequence
  Synthetic
SEAEKVLEELKKLLRDLEETSKRVLREIRELLKEAREKSKRLLDRLRKLARDLKELVRRDGPVDEAIRRVKEELERLSREHRKMVEEIKRRLEELHKRHKKKLEDIRKTLDDIKKELERTNLPKEVLDRIKRLLEEIERELERSNKELEDLLRKIEEDLERSHRELEKLIREILKELEDARK

SEQ ID NO: 8543 - protein, 182 aa, Artificial Sequence; identical to SEQ ID NO: 8542
  Synthetic

SEQ ID NO: 8544 - protein, 177 aa, Artificial Sequence
  Synthetic
DAEERLRKLLDDIRRELKRLTEETRKSLEKIKRDNDELEKKLRKLNEDSDRRLKEANVDERIKEEMERSRRELEEKNRRSRKRIEDMARRVEETHKRIEDDLRRLAERIKELEARGIDEKTIEDLLRELEKALRDLEKEVREINKELKRVLDEIAKTHEDLLKKHEELLRRVEERAR

SEQ ID NO: 8545 - protein, 177 aa, Artificial Sequence; identical to SEQ ID NO: 8544
  Synthetic

SEQ ID NO: 8546 - protein, 178 aa, Artificial Sequence
  Synthetic
DLERELEKLLKDIKEELDKLIRTNEETLKEIEREVRKLLKRNKELLDRIREEVRKTGTDEDEAEKLLRDLKRSVEKLEREHREVRREIEEKLERLRRLHEEIRKRIRDLLEDAKRRKVPKEVVDRILKEARELLERIREENRRTLEDLRRILEDLRRRNKRHLDELRRVLKELRDKRK

SEQ ID NO: 8547 - protein, 178 aa, Artificial Sequence; identical to SEQ ID NO: 8546
  Synthetic

SEQ ID NO: 8548 - protein, 178 aa, Artificial Sequence
  Synthetic
SLEERLEKLLKEIRETVKKNIEENRDLLRRVEEDLRRLTERNKRLLEKIRDALRKAGSGKDRVRKLDEDMERTLRELRRRVEEVRKKLEESLRRLEEELKRILERIERLIERIRREKVPEEVARRLMDDLRRLLEKIDRLSREHLERVRKILEDLRRLSEKHLKELEDLLREAEEEAR

SEQ ID NO: 8549 - protein, 178 aa, Artificial Sequence; identical to SEQ ID NO: 8548
  Synthetic

SEQ ID NO: 8550 - protein, 178 aa, Artificial Sequence
  Synthetic
SLEERLEELLDEIRKMLKRLEDENRRLLKEIEKRVRENTRTNRELLKRIEDRIRKAGSDEKDADEVRRRLEKTVEDLERELRRLLEEIRRSLDKLRRDLERLEEKIERLIEEIKRRKVPEEVVRTLLRELEKILAEAEDLSRRHLERLRDILREAEDLSRKHLEELKKVLEELERRAK

SEQ ID NO: 8551 - protein, 178 aa, Artificial Sequence; identical to SEQ ID NO: 8550
  Synthetic

SEQ ID NO: 8552 - protein, 179 aa, Artificial Sequence
  Synthetic
SDVERLLRELEDLLRRLEERIRELNKRHEELVRRLKEEVKRLSREHNEVVADVARKNDKDEKLDRDLRRLNEKVRRDVEKLIEDAKRVNDEVRKTVERLKEEAKRTLDEVKDRIDKRRVPKELRDRLRDVVRRLEDELRRLDDELRKNSEEVKKVLDDLRRHLEENSKRAEDTLRELRR

SEQ ID NO: 8553 - protein, 179 aa, Artificial Sequence; identical to SEQ ID NO: 8552
  Synthetic

SEQ ID NO: 8554 - protein, 179 aa, Artificial Sequence
  Synthetic
SEVEKLLRELEKALEDLRRTNEKLDREHDAVVKEVKKIAKDLSREHRDVVEDVKRKNSKDETLERDVRRRTERIREEVKRLADDVKRRNDELKKRLDELKKRLEELLREAERRIDENRVPEELRDELRRVVEDVEKKLDDLRKRNEENSRKVKEVLEKLTRELDKNREEVERTLEELRR

SEQ ID NO: 8555 - protein, 179 aa, Artificial Sequence; identical to SEQ ID NO: 8554
  Synthetic

SEQ ID NO: 8556 - protein, 179 aa, Artificial Sequence
  Synthetic
SEIEKLLEEIKESLERLKKTAEDLLEELRRLLEELERRVKELSDEHRRLVKELKDRNSKDDTVVERVRKRSTEIRKELRELLEDVRRKLEKIREELEELSKRHKETLEEIDKEMDRRNISEELKKRVEDVLREIKRAHDDLRRRLEKILRDIEKTIEDLERHMKENHDDAERVIEELKR

SEQ ID NO: 8557 - protein, 179 aa, Artificial Sequence; identical to SEQ ID NO: 8556
  Synthetic

SEQ ID NO: 8558 - protein, 176 aa, Artificial Sequence
  Synthetic
SEEEALERVLRELRRSLEELEEELRRAIRKLEDNLRRLREALETILKKLDDLLDDLRRRKPRETLEEIRRRLEELKEKIKKILTDLEKAYRDLKKKLDEILKRLEERYRELEEKVRRNGFDDKLKKEADDLDRRSRKTIKEVLDEIKELDDRSNERIEEVIREIEDEARRLAREVD

SEQ ID NO: 8559 - protein, 176 aa, Artificial Sequence; identical to SEQ ID NO: 8558
  Synthetic

SEQ ID NO: 8560 - protein, 176 aa, Artificial Sequence
  Synthetic
SEEERLREIRERLKKSLEDLKRELEEILRELERSLDKLRRDLERLLEDLRRLLDELRRRKDTESLEEIERRVRELEEELKKIDKDLEDEYRRLEEELKKVTKELKREYDELEKEVRKRGVREELEKKARELNERSKEKIKRLLEKLRKLDKESKDEIKRVLDKLRELAKRIKEEMD

SEQ ID NO: 8561 - protein, 176 aa, Artificial Sequence; identical to SEQ ID NO: 8560
  Synthetic

SEQ ID NO: 8562 - protein, 176 aa, Artificial Sequence
  Synthetic
SEEERLRRVIEEYKRVLDELSERLKRLLDELRRSLKKLEEDLKRLLDELKRTLDELIRRVEDDRLRELREEVKKAAEEIKKILKKLRELYTELEKELDRAHKENEKELRKLEEEVRRKGFSEELEKKLREALDTVRRLYEALIKKARELDKRSKDEIKRVVDKLKKLVRDIEERVR

SEQ ID NO: 8563 - protein, 176 aa, Artificial Sequence; identical to SEQ ID NO: 8562
  Synthetic

SEQ ID NO: 8564 - protein, 182 aa, Artificial Sequence
  Synthetic
DDIEDVLRRIEKLIRDLRDHSRKLVEEIEKLIEDHTRHSRKLERDIKELLKRLRELRRRGDLTEELLRKAKEELKDLLRRHEEVSERLKRRLDKLETDHDRVIKELEDRLRRIAEELERRDTSEEVKKRLDEARRKAEKVVKESRDTLRELKDKVRENLDRSRKELKKLEEELEEVLREARE

SEQ ID NO: 8565 - protein, 182 aa, Artificial Sequence; identical to SEQ ID NO: 8564
  Synthetic

SEQ ID NO: 8566 - protein, 182 aa, Artificial Sequence
  Synthetic
SDVERVAKTIEDLIREHTEHVKRSAERVERLIKEHTDHVRRSLTRIEDLLRRLEEMRRRGDSTEEVLDTVRRELRKLLKENEDRSRELEKELRELLERNEKKTKELEDELKKILRELERKPTSEDVERKARELERKVRENVRKVRDDHRKLEEKFRDNLRKVKREHEEAERKMRDLLREARR

SEQ ID NO: 8567 - protein, 182 aa, Artificial Sequence; identical to SEQ ID NO: 8566
  Synthetic

SEQ ID NO: 8568 - protein, 182 aa, Artificial Sequence
  Synthetic
KDVDKVEEDIERLLADLRRHNEKLHRDIERLLEELRRHNDKLRKTLEDLLKKLKELAERGDNEERELKRAKEEVDKLIRDHEEVLRRVEEEIEKLIRDHEKKLEDVRRTLRDILRKLEKKPTSEDVKRRLEDLERKARRVLEESRKDLEEAKKKVDELMKRARDSLRELTRRLEELVRRIRK

SEQ ID NO: 8569 - protein, 182 aa, Artificial Sequence; identical to SEQ ID NO: 8568
  Synthetic

SEQ ID NO: 8570 - protein, 182 aa, Artificial Sequence
  Synthetic
SEVEEVMKEIERLIEELRRHNEELARRLEELIKDHTRHNEELHKTIEDLIKELEDLARRGDLDEETLKRVARDLDELLERHERRSREIEERIRRLLERHEEELERIAREVKKILDELKRKPTSEEVEKRLRELKEKLDKVLDELRETLKRLEEKARENLKRSRDDLETIKRKLKKVMDEARR

SEQ ID NO: 8571 - protein, 182 aa, Artificial Sequence; identical to SEQ ID NO: 8570
  Synthetic

SEQ ID NO: 8572 - protein, 185 aa, Artificial Sequence
  Synthetic
SDVERLIEELERLLDELRKKTEEIIRRIKKLIDELRRKTEEVIKRLEKLARDLTRLTERGSDKEEVDRILDEIKKRVEKIERELEETHKKVRRRLEELETEMEKLHKELKERIEKLSKELEDKGTSEEARRRIDEIRKKAEEVNKESRDRLRRLKEEVDKVDKDSKRRLDELREELRRLMEESKR

SEQ ID NO: 8573 - protein, 185 aa, Artificial Sequence; identical to SEQ ID NO: 8572
  Synthetic

SEQ ID NO: 8574 - protein, 176 aa, Artificial Sequence
  Synthetic
DAARELRERLKKAIEDHRRLLERAARDVERLNKELEDILRRMAEDMKRSIEELKRVSEEGRVDDEIARRHEEDNKRLEEELREVAKRLEDKHRKVKEENDRSAEELKRRIDKLRKDKLLDEKDLRRLEEEIRKEIRRSNETLKKLKKKTEDSLRTIKRRLEELHEEAKKVLDDLRR

SEQ ID NO: 8575 - protein, 176 aa, Artificial Sequence; identical to SEQ ID NO: 8574
  Synthetic

SEQ ID NO: 8576 - protein, 178 aa, Artificial Sequence
  Synthetic
REDETLKRLEEENEEVNKRSEETLRKLLEDNRRLLERIEERLRELLEELRRLLEKIRKDRRLPEEMIKRLRDLLRRLEEELRKALEEAEKSLRELEREIEELRRRSRESSKKVKDELRERRDKDELTERVKRHIEENKKLTEDVARKSEKHLRDLEELLERLRKLVEDLLRRLEEEAR

SEQ ID NO: 8577 - protein, 178 aa, Artificial Sequence; identical to SEQ ID NO: 8576
  Synthetic

SEQ ID NO: 8578 - protein, 185 aa, Artificial Sequence
  Synthetic
SELEKVRKESERNLRSNEKLLRELDELSERNLDKLRRFVEEVRELVREMLERLDSVRRRNVSEDELRKLAREVEEILKRIKERLERLAKESEDLLRELKKRLEKHEEDSKELAKRLRDELRDRRVSEEVKRDVERNEKENKELLDRTRRKVEENAKRNKKLLEDIREDLKRLATELRRKLEEIRR

SEQ ID NO: 8579 - protein, 185 aa, Artificial Sequence; identical to SEQ ID NO: 8578
  Synthetic

SEQ ID NO: 8580 - protein, 177 aa, Artificial Sequence
  Synthetic
DKEETVKDLERRYRDLLREIEKRLRELVRRNDKLLEEIKKAIEDLIRENEKKIKEIKERRGRTKEVEEIEKSLEELRKEHERVVREAEKSVEELRKRHEKAIRDSRRHLEELKDELEKRRIDDELRRRAEEALERNKRLLEELKKENDDHLKRLKELLEELKKRNEDHLRRLDEEER

SEQ ID NO: 8581 - protein, 177 aa, Artificial Sequence; identical to SEQ ID NO: 8580
  Synthetic

SEQ ID NO: 8582 - protein, 182 aa, Artificial Sequence
  Synthetic
KELEEIKRAVDESLKRAKELMDRHRREVEKSLEEMKRLAEDHKRRADRLLKELKRLADEGRPREDLERKLDELKRDLERHSTELKKELEKNHRELEEHSKKLKEDLKRNHEELDRLVKSRKKSDEVRRAVKELKDRHKELLDRIERESERLREEHRRLLEKIERTSEDLIRRLEKLIRDIRR

SEQ ID NO: 8583 - protein, 182 aa, Artificial Sequence; identical to SEQ ID NO: 8582
  Synthetic

SEQ ID NO: 8584 - protein, 182 aa, Artificial Sequence
  Synthetic
DEVETVEEEVKKSLEELRDLARKHEKKVRESLKRLEESLRRSEEKVKDIIRRLEELKKRGEPKKDLERDIDELKKRLDETAEKNDEEMRRNHRELEEHSRRLKKKLEDNHKELEDRLRSEKKSEEVKKRLEDLRKEHEDTLRDIERRSRELLKRHKDKVDEIRKAHERLIRELEEIARRIKK

SEQ ID NO: 8585 - protein, 182 aa, Artificial Sequence; identical to SEQ ID NO: 8584
  Synthetic

SEQ ID NO: 8586 - protein, 182 aa, Artificial Sequence
  Synthetic
SEEEELKKKLEKSLDELRRSLKKSAEDVRRILEELKELMKRHKEVVEEIARELDELRKRGEPEEDLERRLRKLLEEARRHSRELEKRLRELEEEVRRIAKENRDRMKRNHEELEKELRSTKKSEDVERSLRDLRRKHKELVDRIDEEHKRLEKELRDIIEEIERRSRKLLKELEDIIRETRR

SEQ ID NO: 8587 - protein, 182 aa, Artificial Sequence; identical to SEQ ID NO: 8586
  Synthetic

SEQ ID NO: 8588 - protein, 184 aa, Artificial Sequence
  Synthetic
SLEEELKRVMKEVRDLAKEHSDRSRDVMREIRELSEENERRLRRVLEEAKRLADDLRRDRRKELLEDLERKLRKLVEDARRHHKKLEDDVKRITDELEKHLRELEKRLRDLTRRLEELLRREKVEERLKDILRRIREDIERLLDELRKLNEKIKRDVDRLLKENKETLDDIERRIRKLLDDERR

SEQ ID NO: 8589 - protein, 184 aa, Artificial Sequence; identical to SEQ ID NO: 8588
  Synthetic

SEQ ID NO: 8590 - protein, 181 aa, Artificial Sequence
  Synthetic
SVEELITRVERENERVARRDEELLRENEKRNRDVTREDRDLLKKLKEEVEEVLKRIREEGKEREEIAKRLKEILDRLKKESDDVEERSKELLEELERSSREAKARMDEHLRDLRRRVKGGVSEETVKELVKHNEDLLRKWEKKSEDLSRKNEEALERWRRKSKKLAEELKKTLEDIRREVT

SEQ ID NO: 8591 - protein, 181 aa, Artificial Sequence; identical to SEQ ID NO: 8590
  Synthetic

SEQ ID NO: 8592 - protein, 179 aa, Artificial Sequence
  Synthetic
DVEDKIRRLKERIKEVTERDRKLLEELKREAEEVLRRDKKSLEEVEREIEEILKDAERKGKRDERIEKTLRDLVERYRREHKRAAEDVERLKEEYERKHRDAKRKIDELERKLEDKLRDKKRGGDELIREVEKVLEDWKRKVDELNRRLKKVLKEWEDTVRKLNEELKDVLDKLREELD

SEQ ID NO: 8593 - protein, 179 aa, Artificial Sequence; identical to SEQ ID NO: 8592
  Synthetic

SEQ ID NO: 8594 - protein, 174 aa, Artificial Sequence
  Synthetic
DMEDKLRKIKEAIKKVLDEIRKLLEDIRRRLKRVREEIEEIHKRNEEENDRVKKELNVTEDLLREIEEVDKKLKEDSEDHKKKVDEVRKRLEDKLETLRKRAEDLAKKIDDDLRKDGVTDELIKKIRELLEELKDELRKLLEEAEEVLERLKRSVEELSRRNKKLVEDLDRKTR

SEQ ID NO: 8595 - protein, 174 aa, Artificial Sequence; identical to SEQ ID NO: 8594
  Synthetic

SEQ ID NO: 8596 - protein, 174 aa, Artificial Sequence
  Synthetic
SVEEKARDILEKLKRVVEKIKEIADRNRRENEDADREIKRLIEENKKRNEDLLRRLNVTEDLLRELEEADKESEKTFKRLDEDVETKNRDSDKKVRDIEEKIRDVLRKIKDELDKKGVTDELIKRIKEIIETLEKEVEDLSRENKKKVEEILDKVRKVSTRNREKLDELDKKVR

SEQ ID NO: 8597 - protein, 174 aa, Artificial Sequence; identical to SEQ ID NO: 8596
  Synthetic

SEQ ID NO: 8598 - protein, 182 aa, Artificial Sequence
  Synthetic
SDEEILRELEKRLEENVRRVEKRHEELEREVRDNLRRAEEKHRELEERVKRVIEEVIRTKGDEGEEARELSKTLRRLSEKHRRDTEKLLRDLKELSDRHRDRTRKIREELRRKLEEARRANSSEEMVRKLVEDVDRLITDHTRSLEDVDRKVKDVIRRHTDSLRKVEEDVKRIIEELRKKAE

SEQ ID NO: 8599 - protein, 182 aa, Artificial Sequence; identical to SEQ ID NO: 8598
  Synthetic

SEQ ID NO: 8600 - protein, 182 aa, Artificial Sequence
  Synthetic
DDEEILKKLREDVERVIKKIEDSLRELRKRLKDNVDRAEELHRRLEERAKKLIDEIIKKRGDRGERLDELRRRLEELSDRHRKETTKLERELEELMKRLREELKKALEELEKLLEDIRRAKLDREFVRRLAERVKKLLKELEDRLRELEERVKEVITRHTRSLEEIVRRVERVLEEMERAAK

SEQ ID NO: 8601 - protein, 182 aa, Artificial Sequence; identical to SEQ ID NO: 8600
  Synthetic

SEQ ID NO: 8602 - protein, 178 aa, Artificial Sequence
  Synthetic
SETEEAKKEIDEIIKRIEEETKRLRETYKRIIEEIERVSKRLEDEYRKLIEELERAKREGRSEKELTDLEKRLKEEDDRTREDSRRLEEEVKEKNKKSKKESDDLARKVREDLDRLRKGGVKTEELDKLRRRLEEILKRHEESNKKLSEDLERILEEHRRENERLHRELREILERLRR

SEQ ID NO: 8603 - protein, 178 aa, Artificial Sequence; identical to SEQ ID NO: 8602
  Synthetic

SEQ ID NO: 8604 - protein, 178 aa, Artificial Sequence
  Synthetic
SIEDILRELEKELRESSKRSREILERLREELRDSSRRSEEILERLKRKVKRVKEEIEPRESVERVEEELRRLEKELKDLNEKLERDHRRLEEELERLNKELKDEHEKLVRRLEEEGNVDDKRVREVAERLRRLNERYNREVKRLEKEARRLNEEYNRLVERLAREVEKLIRDLKEEAR

SEQ ID NO: 8605 - protein, 178 aa, Artificial Sequence; identical to SEQ ID NO: 8604
  Synthetic

SEQ ID NO: 8606 - protein, 184 aa, Artificial Sequence
  Synthetic
SLEDLVREIRKRLDDMEREVKKVDDESRKRLDEARKRVEKINRESEKRLKEVADELSELKDDELKKRLEDLRRELRKLHERADRELEELTRRLEEKHKEAKRELDELKRRMEEILRDIERKNSSDEKLARDLRREVRKLEKRLEELLKELKETTEKILRELERLLKKLEDDTRRVLEEIKELKR

SEQ ID NO: 8607 - protein, 184 aa, Artificial Sequence; identical to SEQ ID NO: 8606
  Synthetic

SEQ ID NO: 8608 - protein, 173 aa, Artificial Sequence
  Synthetic
DEEREVKRKYREDLDDIRRHSEEVLKRYDEAVKKLDEDLKKVVEEYERALEEIVRRAGEDEELRREVEENRKRNEDKARTKREDHKRNSKRYKDEHDRLEKEHRENEKRKDDENSSEEEMSKDLERELRRSRRENERLAKELEDALRKSEEDIRRLVEENKERLERLERELSR

SEQ ID NO: 8609 - protein, 173 aa, Artificial Sequence; identical to SEQ ID NO: 8608
  Synthetic

SEQ ID NO: 8610 - protein, 186 aa, Artificial Sequence
  Synthetic
SEAEKVEEEVKELVKRNREKHDEIRRRIEKLKEDLKRTSERSERKIKRLVEKIDDTLRKKGPDTDKLKRIRKRLEDKERKMKEDHRRLEEELERADKERKERTDKSDKKLRDDTEKTKDDLRKRGPGEDELKRMADTIRDEIRKDNERLRRTLEKAKREADEYRERDKRKLEDFEREIRRIEEETR

SEQ ID NO: 8611 - protein, 186 aa, Artificial Sequence; identical to SEQ ID NO: 8610
  Synthetic

SEQ ID NO: 8612 - protein, 178 aa, Artificial Sequence
  Synthetic
DEREEIEKTIRELMRENDDLVRKIRREIEESLRENRRTLEKIKKEIEELTRKAKRDVRPDEELDRDAKKIREEMERRERRYEEEAKKIRDRDREKKERSEEEKRETEEREEDLKRKNADEETLRKRLEEVKRKSDEHKKELEERLREVRRRSERVNEELKKTLEEVRKKIRELIERDR

SEQ ID NO: 8613 - protein, 178 aa, Artificial Sequence; identical to SEQ ID NO: 8612
  Synthetic

SEQ ID NO: 8614 - protein, 174 aa, Artificial Sequence
  Synthetic
SEEEVARRVEERVEELDRRLREIVKDLRDHNRRMKEKLEEAVERVRRRDKELDDILRETSLDERVEKEHRDRHKKEDDETRKDDEDNKEKEDRVKKEEDDLRKETEEERKRLEEDRSTSEELRKKLEDLRRKIDEKVKKVTKEHRDSAKKIRDDVRRVKEENKKANRELAEKRR

SEQ ID NO: 8615 - protein, 174 aa, Artificial Sequence; identical to SEQ ID NO: 8614
  Synthetic

SEQ ID NO: 8616 - protein, 173 aa, Artificial Sequence
  Synthetic
SREEEVEEEYERLLEEIRRRVKEVEKEYRDLLKKIEDDVREVRKEYEKLVEDLSRKAGRVEDEERKLEKNRRDNDKKEEDKRRRHERNADDFRRRADEMEKRHKRNRDEERKRNVEDEDASRRLRDIARRSREELEEEVKRLRTEIEKSERELRETTKENRKIIEDVRRRLEK

SEQ ID NO: 8617 - protein, 173 aa, Artificial Sequence; identical to SEQ ID NO: 8616
  Synthetic

SEQ ID NO: 8618 - protein, 173 aa, Artificial Sequence
  Synthetic
SEKEEVEREYRELLKEIEKRIDEVIKEYRDLLRDIRREVKRVLREYAELVKELKKTTGPVREEKKKLEDNDRKNKEEAKRLEDEHKENDERNKRRKDTLKKEHDENEKRERDEDRERDEAARELRKKAEDSKRELEKLEEENRRIIKRSRERLKKIEEDNRRIIKEVLDRARK

SEQ ID NO: 8619 - protein, 173 aa, Artificial Sequence; identical to SEQ ID NO: 8618
  Synthetic

SEQ ID NO: 8620 - protein, 174 aa, Artificial Sequence
  Synthetic
SKEELVKKARDELRRVLEELKRAVDELRKRDEDYERKSEDVVRRLRKIDKDVREVLRRGELDERTLEEIERRLREIHRRVREDSKRTEDELKERHDALRDRMKKLKEKLREERERLDLDEEVEEEIRREAKRIDDELEKVEEENKRTLDRAKKHNEEVEKENRDTLREIDKERE

SEQ ID NO: 8621 - protein, 174 aa, Artificial Sequence; identical to SEQ ID NO: 8620
  Synthetic

SEQ ID NO: 8622 - protein, 180 aa, Artificial Sequence
  Synthetic
SIEEEAKEIIDKVRKEVEDIVRRLKETNDEVRERLERILRRLEEVDEEAKRRVEELRERKRTLEKKTVKDIEDKLERDSERVKRETREETKELEDRSRDLTRRTREELERIRRELEDRDRRLRIDDRLREELEKLARDVERRTRELEKHHRELMKRAKEETERLERHHDELAKRVREKLK

SEQ ID NO: 8623 - protein, 180 aa, Artificial Sequence; identical to SEQ ID NO: 8622
  Synthetic

SEQ ID NO: 8624 - protein, 182 aa, Artificial Sequence
  Synthetic
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 8625 - protein, 182 aa, Artificial Sequence; identical to SEQ ID NO: 8624
  Synthetic

SEQ ID NO: 8626 - protein, 182 aa, Artificial Sequence
  Synthetic
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGKDAEEVLREVEKVVEDSRRSAKDALKRVEDRVRESDKSVRELLEENRKVVEDIKRRVD

SEQ ID NO: 8627 - protein, 182 aa, Artificial Sequence; identical to SEQ ID NO: 8626
  Synthetic

SEQ ID NO: 8628 - protein, 174 aa, Artificial Sequence
  Synthetic
EELERILDKVRKVIEEVRKRLRDDLRTVEKVLKETEEVLRRAAERAKRALERVEEAARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 8629 - protein, 174 aa, Artificial Sequence; identical to SEQ ID NO: 8628
  Synthetic

SEQ ID NO: 8630 - protein, 174 aa, Artificial Sequence
  Synthetic
KDVEDVEREVDEVVKRSDDTVEENLRRAEDVVRDTDRIVKEMKERIDRVVERVEEVVRRGRDKREIEDELRRVLEELKRLADEVEKKNRDVNRRSEKLLRDDEKELRDVERELRKKIRGEEVLRKVTRLLREAKRRTEESHKKVNDLSRRVKERVDEVLERVKRLLEEVKRKVK

SEQ ID NO: 8631 - protein, 174 aa, Artificial Sequence; identical to SEQ ID NO: 8630
  Synthetic

SEQ ID NO: 8632 - protein, 176 aa, Artificial Sequence
  Synthetic
DEAEKVLKESKDTVDKIRRDVERLVDESRKTVDRIRELVDKAVKDSKDSVDRLRDVMRRNTNDKKELEKISRDDRKRLDEVRKRLKDLLREDNERLKKVLKEMRELLKRDNERLKRANVDEEVLRRIEKVNRDVARRVEEVFREAKEVNKKVDREVEDVIRKVKRVNEKVDEELKK

SEQ ID NO: 8633 - protein, 176 aa, Artificial Sequence; identical to SEQ ID NO: 8632
  Synthetic

SEQ ID NO: 8634 - protein, 176 aa, Artificial Sequence
  Synthetic
SEAEEVVRRSRETVTRNVRMLEKVVRDSEETVKKIVRDVERLLEESKKSVDDLRRLKEENRVDDRELKRISEKDEEDLRRALKDLEEKLKRDNERLEKVLEDSKRTLDEDNKRLDEANADEKVLREVKEVNERVRETSRDIADRVREVNEDVKRKVKKVIDDIRRVNEKVKRELEK

SEQ ID NO: 8635 - protein, 176 aa, Artificial Sequence; identical to SEQ ID NO: 8634
  Synthetic

SEQ ID NO: 8636 - protein, 182 aa, Artificial Sequence
  Synthetic
DEAREVVKRVKDLVRRLRRLSEKSLEDDKRLIEEVNKRSKDILDKVKKLVDDLRDMVRRTRDKDTLRKLVKEVKDRADDLLRRLEEIDKRIRDRSEENLRRNKEISEDVKRRAKELLDDARRRKLEEEVIKEIERVVRKVLEESREVHERIRETVKEVNDRNRKVLREIREVVKKVFEDARR

SEQ ID NO: 8637 - protein, 182 aa, Artificial Sequence; identical to SEQ ID NO: 8636
  Synthetic

SEQ ID NO: 8638 - protein, 179 aa, Artificial Sequence
  Synthetic
SDAEEVVRENRELVERIVREVEKILRDNEELVKRLVELVETSLRRNEKMVDELKKLVDRNKDKERLLEDAKRRSEKNERELEEILERLKRESDKSLKRIKEVLDELRKESKRLDDELRARRVDSRVIKEIRDTSKDAVRKVEEVLRRIEETVRDAERKVKEVIKRIRETSKEVLDRVRK

SEQ ID NO: 8639 - protein, 179 aa, Artificial Sequence; identical to SEQ ID NO: 8638
  Synthetic

SEQ ID NO: 8640 - protein, 179 aa, Artificial Sequence
  Synthetic
DAAERALRRSEEVVRESVEEVKTWVDENRRSVERLREELRKDEERVRRVVERIRKLVEDGEDKRELRKDLTRVLEESKESVRRIKEDLKRDTDKTEKLLDENRRKNEKSRRELEEIVRKGLVSEEVLKRVRKTNDDSDKEVKRLIDEARKLNDDVRKEVEEVLERTTRILDRVRKEVEK

SEQ ID NO: 8641 - protein, 179 aa, Artificial Sequence; identical to SEQ ID NO: 8640
  Synthetic

SEQ ID NO: 8642 - protein, 178 aa, Artificial Sequence
  Synthetic
DEAREVERRVREMVKELKRRLEEDVKESDKSVKDLERIAKEDVDRSRESVKELRDRVRRRRDEDVRRELREKLKKDNDESRKSKKELDDISREDEKRSRDSLRDLERLLRELERELREAKVEEEAVRRVKRIIEEVRKVLEDVFRESERLNREVREKLKRMFETSKELNKRVEEALRE

SEQ ID NO: 8643 - protein, 178 aa, Artificial Sequence; identical to SEQ ID NO: 8642
  Synthetic

SEQ ID NO: 8644 - protein, 179 aa, Artificial Sequence
  Synthetic
DSRRELEDDVRRIVETNRRLLEELERRVKKILEENRRLVEELRKENERIVRELTDRVRRDGKDDDLRRKLKEILDEIRKRNEDVLRESRKSLKDLARLIEEVRERSRESLEEIKKRLREANVEEDVVRTVEKLIRDLEEESRRVLEEVRRLLDEVRKESEEVHKRVNEIVKRVEDEIRR

SEQ ID NO: 8645 - protein, 179 aa, Artificial Sequence; identical to SEQ ID NO: 8644
  Synthetic

SEQ ID NO: 8646 - protein, 178 aa, Artificial Sequence
  Synthetic
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 8647 - protein, 178 aa, Artificial Sequence; identical to SEQ ID NO: 8646
  Synthetic

SEQ ID NO: 8648 - protein, 178 aa, Artificial Sequence
  Synthetic
SKVKEVEDRVREVVKESERVARESLEHVRRVVRKTEDVVRRLKEKVRKAVEDLKEIKRRGGSEETLEEVERRLKKILDELRKEVDDVEKDNERALRDNRRKIEKVERENRDELEKLKKSGIGEEVLKKVEEISERSRRELRRALKESDKISEESLRRLRKVLREVEEIVRRVLEELRR

SEQ ID NO: 8649 - protein, 178 aa, Artificial Sequence; identical to SEQ ID NO: 8648
  Synthetic

SEQ ID NO: 8650 - protein, 178 aa, Artificial Sequence
  Synthetic
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 8651 - protein, 178 aa, Artificial Sequence; identical to SEQ ID NO: 8650
  Synthetic

SEQ ID NO: 8652 - protein, 176 aa, Artificial Sequence
  Synthetic
DSDRKIDDEVRKVVETSERSLRENIKRIEKVVRKLEEEVRKDLEEVRRVVKELREIVKRNKEKKEDLERLIREVKKKSEKSLEDLRREIKKVEDESRKNLEENKRLLEKVKERLDRANVDEEALRKVEEDLRRLDRRVEEVVTRSKEILDEARKSVEEVVRRSDEILRRVEEDLRR

SEQ ID NO: 8653 - protein, 176 aa, Artificial Sequence; identical to SEQ ID NO: 8652
  Synthetic

SEQ ID NO: 8654 - protein, 177 aa, Artificial Sequence
  Synthetic
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGVDKRVLEKIKKVVDDSVRVNREVLKRVEEVLEESKRVNEKVEEDVRRVHEEVRKEIK

SEQ ID NO: 8655 - protein, 177 aa, Artificial Sequence; identical to SEQ ID NO: 8654
  Synthetic

SEQ ID NO: 8656 - protein, 177 aa, Artificial Sequence
  Synthetic
DRVEKLLEDAKKIVEDSKRTAEKLLRENEKIVEKIKREADKILEDNKKIVDELAEAVKRTTDKDKKEELKRRSEKVNKESEDLVRRLRKESEEVLERTERVVRETEKRNDEMRKRIEEGGVDRRVLEEVKRVIDESRRVNKRVEEEIRKVHRDVERRLEEVLKRVRDTSEDVRRKIK

SEQ ID NO: 8657 - protein, 177 aa, Artificial Sequence; identical to SEQ ID NO: 8656
  Synthetic

SEQ ID NO: 8658 - protein, 177 aa, Artificial Sequence
  Synthetic
SEAEKLLRDVEREVERVIEDADKLLREIEEIVKRSEDKAREILKENEKIVRELKEAVRRTTDERKKEELKRRSEKVNRKSRKLVEDTKKENEDVLREIEKRLRDLDRRLKEVEDRIRKAGVDEEVLRRIKKVVDDVRERLREVEKRIRDVIDRSRRVNERVLREAERTSREVERAID

SEQ ID NO: 8659 - protein, 177 aa, Artificial Sequence; identical to SEQ ID NO: 8658
  Synthetic

SEQ ID NO: 8660 - protein, 175 aa, Artificial Sequence
  Synthetic
DEAEDVLRKVRERVKESERHVEKVLEDVRRVVKKSIDHARDVLRKVKEVIDRVRELVERNERDKKELEEDLKRLRERVEEMIRTNEKENRDLERDVERAIEENRRRNDKVEDDVRKSNIDERVEREIRRVLKRSKERLEEVVKEIRELSEKSRRVLEEVKKRIREVLERVRKDVE

SEQ ID NO: 8661 - protein, 175 aa, Artificial Sequence; identical to SEQ ID NO: 8660
  Synthetic

SEQ ID NO: 8662 - protein, 175 aa, Artificial Sequence
  Synthetic
REAEEVLKEVRKAVEDSIRHVEEVLEEVKKVVEESIRHIRDSLRDVRRVIEEVDRLVKRNERDKKELKERLERALRKDERVVEENEDTNRRLIEKVEKAIRENEKRNDDVKRKVDELNVDKRVKEEIDRVLDESKRVLEEVVTRIRKVSDDSEKEVRRVHKESKRVVEEVERTVD

SEQ ID NO: 8663 - protein, 175 aa, Artificial Sequence; identical to SEQ ID NO: 8662
  Synthetic

SEQ ID NO: 8664 - protein, 175 aa, Artificial Sequence
  Synthetic
DEAEDVLRRVREMVERSIEHVRRVLKEVEDVVRESIKHVEDVVREVREVIREVEELVDRNEVDKKELRKRLKELEDKVEKRTRENEERNKELNKKVKDADDENRKRNEKVRRDVRRSNIDKRVEEEIDKLLRESKRELDEVRKRIEDLSRESERRLREAVEEIRRLVKKVAEKVN

SEQ ID NO: 8665 - protein, 175 aa, Artificial Sequence; identical to SEQ ID NO: 8664
  Synthetic

SEQ ID NO: 8666 - protein, 175 aa, Artificial Sequence
  Synthetic
KEAEDVLDEVRKAVEESIKHVKRVLEEVEEIVRRSIKHARDSLRKVKEVIDKVRTLVRRNEVDKKELEEELKRLEDEDRKMVKDNRDDNREANRKVDKMVKENEDRNRRVEEKVRELNIDERVRREIKRLLDESREVLKEVTKRIRKVSRDSERVVEKVHRDSKDVLDKVREDVR

SEQ ID NO: 8667 - protein, 175 aa, Artificial Sequence; identical to SEQ ID NO: 8666
  Synthetic

SEQ ID NO: 8668 - protein, 178 aa, Artificial Sequence
  Synthetic
SSLEKAEDEVRELLRDVERVLKEVRDRIEELNRKVNEVLRRVIEESERLLREVLERVRGRREVTELLKEVKKRNDKVRKDIRKESEEDKKKVEETVAEIKKELDDLRRDVRRVAEENGPSEKVRRLVDKVRETVTDIVRRVTRLLEESEESVRRLIEKVKKLNEESRRIVEKIEKDAR

SEQ ID NO: 8669 - protein, 178 aa, Artificial Sequence; identical to SEQ ID NO: 8668
  Synthetic

SEQ ID NO: 8670 - protein, 178 aa, Artificial Sequence
  Synthetic
SELERVEEDVKRVNKEVNDTLEKVIRDSKRVLDEVEERTRKVKRDSERLLERVERAVEGLKELKELLDRLREENREVVKDSERLLREWERENREVKKRIEDESEEDKRRLEEVARRNGPEEVVERVLEESRRSVETLIRDVERVNKKSREAVERNIRRSTAANERSKKIVKEIIDTAK

SEQ ID NO: 8671 - protein, 178 aa, Artificial Sequence; identical to SEQ ID NO: 8670
  Synthetic

SEQ ID NO: 8672 - protein, 174 aa, Artificial Sequence
  Synthetic
DEAEDVVRRVREEVERLIRRSREVAEESKRTVDKLRRELEELLRRSRETVERIKKLIDEGVDRREIEKLNRDNEEEVRRMEEKARRINTENRDRVRKVHEESKRELERIKEEVRRVDIDDKVREDIERVLREVEEVDKEVKERVRKVDEDSKKEIKEVKDEIRRVDEESRERAE

SEQ ID NO: 8673 - protein, 174 aa, Artificial Sequence; identical to SEQ ID NO: 8672
  Synthetic

SEQ ID NO: 8674 - protein, 177 aa, Artificial Sequence
  Synthetic
DEAEKVLEKARDLVRRNIERSRRVLEENKKSVDDLIRRNEETNRRNEKSVDEVKKLVDNGGSEEAVRTVAERDEKSLEENREENERILKRDEDTLEKAKRESDKSLAELKKLLDDAKRKGVDDDVLREVKRVLDEARRVSEEVEKESRRVLEEAKRVAEEVHKRSKKVVDDVKERAR

SEQ ID NO: 8675 - protein, 177 aa, Artificial Sequence; identical to SEQ ID NO: 8674
  Synthetic

SEQ ID NO: 8676 - protein, 180 aa, Artificial Sequence
  Synthetic
SELEDVKRRIDKVVREVEEVVREVSERSKKVLEEVRRSAERVNREIERVLREAKDEVRRRTRDDKIRKKVEEVERRVRKLIEDNRRINEEVERRVERLNEELRRLVEKVRKELEELKKDIKDKDAKRVLEEARKIVDRLRKIVEEVVRRSEELIRRLKKINEDSLRRVEELVKDLIREVS

SEQ ID NO: 8677 - protein, 180 aa, Artificial Sequence; identical to SEQ ID NO: 8676
  Synthetic

SEQ ID NO: 8678 - protein, 181 aa, Artificial Sequence
  Synthetic
KEAEEVVERVRELIERLRRRVTEMLRESKRLVEENIKRSEDALKESERLVDKLRELVKRTRDKETLKKLLEEIEREIKKINKRTEDILRESARRVEEINKRTKDILEEIARRITRIREEARRRNVDDKVLRTIEKLLDDVKKEVEKVNEDSKRLLRDVERVSKEVNDESRRVLEEVKREAK

SEQ ID NO: 8679 - protein, 181 aa, Artificial Sequence; identical to SEQ ID NO: 8678
  Synthetic

SEQ ID NO: 8680 - protein, 181 aa, Artificial Sequence
  Synthetic
SELEKIVEKIKRIIDESRRTVEESVRKSEKIVEEVKKRLEELVEEVRKIVEEIVRIIRNGDRREEVEEKARRTAEELRRRLEELRKRLEDLVRKDLRENEENLKRTEDLVREVKDELEKLPRNEELEKVKRMVDKVVDDVRKVNDTSRKRSKETLEEARRKVEEVKRRIDKVLRDVKREID

SEQ ID NO: 8681 - protein, 181 aa, Artificial Sequence; identical to SEQ ID NO: 8680
  Synthetic

SEQ ID NO: 8682 - protein, 177 aa, Artificial Sequence
  Synthetic
DEVEEVVKRVKEVVEKIVRELEKLVEESKKIVEDAVREDERLVEKIERVVRRLVEEVRRSTDEKKLEDLEKELEDVRKDIERVLEDNKRKLEEAHEKSKDKARRLREELERALREVEETGVSEEVKKLVDEVVKEVEEVIKRVEDLDRRVLEENRESTRDVERRVREVVKRVREALK

SEQ ID NO: 8683 - protein, 177 aa, Artificial Sequence; identical to SEQ ID NO: 8682
  Synthetic

SEQ ID NO: 8684 - protein, 176 aa, Artificial Sequence
  Synthetic
SDAERVVREVERLVDTTRKLVKKVVEDIRRVVETAKRDLDRVVKRSEDVVREVKKLIEEGVREEEIKKILDEIRKETKDVERKIKKILDDIRKKVEKVTEEIKDVNRKTKEIVDRAKDRIDDRVIKLVRKLNKDSERKLREVRDRVERVIEEVEKRLREVKERSKETIEDVERARK

SEQ ID NO: 8685 - protein, 176 aa, Artificial Sequence; identical to SEQ ID NO: 8684
  Synthetic

SEQ ID NO: 8686 - protein, 177 aa, Artificial Sequence
  Synthetic
DEAEKVVEEAKRRVKEVVERLREVADRNRRSIEELVKELRAVVEDSRKSVEDLVRRVRNGGSKETVEEIDRRNEDKLRELEKRVRKIIEENKRSLEKLKRDIERIERRLEELLERVDRNNVSEEVKKLVEDVIEEVRKVVKEVEDISRRVIEDLKRVLEEVEKRSRKLIKEARDETR

SEQ ID NO: 8687 - protein, 177 aa, Artificial Sequence; identical to SEQ ID NO: 8686
  Synthetic

SEQ ID NO: 8688 - protein, 181 aa, Artificial Sequence
  Synthetic
DELREVVKRVRRLIEEVRRLVKELVDRVRKVIEELKRRSEDSARESERVVREIKKLVEERKDKEELLKEAEKKVEKIHRDNKKLLRELEEKIERIREELDRVLRDLERRLRELKEELKRGPKNEELEDVDRDIERVREEVKRVVDEVRKRIRDVLEDARRESKRVLDRSRESLREVREAVR

SEQ ID NO: 8689 - protein, 181 aa, Artificial Sequence; identical to SEQ ID NO: 8688
  Synthetic

SEQ ID NO: 8690 - protein, 181 aa, Artificial Sequence
  Synthetic
DELEELVKRVEDVIREIEERVRRLVRESERVVKEILKKSRKSVEKVKEVVDRAVDLVRKRKDDKRALEELRRVAEEIKEENERLLRDAEEKVKKLDRELEKLLEDLRREIRRLLEELRRGPDDERLKDVEREIRRVLRRAEKVVDEALKRSRDTLREVRKVSKEVREDIERVVKEADEAAR

SEQ ID NO: 8691 - protein, 181 aa, Artificial Sequence; identical to SEQ ID NO: 8690
  Synthetic

SEQ ID NO: 8692 - protein, 177 aa, Artificial Sequence
  Synthetic
SVVDRVREELEKVLRHSKKVVEDVKREIDKVLKRSEDALRRVEEESKRVLEEVERDGISEELEERLRRIHRESRERLKRLKEENERIAEELRKRLEDLTRENEKIIRDLDRELKKTRDKDTLKKLVEEARKVSEDSRRRLERIVEEMRRVSEDSRRRLEEIVRENRKVVEEVRRRAT

SEQ ID NO: 8693 - protein, 177 aa, Artificial Sequence; identical to SEQ ID NO: 8692
  Synthetic

SEQ ID NO: 8694 - protein, 177 aa, Artificial Sequence
  Synthetic
SVVERVREEIKRVLENSKRAVDKVREDIKRVLDESRKAIKEVEDEIRKVLEEVERGGIDEELRKELKRIVDELRAELKKLLDENEEAVKELEERLKKLTRDNEEIVERLERRLKKTTDSDTVRRIVEEIEKVSRESVKRLEDIVREMKKISEESKETVDRIVEKIREVVKRLLEAAK

SEQ ID NO: 8695 - protein, 177 aa, Artificial Sequence; identical to SEQ ID NO: 8694
  Synthetic

SEQ ID NO: 8696 - protein, 177 aa, Artificial Sequence
  Synthetic
SAVETVRKTIEDVLRNSERVLKKVREDSKKVLENSERVLKEVEDRSKEVLKEVEDGGIDERLREELEDIHRRSKKRLDELREENKRIHDRTEEELKRLLRENEKIVEDLARRLDKTTDKKELDEIAEEIKRVSEDSVRKARELAERNKKVSDESVKRVKKIVRENEKVVEELLKAKK

SEQ ID NO: 8697 - protein, 177 aa, Artificial Sequence; identical to SEQ ID NO: 8696
  Synthetic

SEQ ID NO: 8698 - protein, 177 aa, Artificial Sequence
  Synthetic
SEVDEIVRRIKEISKRSVDDLEKLARDNKKAVEEVLEELRKLLEENEKMVREVLEEVRRSTDEDRLAKLRKRVEDVNRRTRRVLDEIRKKVEEVHDRTRRRLEELKRRNDEVLRKIASKPIDERLDRMLKEVIKHSEKVVRDVEETSKTVLKEIEDALKKVEEASKRVVDRLEEATR

SEQ ID NO: 8699 - protein, 177 aa, Artificial Sequence; identical to SEQ ID NO: 8698
  Synthetic

SEQ ID NO: 8700 - protein, 177 aa, Artificial Sequence
  Synthetic
RRVDEIAKKIKRISEESVKTLDKIMEDARKIVKDVLDELRKLAEDNKRVVREVLERVRRSTDEDTLKKLDDKLRDVHRRTKEVLDKLTDEVRDVKRRIDELLEKLKEENERVLREIESEDIDERLRRTVERVIRHSREAVKRVKDEVEKVVKELEDVVRKVKEDSERVVKEVEEAKR

SEQ ID NO: 8701 - protein, 177 aa, Artificial Sequence; identical to SEQ ID NO: 8700
  Synthetic

SEQ ID NO: 8702 - protein, 181 aa, Artificial Sequence
  Synthetic
SEAEDVVRRSKRSVERLKKELDDVVRESKESVERLVRRNDEVVKRSRESVDELTEAVKRGLRREDIERILRENRRLLEEAHKENKKILEENKKLLDDLRRRVREILERNKRLLEELKRRLKDKDLVERVERTVRTTLKELEDALREVKRMVEDTLKKAEDVNRRVAEEVKKSEKRLRDVAK

SEQ ID NO: 8703 - protein, 181 aa, Artificial Sequence; identical to SEQ ID NO: 8702
  Synthetic

SEQ ID NO: 8704 - protein, 181 aa, Artificial Sequence
  Synthetic
DEVDDVVRKSEKSVEELVRKLETVVKRSEESVRELLEKNREVVERNERSVRELLERLEKGLSEKEVEDILREDEESLKKLHEDNKRILKENRDLLRRLEEEVRRINRENERLLDDLRKKLTDKDLLKRVEDTARRVNREIEEALDRVRKAVEKTLKKLKDVNDEVRKESEKVLKELRDATK

SEQ ID NO: 8705 - protein, 181 aa, Artificial Sequence; identical to SEQ ID NO: 8704
  Synthetic

SEQ ID NO: 8706 - protein, 177 aa, Artificial Sequence
  Synthetic
SDEDRVREMVRTVIEKLDRVLEEVERDSAKTDRDNKKSAEDVRRESKRTDDELKDVVRKAGRELEKIRDVVDKNRRLVEKLDKENRKTLEENRRLLEELKKLADEVKEELERLRKEIKDKDVDEVVERAKKLVKRLEDRLREVVKESRRLVRRVVERNREVAERSKDLVRRLVEDTR

SEQ ID NO: 8707 - protein, 177 aa, Artificial Sequence; identical to SEQ ID NO: 8706
  Synthetic

SEQ ID NO: 8708 - protein, 177 aa, Artificial Sequence
  Synthetic
SKEEEVERRVEEVIKELEEVLRRVEEEIKRVIDDNRRSARDVEEKSKRTDEELKDVVRKAGRRLEEIERIEEENKKLVDELRKSNEKTEEELKKLLEELREMVREVKERLKDLLDKIKDRDVDEVARRVKEMVERLRKLAEEVVREAERVVREVVDENRKVVEESKRLVKELLERVK

SEQ ID NO: 8709 - protein, 177 aa, Artificial Sequence; identical to SEQ ID NO: 8708
  Synthetic

SEQ ID NO: 8710 - protein, 177 aa, Artificial Sequence
  Synthetic
SDEERVDEEIKTVIEELKRSLKEVEDTIRKVIKENKDSAKRVKETSEKTDREIEDVVRKAGRELEDIKKVKRDNKELVKRLDERNRETEKELRELLDRLRKENKESEDRLRKLRDEIKDKDVDTVAKEVRDLVRENVERNKEVVKRAKKVVDDVVRENRKVAEDSKKLVKEVKDRVR

SEQ ID NO: 8711 - protein, 177 aa, Artificial Sequence; identical to SEQ ID NO: 8710
  Synthetic

SEQ ID NO: 8712 - protein, 177 aa, Artificial Sequence
  Synthetic
DDEERVKELIKEVIRELEESLRRVKEDSKRTDEKNKKSMEDVERKIERVRRRLDEVVKEAGRDLEDIKRIDKELEELLRKLREENERTRETNEELVRKLDEENRKSKKELEKLLREVKDKDVDEVAKRATDIVKRNAELNKEVVDESRRLVEEVVDRNEKVAKRAEEIVDELERRTR

SEQ ID NO: 8713 - protein, 177 aa, Artificial Sequence; identical to SEQ ID NO: 8712
  Synthetic

SEQ ID NO: 8714 - protein, 185 aa, Artificial Sequence
  Synthetic
DEFKEVVDRVKRLVTENVRENRRVVEESERLVKEALKRLEDLVRRAKEIVDRLDDLVRKIRDEDTLREVVDRIEKILRELEEEAKRVARRIKEESKRLNDEVKEINDRSRRKLTELLKRLDESRVPKDLLKRVRDSIETVKKELDDSMKKVSDDDERSKKELEDVLEEVRKRIEKVMKELRDTSR

SEQ ID NO: 8715 - protein, 185 aa, Artificial Sequence; identical to SEQ ID NO: 8714
  Synthetic

SEQ ID NO: 8716 - protein, 185 aa, Artificial Sequence
  Synthetic
DEVREIVREVKRLVEENVRRNDDVARKSRKLVKENKDRNKEVVDRLRELVKRALDEVRRIKEEEELRRVVKEIRDELRRLRKKLKDINDDSERKSRELNKLVKDINKKSEEELEKLRDRVRRLRVPEKLLKEVEDMIRTVKKELKDSARRVSEEDKRSKEDLKRSAKEVEETIKDVLRKLDTETT

SEQ ID NO: 8717 - protein, 185 aa, Artificial Sequence; identical to SEQ ID NO: 8716
  Synthetic

SEQ ID NO: 8718 - protein, 185 aa, Artificial Sequence
  Synthetic
DEAEEVVRRVERLVKENVKLNKEIVKRSRDLVKELEERLREIVKRVEEIVKRAKDLVEEIKDKDTLKEVVDRIRRELERLLEEVERIARKIIEESKELNKRMREINKKSKEDLKRLLDELDKSRVPKDLLKRVREVIERVDRELDKSMKEVHDENEKSVRRLREVLERVKKRIKDVTKELEDRTR

SEQ ID NO: 8719 - protein, 185 aa, Artificial Sequence; identical to SEQ ID NO: 8718
  Synthetic

SEQ ID NO: 8720 - protein, 185 aa, Artificial Sequence
  Synthetic
SLVEEVVRRVEDLVRKNVRLNEEIVRRSEDLVRRNVELNEELVRRAEDLVRRIEELVKKIKDRRELERVLREIRRTLRELKRELEEINKRSKDESRRLNDEVRRINEKSEEELKRLLDELRKRPVDEELLRKVEKMIERVVRELKKSAKRVHDENRRSDEDAERSMERVERVIERVERDIDRRLR

SEQ ID NO: 8721 - protein, 185 aa, Artificial Sequence; identical to SEQ ID NO: 8720
  Synthetic

SEQ ID NO: 8722 - protein, 185 aa, Artificial Sequence
  Synthetic
DEAREVVTEVKRLVRENEERNKEVVKRSKKLVEDLKDLARKLVDRAKKLVDTLRDLVRKIRDKDTLKEVVERIRRELDKLRKELEEILKRVHEEDKRLRDEVDEINKRSEDELRKLEDELRKSRVEERLLEDVERKIETVIRELRKSMEEVKESSRRSNEELKKVADDVERTIRKVERELEKEST

SEQ ID NO: 8723 - protein, 185 aa, Artificial Sequence; identical to SEQ ID NO: 8722
  Synthetic

SEQ ID NO: 8724 - protein, 175 aa, Artificial Sequence
  Synthetic
SDAERVVDDLERRVRENLEDLRRAVREVREVVKKNLETITRVLEEVERVVDRLSKLVKEGTDRKDLEKELRDLEEKIKRISEESRRHLDELRRKVEEINKRSRDHLRDLARRLKEEIGRVREVDKVLKDVARKVEEANEKSRRVLEEVEELVERVNRELHETLKRVAERVKRDAT

SEQ ID NO: 8725 - protein, 175 aa, Artificial Sequence; identical to SEQ ID NO: 8724
  Synthetic

SEQ ID NO: 8726 - protein, 177 aa, Artificial Sequence
  Synthetic
SDEERVTKVLEEVKERIERANRTLEKRVREVTDRVREVNERSDKVNRDSERKIREIIKRLTDKDLVRKLEKLLEEDRRRSEEALEESDRLVKEAKRRIDKALKESEDSLRDMEREVRERPKLEKLVRDLRKIVEENERKNRDLLRKIEKIVEEIERRNRDVVRRSKESVERLREEVR

SEQ ID NO: 8727 - protein, 177 aa, Artificial Sequence; identical to SEQ ID NO: 8726
  Synthetic

SEQ ID NO: 8728 - protein, 181 aa, Artificial Sequence
  Synthetic
DADRELRRVAKEVTDRSRRVLEDSERVVRESHEKSKRVLEDLRRVVKEVAERIDEVLKRVRGEDLERLERIKERIKEEVDRVDERSKRTVEENKRRVDEVRKESKKIVDDMRELLERAKDLTEEVARDVVRKLKRIVTENLKKNTKVVRDSEDLVRRDLEEVDRVVKKVKKDVDEIERDVK

SEQ ID NO: 8729 - protein, 181 aa, Artificial Sequence; identical to SEQ ID NO: 8728
  Synthetic

SEQ ID NO: 8730 - protein, 181 aa, Artificial Sequence
  Synthetic
DEVREVVKELKRIVDELLDELRKVVEELEKIVTDDLRRIEEAVKRSKDSVEDLERRLKSGGSEEMVKKIKDENKELLKKVREESKRSNDRSKEVLDRVKKRVEDIIERLRRELKRVTKDIEDKDLLRELEEVARRVEEKIKKAVRELEKVMREVNRKSTEVLKRLEKVVRDSEKRIDDATR

SEQ ID NO: 8731 - protein, 181 aa, Artificial Sequence; identical to SEQ ID NO: 8730
  Synthetic

SEQ ID NO: 8732 - protein, 181 aa, Artificial Sequence
  Synthetic
SDVDEVVKEVKAIADDSTRLNKESAEKSRELVDRDTKKNKRSVEELRRLVTEILKVVESGGPGKVVEEAKKRLDRLLERDEETNRDSERKDRELLRTDEELNRETDKRLKDLLDRVRRRISNDELLRKLEEVVEKVRRDDERSHRESERVSRESTKRSRDSHRESREVVTEVKKEVDRAAK

SEQ ID NO: 8733 - protein, 181 aa, Artificial Sequence; identical to SEQ ID NO: 8732
  Synthetic

SEQ ID NO: 8734 - protein, 185 aa, Artificial Sequence
  Synthetic
DEAEEVVDRARKLVKESEDLNRRSVEESEKLVTTSTELNKRTVDRLREIVEEVKDLVRKTRDEDTLRELVRRIEERLEKLLRDDREINKETNKESRRLNEEDKRINDESRKKLDELKKEIDKRGLPEDVLRKVKKTLEEVKRRDDEAMRRSHKKDDDSRKRDEESMRRSDEVVREVIEEVREAER

SEQ ID NO: 8735 - protein, 185 aa, Artificial Sequence; identical to SEQ ID NO: 8734
  Synthetic

SEQ ID NO: 8736 - protein, 187 aa, Artificial Sequence
  Synthetic
DEIEDVVRKVEEMVKESKDRVDRNVEESRRIVTESREKVKDSVRRVEEVVKEIKKLAEQGRSEEELKRILDEAEKTLRENRRRNKKVHEETRRRLEESDRHLKKVHEDTKRLLDALKEELKRLKEKIDDKVVKKVDDALKRVEKKDRDAIREVERVNREVEKDDERVLRDSERVLEEVRKRVEEVTT

SEQ ID NO: 8737 - protein, 187 aa, Artificial Sequence; identical to SEQ ID NO: 8736
  Synthetic

SEQ ID NO: 8738 - protein, 187 aa, Artificial Sequence
  Synthetic
SEIDEVVERVRKAVEDSRKVVEDLIKTVEDAVREHERLVRRVVEEVDKLVEDIRKLLERGESEEMLKRILEDAERRLKELKEELKRSNEDIERILRELKKELKKVHDRTRKILEELKRRLDELRKDIDERMLRKVDEVIKRVAREDERVVKKLEDVLRDVKRRVDEASKEVDRRLKEVKKRVEKEAE

SEQ ID NO: 8739 - protein, 187 aa, Artificial Sequence; identical to SEQ ID NO: 8738
  Synthetic

SEQ ID NO: 8740 - protein, 187 aa, Artificial Sequence
  Synthetic
KEAEEAAKRAEEAAKRHEDLAREAAKEAKRAADESRKAAEEAAKRAEKAARDIADLARKGLDEEALDRAAKRAKELLDELRKELEKVHRDTERLLDELRRRLERSDEEIEEILRRLKDELDKARERIDEKAARKAEDALRRAREIAKKASEDAKRALDEARKADEDAARKAEKALKEAEDAAREARR

SEQ ID NO: 8741 - protein, 187 aa, Artificial Sequence; identical to SEQ ID NO: 8740
  Synthetic

SEQ ID NO: 8742 - protein, 184 aa, Artificial Sequence
  Synthetic
DEEEELKEVVREVAERVEEVNRKSERELDKARKDSERALEKLERVLREVAERVKRVLDEASKRVPEELIKRIKEELEKMKREIEKILTDNRRKTEEMEKKIRKINEDSRDHLRKVEREVERVKDEGKDVKDVIRELEEVVRRNTDLVRKVEEEIRKVVEESKRSIEEVIKRLRKLVDDIRKAIK

SEQ ID NO: 8743 - protein, 184 aa, Artificial Sequence; identical to SEQ ID NO: 8742
  Synthetic

SEQ ID NO: 8744 - protein, 184 aa, Artificial Sequence
  Synthetic
DEREKLAEVVKRVAEDVKRMNKESREALKRVKEEVKRVNEKSEKVTREVKKEVERVIEEAKRTIPEELLKRIRDKLKKVEEDSRRTNEESKRHLKEAEDRIREINKRSEDHLREVIKKVEEVMTRGKDVEDVIRELEKVVEDNKRLVEKVVRDARKVVEDNKELVDRNVKRLEEVVREITKEIK

SEQ ID NO: 8745 - protein, 184 aa, Artificial Sequence; identical to SEQ ID NO: 8744
  Synthetic

SEQ ID NO: 8746 - protein, 186 aa, Artificial Sequence
  Synthetic
RDVDELVRELRDVVRKVLETARDSVRELKRIVTESLRRAEDLVKEITDVVREVLDAVRRARDKDTLKKLKDDAERVLERLERRIRELHERSRRVSEESEKLVRKLEEDAERVIRKVEDALRKRLKDNREVVKKLRDVIREVKEDVERVLKEVRDVNREVNKIDKEAVERIRRVLDEVRKRVDEAAR

SEQ ID NO: 8747 - protein, 186 aa, Artificial Sequence; identical to SEQ ID NO: 8746
  Synthetic

SEQ ID NO: 8748 - protein, 174 aa, Artificial Sequence
  Synthetic
KEIDDVVRELKEIAKRDEDKVRRVVEDLERVAREDLRKVREVVKELRRVVKTLLDLVRRGVDKRELKKILEELEKRVREVHDESRRTLEELDKKIKKVKEESERTLREAEKRARDIEKDKRLDDVLREVADIIRRSIRDLERVLEEVKRIIETSNDELRKVLKEVRETITEAER

SEQ ID NO: 8749 - protein, 174 aa, Artificial Sequence; identical to SEQ ID NO: 8748
  Synthetic

SEQ ID NO: 8750 - protein, 174 aa, Artificial Sequence
  Synthetic
SEIDEMVRKLKEMARRDLETVRRVVERLRKLAEDDLRRVRKVVKKLKELAKDIVRLVEEGSREEELEEILKRIEEEVRKVEEESKKSLREIREEVEKVKRESERTLEDIERKAEEIEESERLRKVLKEVKDIIRKSNKELDEVLRDVERIIRESIEELRRVLEEVKKIIKEARD

SEQ ID NO: 8751 - protein, 174 aa, Artificial Sequence; identical to SEQ ID NO: 8750
  Synthetic

SEQ ID NO: 8752 - protein, 181 aa, Artificial Sequence
  Synthetic
DEVDEAVRRLEEIVTRIEKDVDDVARRSEESAKEVEKAVRKVVEEHKKVAEDIRKLVEDGGDERELRKILEDLRKTSREVERALEEILRENDRLLTEVRRKLERILERLDELAEDVKRRVRGREVKERLKKVLDKVRKRIKRVVERLEEAARKSRKIIRDAKEELERVSREVEKVIRDVRR

SEQ ID NO: 8753 - protein, 181 aa, Artificial Sequence; identical to SEQ ID NO: 8752
  Synthetic

SEQ ID NO: 8754 - protein, 186 aa, Artificial Sequence
  Synthetic
EEVKELVERLRDLVRESEKRVDEVVKRLEDLVRRNEELNRELVTRLRDLVRKLEEKVKDTKDEETLRRLAEEVRKRLDELRREMEKINRDSERELDRLDREVERISETTERRLRELEKKAKDDIKDDKEMVREIKRVVDEVRKRDKEALDRLKKVIEEVRRKVKRSEDEARRVVEEVKRIVDRVET

SEQ ID NO: 8755 - protein, 186 aa, Artificial Sequence; identical to SEQ ID NO: 8754
  Synthetic

SEQ ID NO: 8756 - protein, 186 aa, Artificial Sequence
  Synthetic
REVDDLVRRLEELVRRNEKKNEDVVRESKELADRSRKLVKELVKRLRELVKTVVRLVEETKDEDTLRRLIEEVEKRLRDLKREIEEISKETKKRDEELLRKAEKINKDSKDRIEDLLREAKRRIKDDKELVRKLKKVVDEVRERIDRSTEEVRRVSKESKDIDKRAKEEIEEVLRDVEKKLRETAT

SEQ ID NO: 8757 - protein, 186 aa, Artificial Sequence; identical to SEQ ID NO: 8756
  Synthetic

SEQ ID NO: 8758 - protein, 186 aa, Artificial Sequence
  Synthetic
DEFRDVVRKLEKLVEDITREAEEVVKISKALAEENKRLNDELVDRLRRLVEEVRKKVEDTKDEETLDEELRRVKETLKRLLEEVERINKESREKDRKLKEEVRKRIEEVEERLRTLLEEVKKRLKDDKEVVKRVKDVVDRVRDEVRRVAEKVDRVSKESKRIIDESTKRAREVLERVRKRVEDERK

SEQ ID NO: 8759 - protein, 186 aa, Artificial Sequence; identical to SEQ ID NO: 8758
  Synthetic

SEQ ID NO: 8760 - protein, 186 aa, Artificial Sequence
  Synthetic
SEVDDIARKLRDLVRRNKELNDEVVRRSEKLVKENKELNEELVRRLKELVDRLEDEVRRTKDKDRLREIIREVRERLKRLLDTIKRINDESRKEDKRLLDEAERINRESRKKIDKLEKDAEKDIKDDKEMVKKLRKVVEEVRREIDDSMRKVKKVSEDSKRRIERSTEEIEEVAKRVADKVTDVER

SEQ ID NO: 8761 - protein, 186 aa, Artificial Sequence; identical to SEQ ID NO: 8760
  Synthetic

SEQ ID NO: 8762 - protein, 178 aa, Artificial Sequence
  Synthetic
RELEEVVRELRKLVTEDLDRVRKSVEESERVVREDERRVDESVKRTREIADEVRRLKEEGVDESRLRELLKRVEDMNRESLKRSEDSLKRLHERNRKSLKESRDSLEEAERRVEDVRRRGVDEEELKKVLKEVRKVVTDSERRDKEANRKVEEVIRRSKKKDEDAHREVRKVVEDVRT

SEQ ID NO: 8763 - protein, 178 aa, Artificial Sequence; identical to SEQ ID NO: 8762
  Synthetic

SEQ ID NO: 8764 - protein, 176 aa, Artificial Sequence
  Synthetic
SKDEKLEKVIREVKRVIERVSKESEDVLRKVRKVIEDVSRESRRVLEDSRRVLERVAREGKRDERIKEVEDRSRRTLERLEELNDTVRRLLEEVVRRLRELNKDVERRLRDLARKLKDLDVDEVVDRARRIVDDVDRLNREVVKRLKDLVEDLRRLNEEVVRRNKELADTVRKDVR

SEQ ID NO: 8765 - protein, 176 aa, Artificial Sequence; identical to SEQ ID NO: 8764
  Synthetic

SEQ ID NO: 8766 - protein, 176 aa, Artificial Sequence
  Synthetic
SEDEKLKEVVDEARKILEDADRELKRVVKEVEDVIRDVSKKSTEVRKEVKEILKEAADKGDEDERIREVEKTVEDLLRKLEEMNRRIEETLKKLAEEVHRRNREVEKEVEDLARRVKELDVDKVVDDLRKLAEDLLRENKEVVDKLRELVERVKKLNEDVVREARRLADEVLKRVT

SEQ ID NO: 8767 - protein, 176 aa, Artificial Sequence; identical to SEQ ID NO: 8766
  Synthetic

SEQ ID NO: 8768 - protein, 179 aa, Artificial Sequence
  Synthetic
SEVERLEERLKRIVEDIKRLVKKSVEDSRKIVEEIRKLVKDSVEKNKRSVEEVEDIVRKDKDVKERLEELVRRDEEVNKKTKEDIKELLDRVREINERTNEKIERLLRELKKEIDDVRRRGVDEERVKRVLREVEERVKEVKKENEKAHEEVRKDVERVLEDDDRALRESRERAERVKK

SEQ ID NO: 8769 - protein, 179 aa, Artificial Sequence; identical to SEQ ID NO: 8768
  Synthetic

SEQ ID NO: 8770 - protein, 179 aa, Artificial Sequence
  Synthetic
TEVDELLDSLRKIVTEIEKLVEESEKRLREIVKTIEKLVKDSVRTLKKIAREIEELAKDRKEVEDAIRKLLKEVEDIVRETNKTSEELARRIRKLVKEVNERTDKLRREVEREVEEVKKNGVNEERVEKVLREVRDRVKKVNKRNEDALREVDKKVKDVNKENEDVLEEARRVVEEVRR

SEQ ID NO: 8771 - protein, 179 aa, Artificial Sequence; identical to SEQ ID NO: 8770
  Synthetic

SEQ ID NO: 8772 - protein, 174 aa, Artificial Sequence
  Synthetic
REDEKIKKVVEEVRKKLEDVDKNSRDAIEDDKRVNKEVDRNSERAFKENEDEIRKVKEAGVDEKKLKESRDNSKRVLDRSKELLKRSEENTRRLAKESKELLKEVRDRLEDLRRRVKNADEVVKELERIVAEVEKLSREVVKRLKENVKRVRDLSKRVVEYLKEDADRLKEDVR

SEQ ID NO: 8773 - protein, 174 aa, Artificial Sequence; identical to SEQ ID NO: 8772
  Synthetic

SEQ ID NO: 8774 - protein, 174 aa, Artificial Sequence
  Synthetic
DEERKIRKAVEDVRRVIKEVEENSKRVFDENKKVIDDVRKEVEKVLKENRDVIKEVRDKGVDEKLLDESRRNSERVVTKITKLLKDSEDNSRRLLEESKRLAEDVRRRLEELRKDVSNADEVLKELKKLVEELEKLSREVVKYLREDAKRLKDLVRKVVEYLKEDARRLDEEVR

SEQ ID NO: 8775 - protein, 174 aa, Artificial Sequence; identical to SEQ ID NO: 8774
  Synthetic

SEQ ID NO: 8776 - protein, 186 aa, Artificial Sequence
  Synthetic
SVVEKLLEDARRVVEKVREAVERNLKKVRDLVKKLREDVKRSKDHLEEVVRKLEEAKKTTDEKVLRDLKREVEEVLKRNEDLTRKLKEEAERINKESKDHLERLREEIERIIEDLRRKLEEAKDRVSEEVERRVEEVIRDLERVLREVRERVRRINEESRRMLEDVERESRKALRDLEEVLDRVRR

SEQ ID NO: 8777 - protein, 186 aa, Artificial Sequence; identical to SEQ ID NO: 8776
  Synthetic

SEQ ID NO: 8778 - protein, 186 aa, Artificial Sequence
  Synthetic
SVVEELRKRVEDVVDEVREVVERNRDLMRRVAEESKKIVDDSLRHIKEVVDEVRRAKNTTDEKVLDDLRKKVEEMLRRNEETTKRVSEKSEKINKESEDHLRELRKKIKKIIEDLEDRLRKAKDTVDERVKKRVRDVLRKLREVLERVAEEVKKVNKRSREVNKRVEEKSEEVLRDLERVLREVET

SEQ ID NO: 8779 - protein, 186 aa, Artificial Sequence; identical to SEQ ID NO: 8778
  Synthetic

SEQ ID NO: 8780 - protein, 178 aa, Artificial Sequence
  Synthetic
SEVEEVVERLRRKAEEDLRRVEEAVKEHRRVVKEDLDRVRDAVERHREVVETIRKLKEDGGDEKELKKIEEDLERSSRKVKEESDRTLERLEETSRKVDKESKETLDRLREEVKDVARRGGDDEKLKRVLKEVEEVVRESKERLREVHEEVRKVIEDSKRILKTVHDDVRRVIEEVKK

SEQ ID NO: 8781 - protein, 178 aa, Artificial Sequence; identical to SEQ ID NO: 8780
  Synthetic

SEQ ID NO: 8782 - protein, 178 aa, Artificial Sequence
  Synthetic
DDVERVLKELDELLKRDETEVREVEKRHREVLETIERRVREVIERHKEMLRRLAELVRSGGSEETLKEILDRLRRTSEELKKELEKILRDLERTSREVEERSERTLREIEKRIEDLRRKGGDVEELKKVRDKVRRVIEESKRRLEELHEEIRRLITELKRRLEEVTEEIKRAIDELRR

SEQ ID NO: 8783 - protein, 178 aa, Artificial Sequence; identical to SEQ ID NO: 8782
  Synthetic

SEQ ID NO: 8784 - protein, 178 aa, Artificial Sequence
  Synthetic
DEVEDVVRRLRKIVEDIRRDVERVVEEHDRVVRKLKRRVEEAVEEHRKVLEEIKKVKENGGSERELEEIAKKMEESSRRVEEEIERIARELDRTSEEVKKRLEKLLRDVREEVKKVAKDGGDREDLKRVLKEVEDVVREVDKILTDATERVKRVITEVKDILRRVHEEVREVIKRVKE

SEQ ID NO: 8785 - protein, 178 aa, Artificial Sequence; identical to SEQ ID NO: 8784
  Synthetic

SEQ ID NO: 8786 - protein, 178 aa, Artificial Sequence
  Synthetic
DEVEEVVRELREILKRDLDEVRKAVEDHERLLREITKDVKRVADRHRDLLRKIRELKENGGDEKLLKKIEDELRRTSEEVKRRLDEILKRIRDTSEEVKERSKETLKRLEDRVREVAREGGDDEKLKRVLKELEDVIRESEEILERVTRKAERVIERVRKILEEATKEVERVIREVRR

SEQ ID NO: 8787 - protein, 178 aa, Artificial Sequence; identical to SEQ ID NO: 8786
  Synthetic

SEQ ID NO: 8788 - protein, 172 aa, Artificial Sequence
  Synthetic
EEDERIEKVTEEVKKVIEDVTRLTETVMRESEKVIEDVTRDSDRVRKEVKKVLEKVRKSEELDDVARKLEKLFRDLARTNKKVKDDSKRTIERLREKNEKVKRDVDRLRKKVKSEDVDEVVKRLKELVTRLAEENKRAVDTNRKLAEDLKELNRKAVEELKELLRRVDERDR

SEQ ID NO: 8789 - protein, 172 aa, Artificial Sequence; identical to SEQ ID NO: 8788
  Synthetic

SEQ ID NO: 8790 - protein, 172 aa, Artificial Sequence
  Synthetic
SEDEEIDRVDKDVKRVSDTSNKILDDVEKEVDKVIREVTAESKKVLDEAKKVLDKVREDERLKEVATRVKELFDRLREENKRVRRRLREIVKRVRELNRRSEEEIRRIKEEAKDRDVEEVVRRLEKLVDDDRKLVEKVVKELRELLKELRDKNKEVVDELRRLAKTVDEEDR

SEQ ID NO: 8791 - protein, 172 aa, Artificial Sequence; identical to SEQ ID NO: 8790
  Synthetic

SEQ ID NO: 8792 - protein, 177 aa, Artificial Sequence
  Synthetic
SAEEIAERVLRELRKVTKEVAEEDERVLREDEKVTDEVRKEDKRVLDEARKVIDDVRKKGIPEEVLRRAEEVLERLRRKSEEILKESKKSTETSRRESEKVLRDSEDSIRELEERAKKTKVDEEVVKRVRENVKRTRELSKRSVEKNEENVRRTREMSKRTVKEIRDVVKELRDRVK

SEQ ID NO: 8793 - protein, 177 aa, Artificial Sequence; identical to SEQ ID NO: 8792
  Synthetic

SEQ ID NO: 8794 - protein, 177 aa, Artificial Sequence
  Synthetic
SKREKAEEVLKEAKKVIDDVREKDRRALEEDKRVTDEVARIAEKVLKDLRDVIEEVRERGIDKRVLDTIKELLERLEKELRDVLKRSKESTEESKRKSEEILRRAEEVLKRLEEELERTRADEEVVRRVRKVVTELEELSRRSVEENRRNAEETERLIREIVERARRVVETLKETVR

SEQ ID NO: 8795 - protein, 177 aa, Artificial Sequence; identical to SEQ ID NO: 8794
  Synthetic

SEQ ID NO: 8796 - protein, 181 aa, Artificial Sequence
  Synthetic
SVEDILRKVAKEAEDVAREVTRILEEANRRVEEVVKRVKEENERANEKVERVVREVKARGLNREELEKILRKIHEENKKMKKRHEDILKRIHEENKRVLEELKRILEEVKELLKEVAKRVRDEEVVRRVVETVKDIVKRLRDIVREVLKKNERIVEELKKTSDESKKRNDDIVRELDERAR

SEQ ID NO: 8797 - protein, 181 aa, Artificial Sequence; identical to SEQ ID NO: 8796
  Synthetic

SEQ ID NO: 8798 - protein, 181 aa, Artificial Sequence
  Synthetic
SVEEILEEVLRRAEKIVKEVKDLDRRALEENKKAIKEVADELRKVDEEVKKVVDEVRREGFNDETLDDILRRIHESNKRVKEKSDESLKRSAEKSEDSRRRLEKITKEVRDTLREVRKRVRDEDVVRKVVRDVEDIVRRMREEVRRSVEDLKRNADENRDEVRKVVKENKDIVREMRERVR

SEQ ID NO: 8799 - protein, 181 aa, Artificial Sequence; identical to SEQ ID NO: 8798
  Synthetic

SEQ ID NO: 8800 - protein, 174 aa, Artificial Sequence
  Synthetic
REKEKLEKAVRDARRVIERVERKDREALKEVERVVRESHKTLEDVLREIRKVATEVRREGLDREKLKKLLDDVEDVIRKAHELSERILREVEDVSRRSKEALKRIEEEIEDLVRKLDDVDKLMKTIEDLLRRVEELVDRSVKELKRLLDENRKLVKRVLEEIRRILKELRDEVK

SEQ ID NO: 8801 - protein, 174 aa, Artificial Sequence; identical to SEQ ID NO: 8800
  Synthetic

SEQ ID NO: 8802 - protein, 174 aa, Artificial Sequence
  Synthetic
DEEEKLRKVKKEADDVIRRSHEEDERVLREVEKVVRESHEELKRVADEIRRVVEEVKTRGMDREELERLREEVRRLLEEVHEKSKEIEEEIKRRSEESHRRSKELKERVADLERKLSDVDKVMETIRRLVTKNRELVKRSVDELRDLVDKNRKLVERVVERIEEIAKKARDDVK

SEQ ID NO: 8803 - protein, 174 aa, Artificial Sequence; identical to SEQ ID NO: 8802
  Synthetic

SEQ ID NO: 8804 - protein, 182 aa, Artificial Sequence
  Synthetic
KVVEEIEKEVRRSVEELERLVTEDLRKVKEVVKRAEEVAEEDERKVDEVVKELKRAAKEGRDKRELEEEVRRVHEDSKRTLEELRRDIKRVNEDSRRSLEEIDKLSRDVKKRLDEMVRDLVRTEEMERRVREVLKRNEDVTDEVKKKIEESNRDLEDALRKVEKKIRESNERLRRVLEEVRK

SEQ ID NO: 8805 - protein, 182 aa, Artificial Sequence; identical to SEQ ID NO: 8804
  Synthetic

SEQ ID NO: 8806 - protein, 175 aa, Artificial Sequence
  Synthetic
KEVEDVLDDVRRVVEKLEREVKKVEDTNERVVETLDEIVKEIRDRNRKVVETLKEIMKSNKESKDELKRILDEVHEDNRRILEELKDLLRKVHTENRDIKRRLDKELDEVRRRIEKVGTSDKLRKAEKDLRDVAKEVRDKIRRADERLKRVIERVADEIRKVNTDLKRVADEVRK

SEQ ID NO: 8807 - protein, 175 aa, Artificial Sequence; identical to SEQ ID NO: 8806
  Synthetic

SEQ ID NO: 8808 - protein, 174 aa, Artificial Sequence
  Synthetic
SEVEDVEREIEEVVEELRKIAEDDLRRNDTVVKEVRELVKRDREKNRKSAEELKKLKEEGRDKTKLEEIFRRDEEENERSRRELKKLLDDVERENRKTLRDLERILRRVKKRLDEFRDSEELKRVMEKITRVVEKVKEDVDRSKKKAEEVIREVEERLKRSLDESRKVLEEVKK

SEQ ID NO: 8809 - protein, 174 aa, Artificial Sequence; identical to SEQ ID NO: 8808
  Synthetic

SEQ ID NO: 8810 - protein, 174 aa, Artificial Sequence
  Synthetic
REVEEVKKRVDEVVKRLRKLAEDDDRKNKESADRLRAIVDRDKKENTRSMETLRRLRERGEDRDELRKIVKDDREKNERSEKELKDILREDHKENKKSEDTLEELLRRAAEELKAVDRSERLEDAKKKLEDVIDEVRRRLEESNKRSRDVMEEVRKEVRRSLRESEEVVKDVEK

SEQ ID NO: 8811 - protein, 174 aa, Artificial Sequence; identical to SEQ ID NO: 8810
  Synthetic

SEQ ID NO: 8812 - protein, 174 aa, Artificial Sequence
  Synthetic
DEVREIKRLVDELVKRLKELAERSRRLVDEVAKRSKELAKENLDLNEDIVRRLDEVAKRGEDRKVLEELRDRIRKINEESKRRDDRLLEEIRRISEETKRRLKKLRDEIRELIERIRDTKELKDVAREIERVLKEVEEEDDDALRKIEEVSKRSKEIIDESMEKVKKVMEDVTR

SEQ ID NO: 8813 - protein, 174 aa, Artificial Sequence; identical to SEQ ID NO: 8812
  Synthetic

SEQ ID NO: 8814 - protein, 174 aa, Artificial Sequence
  Synthetic
SEVETVKKLIEDIVRESRRLVRENEELNKDVIRRSEELVRRSKEAVKRLVDKLDELRKRGSPEDDLERLLREIERISEETKRRDKKLLDEIEEINERSKREDDKLLTTVREIVKAVRRARELERAVEEIERVSRDSKREIKRSTEEVRKASERSRKEDEELERRARRVVEEVKR

SEQ ID NO: 8815 - protein, 174 aa, Artificial Sequence; identical to SEQ ID NO: 8814
  Synthetic

SEQ ID NO: 8816 - protein, 175 aa, Artificial Sequence
  Synthetic
SELEKVVEEVEEIVRRSERHVTEVVKTSKKSVEDSNRHVAKVVEDVKKKVTELIEAARENRVDKRELTREAERVEEELRKVLRTNEKLAEEDKRRLEKVARDNERLIDEVRRELDKVRKDKVLERVKRELKKAADRSRDIIRRVARETEEALRTSREIAKRVEDELRRVLEEVRK

SEQ ID NO: 8817 - protein, 175 aa, Artificial Sequence; identical to SEQ ID NO: 8816
  Synthetic

SEQ ID NO: 8818 - protein, 175 aa, Artificial Sequence
  Synthetic
KELEDVVKRVREEVRRSLEHVAKAVKESEDSVRELKEEVDRVVKESEDIVRELEKLKRENRVDEKELEKIAKENVDRNDTVREELERRVEEDERRLEKILRENEEEVERVERELRKVRDDKRLKEVDKELKRALEESRKIIKKVKEETKDVLRRVRDILRRSVRTSEKVLKEVKD

SEQ ID NO: 8819 - protein, 175 aa, Artificial Sequence; identical to SEQ ID NO: 8818
  Synthetic

SEQ ID NO: 8820 - protein, 178 aa, Artificial Sequence
  Synthetic
SKVERVVEESRENAKRDLDRVDKVVKDSRRSVEEDLKEVRDVVKEVDDMLREAEELMRRGEDEREIERILEEIERRLREVEKKSEKSFREDEERLKRVREESERNLREDRKRLEEVRKDNVDEKVIREVAKESEDAFRESERRLREVLKRSAEALKRSRDILKTVRERVKRVIDEVRR

SEQ ID NO: 8821 - protein, 178 aa, Artificial Sequence; identical to SEQ ID NO: 8820
  Synthetic

SEQ ID NO: 8822 - protein, 178 aa, Artificial Sequence
  Synthetic
REVEEVVKRSEKSVKEMEDKSRETVKKSRKSAKEDIDKVEEVVRRVEKVLREAKKLADDGEDRRTIEKILRDIEEELRRVEEESRRSLKKDREDNKKSLKELEELFDRDRRELEEVAKRNVDKDVIEEVRKKSDEVLKRVRKINKEVTEESERAFDESRRILETVAREVKRVIDEVRR

SEQ ID NO: 8823 - protein, 178 aa, Artificial Sequence; identical to SEQ ID NO: 8822
  Synthetic

SEQ ID NO: 8824 - protein, 179 aa, Artificial Sequence
  Synthetic
DAVEREVRKAEKIVEDDLRRVAKVVDESRKSVEKNEEDVRRVVEELRKILEEIDRLKRNGGDDESLERIARELEDLIRRVKERSDENVEENERLLRRVEEESKDSLKKLREALKRIRDNNVVDERVLRRVKKKLEDAVEDSRRILTELAEEVKTVVERSKRILDTVRDELKKALERVKK

SEQ ID NO: 8825 - protein, 179 aa, Artificial Sequence; identical to SEQ ID NO: 8824
  Synthetic

SEQ ID NO: 8826 - protein, 182 aa, Artificial Sequence
  Synthetic
DEVDEVVEKLRRLLEDTIRLVREAVDYLRRNLEDLRRKIREIVERLKRLLEELRKLVKDTRDEETLKKIIEDVRRTVEELLKELEEILRRSEENVKRVLKRLEEILKKSSDDLRKELKRVREAGLDEKRVRDAADEVRRMNEEVKKIIDDARKELERVHRDVKREIDRVARELDEEIRRVEK

SEQ ID NO: 8827 - protein, 182 aa, Artificial Sequence; identical to SEQ ID NO: 8826
  Synthetic

SEQ ID NO: 8828 - protein, 182 aa, Artificial Sequence
  Synthetic
DEVREMVKTLTDLLRRNRELVKRVVEELRKLLEETRKLVEDMVKELEDLLRELEKLARDTEDKDTLRELIERAKRKVEELRKRLEEILRRSHEELRRLEERVRKIDEESKKRLRELEEEAKRAGLDEKVVEEVARKVARANEDSNRILDEARKEVEKVNEEVRRIIKEVTDRLEKKVREVEK

SEQ ID NO: 8829 - protein, 182 aa, Artificial Sequence; identical to SEQ ID NO: 8828
  Synthetic

SEQ ID NO: 8830 - protein, 178 aa, Artificial Sequence
  Synthetic
SKAERLDEEVDKIVRDLRRLVDELEKRIEKIVRDNRELVKRVRESNKRIVETLRRLKENRGDKRVLDKIARDIHEENKRALERSEKSAEDVERELKKVKDELKEIVDRVKKTLDEARRAGVDKREVDKIEKKLRDVVREVEEIVTRVDKRLKDVLKESREILKEVNDETKKVLDEVKT

SEQ ID NO: 8831 - protein, 178 aa, Artificial Sequence; identical to SEQ ID NO: 8830
  Synthetic

SEQ ID NO: 8832 - protein, 178 aa, Artificial Sequence
  Synthetic
SEAEKVVRDVREIVERLRDIVRKVVEENEEIVKRLRKLVTDLVEENKRTVEALRDLKRRRGREEELEKIAEDDKRRNEEVRKDLERIAKEVHDRNREVLKTIKRILDEVKERLDDVRRRGVDEEILRRVEEEARRAAKEVEERIRTVNRRTEKVLEEVRKIVKDATDTSEKALREVRE

SEQ ID NO: 8833 - protein, 178 aa, Artificial Sequence; identical to SEQ ID NO: 8832
  Synthetic

SEQ ID NO: 8834 - protein, 176 aa, Artificial Sequence
  Synthetic
SRVEEVLRKVEEIVKRNEDLARKVVDESRKTVDKLRTLVEKVLRESRETVKRLIDLVRRNEVDKRRIEELAERDKERLKRVLEEIEREAREDERRLTDVVRRSEESIRRLKEDLDRANAREDLLTRVTDVLRKLRDRSREIIKRVVDETRRVLEEVKELIKRVLEETERVLREVRR

SEQ ID NO: 8835 - protein, 176 aa, Artificial Sequence; identical to SEQ ID NO: 8834
  Synthetic

SEQ ID NO: 8836 - protein, 178 aa, Artificial Sequence
  Synthetic
SEVDEVVDRSRKTVKKMIDDVREVLERSRKNVKEDIERVRKVVRESEETVKTARRLKEEGADDREIKRLIDEDRERLRKVLKESEDNLRENKRENDDMRRRIEKLKRDDERRLDRVEEEGVDEEVLRRVREVTERATREVEELLKRSDEESERALKTSTDVLREVLERSDKVEEEVKT

SEQ ID NO: 8837 - protein, 178 aa, Artificial Sequence; identical to SEQ ID NO: 8836
  Synthetic

SEQ ID NO: 8838 - protein, 182 aa, Artificial Sequence
  Synthetic
KEVEEAVRRVEESVRRLEEEVDRVVKENRKLVKDLIELAEEVVRRVKELVDRLRETVRRAKDKDTLDKLIREVADRARRLVERIDEILKEIKKRSEESLERIRDSLRKHHEELKRLIKEAEDRGLDKDVVTEVKKRAEDVDRRVERVIEEAEEVSREALKRVRDIIDTVRKVAETVLKEVKD

SEQ ID NO: 8839 - protein, 182 aa, Artificial Sequence; identical to SEQ ID NO: 8838
  Synthetic

SEQ ID NO: 8840 - protein, 177 aa, Artificial Sequence
  Synthetic
KEKEVMDEVERVLEKVKEDNRRVVREVEDVLRRVEKENKEIVDEVKDVARKVLEEVRRRGIPEEVLKELEDILRELDKKVRESNKRTRDIIERLRRDVERSNKELKDIVRELRKELRDTRVDERVLEKVKDVVRRSRDIVRRILEDAKDVVRKSREIAKKILEEVTEVVKRAREKVK

SEQ ID NO: 8841 - protein, 177 aa, Artificial Sequence; identical to SEQ ID NO: 8840
  Synthetic

SEQ ID NO: 8842 - protein, 175 aa, Artificial Sequence
  Synthetic
SKLEELLKRSEKSVREAKRLVEELKRRSEETVRRNKELAERLEDESRKTVELLKRIVDSNKEVRETIEDIVRRDREKLEEMRRRSEKSLDEDRRRLEEMRKRIEELLRRDEEDLRRVEPDKLLEEVEKESRKVVEDVRRVIEDVKRRSDEALKESEDIIRDVRRKSEKALRDVEK

SEQ ID NO: 8843 - protein, 175 aa, Artificial Sequence; identical to SEQ ID NO: 8842
  Synthetic

SEQ ID NO: 8844 - protein, 175 aa, Artificial Sequence
  Synthetic
SELEDLLRRSKESVDRLRELIRRLEDESRKTVETLRDIVKKLKEENKKTVDDLRDIVRRRKDDEETIEKIFKEDKERNEEATRRIETILTRDREKLEKVLREAEKLIRDDKRRLKEIEKDELLERVREVSDKVLEELKKIIDEIRKRSEKVAEEVKDVIRKVNELSKKVLKDVKK

SEQ ID NO: 8845 - protein, 175 aa, Artificial Sequence; identical to SEQ ID NO: 8844
  Synthetic

SEQ ID NO: 8846 - protein, 175 aa, Artificial Sequence
  Synthetic
RKLEELLKRSERSVEELRRKVTRLLEENDDTVRRLRELVTKLTDDSRKTVTRLRDIVRKDKDVTEEIKRIVEEDRRRLEKVKRDIDKLLREDRKRNRDVEEELRELLERDRDELRKVEPDKLLEEVTKVSEKVAEEVRRVIKTVNDKSTEVLREVKRVIETVRRESEDVLEKVEK

SEQ ID NO: 8847 - protein, 175 aa, Artificial Sequence; identical to SEQ ID NO: 8846
  Synthetic

SEQ ID NO: 8848 - protein, 175 aa, Artificial Sequence
  Synthetic
SKLEDLLRRVTEIVKRLEEIVRKLEERSRRTVKRLEELVDTLRKENEDTVRRLEKIVRDRKDDTDKIRDIAEKDRRRNKEVKDRVKKLLDDDRELLERVRREIEEIVERVREELDRVEPDELLKEVRDVLETVVKRVREIIEKVRKESEDALRKVDKDIREVNRRSEKALEDVKT

SEQ ID NO: 8849 - protein, 175 aa, Artificial Sequence; identical to SEQ ID NO: 8848
  Synthetic

SEQ ID NO: 8850 - protein, 175 aa, Artificial Sequence
  Synthetic
SEAEKIEREVDKVVEDHRRLVRADLERVERVVEEHRRLVKEDLDRVDEVVKRLRKLKEDGTPKEEIRRLIEEVERRSRESLKEIKRTTDEVRKESKKSADRLRETTERAKKRLDEANVREDVLRRVRELLKTVHEEVKKVIKTSDDILRTVHDEVRKVIKTSEKILREVAEEVER

SEQ ID NO: 8851 - protein, 175 aa, Artificial Sequence; identical to SEQ ID NO: 8850
  Synthetic

SEQ ID NO: 8852 - protein, 175 aa, Artificial Sequence
  Synthetic
KELEDATREVETVADEHRRVLEEDKRDVKEVVERHRRLLEDLRRKLEKVVRDLRKLLKDGVPKEELKKLVDDLKRTIDRLLREAEKTTREVDKKSERSVRELERTSKEMKERLDRLNLREDVLRRIEKKLKDVTDDLRRVIKESKDRLTKLHKEVEDALRRLRDRLRELEDEIRR

SEQ ID NO: 8853 - protein, 175 aa, Artificial Sequence; identical to SEQ ID NO: 8852
  Synthetic

SEQ ID NO: 8854 - protein, 182 aa, Artificial Sequence
  Synthetic
RELEEAVKEVEKKIRELRERLKEVVERSTKKMDDLRKENEKVMRESSELVTELVKEIKDRASDKDKARRVIEELEKVNRELKKEHDKTVKELEDVNRRIERKAREVERELEEVLRDIERLIREGVDLKDLRKKVDDVARKVDKILEDLERESDTVLDRVKKVLERSRRDSEDVARRVEEKVR

SEQ ID NO: 8855 - protein, 182 aa, Artificial Sequence; identical to SEQ ID NO: 8854
  Synthetic

SEQ ID NO: 8856 - protein, 183 aa, Artificial Sequence
  Synthetic
SELDELRKMVKEVLDRVRDLLKKLEDEARKVAEDNKRLLERNKREIEAALRRVEEIIRRRRTEDVRREVEKILEELIRESERSVRESKKHLDDVKRRVEEIVRRIKKELDDLLREAKRIVDEKEDKRVREVLREVEKRIKELEDLVRKVLDKIRELIERLKRETDKVLEESKKLIKELSERLE

SEQ ID NO: 8857 - protein, 183 aa, Artificial Sequence; identical to SEQ ID NO: 8856
  Synthetic

SEQ ID NO: 8858 - protein, 183 aa, Artificial Sequence
  Synthetic
DELEDVRKEIEDVRKENEDTVRESKDEIRRLEDTNRKTLKESRDDIEKARERVKKERRDSDKRVLERVAEELRRIVKRIREKDKEVIERSRKILDENRRRNEEVIKKTEKRLEEIRDRLSRVENEKDVRKVLKEVEEEARELVKLNRDVLEELRRRVRKLVEDNKDVTREVEDILKKLEEELK

SEQ ID NO: 8859 - protein, 183 aa, Artificial Sequence; identical to SEQ ID NO: 8858
  Synthetic

SEQ ID NO: 8860 - protein, 176 aa, Artificial Sequence
  Synthetic
SMDETIRKLAEDNRRRSDETVERIERLAKKLDEDNRRVVEKSERLAKEVADKVRRVKNTTDERELKEVMEELERILKRIAEDHEKVIRDSEDILRRIEKLVERSIRESRKSLKRIRELKVDERVIKEVEDISRDLERKNKEVVERARRIVEKVKETNKRVLEEVEKIVRKLKEELK

SEQ ID NO: 8861 - protein, 176 aa, Artificial Sequence; identical to SEQ ID NO: 8860
  Synthetic

SEQ ID NO: 8862 - protein, 184 aa, Artificial Sequence
  Synthetic
SVEEVVEEVRRVAEKVEEDVTRVIKEDEDIARELEKRIDDVIKESKTVADELLERLRRAGADRRLLEEVRRLMEEVTRRHEELRREVEERVKDSKRRHDESRKELEDLLREVEERARDVRRRGGIEEELERLLREVEELIERVKERHKRLVEDSKRLLDEVDKRLKDSNREVRERIEEIKRRVD

SEQ ID NO: 8863 - protein, 184 aa, Artificial Sequence; identical to SEQ ID NO: 8862
  Synthetic

SEQ ID NO: 8864 - protein, 175 aa, Artificial Sequence
  Synthetic
DELEKIREEVREIVERSKREAKELLDRNKEIVKDLERKAREILRENRDRVRRLAEKTNEDEKTVRELLERNKKVARDVEDKVRKLIEDNERVARESEKRIRESEKKNRDVLRELEKRVDSEVLDELRRIIETSEKLNRDVLRESKEVNRDLTRKLEEVLRRSKEDNKRLSEKIKE

SEQ ID NO: 8865 - protein, 175 aa, Artificial Sequence; identical to SEQ ID NO: 8864
  Synthetic

SEQ ID NO: 8866 - protein, 175 aa, Artificial Sequence
  Synthetic
DELEAIKDEVRRIVRESEERAKKILRDVERMLDEIRKKLKEILDRNREVVDELKRQINEDKETVERLLRDNKRVLDRVEDSARRLEEELKRVLDEVEERVKRSLDRNDEVLKELEKRVDSEVLKELRRIIEESKRRNKRVLDEIRKRAEDLRRVIKEVLDRSREINKRLSDEIRK

SEQ ID NO: 8867 - protein, 175 aa, Artificial Sequence; identical to SEQ ID NO: 8866
  Synthetic

SEQ ID NO: 8868 - protein, 175 aa, Artificial Sequence
  Synthetic
DELEKIVREVREIVKESKEEARRILEENKKIVEELRRRLRKILEENEDMVRKLEKKTNEDKDTVRRLLEENKRVAKEVEDKVRKLIKENEDVMREVEKKVEKSLRDNKRVLDDVRRRVDSRVLEELERIIRESEEANKKVLEDSRRVNKKLSEELKRVLDESRRRNEELSKRIKD

SEQ ID NO: 8869 - protein, 175 aa, Artificial Sequence; identical to SEQ ID NO: 8868
  Synthetic

SEQ ID NO: 8870 - protein, 185 aa, Artificial Sequence
  Synthetic
DELRDLEREIRRIVEESERHLKEVLERNHEASKRNRDDLKRMVDDIRRKVEEVRKLREEGTDKEKLKEELERALRKVEKIARDSERHLDKVLKESREAIERNERENRRLLEEVKRTIEELRRRTDAETVDRVLEKLKRIVEDSERRVKEVLKELEENSKRIKDETKDVLRKVEEIVERLRKEIER

SEQ ID NO: 8871 - protein, 185 aa, Artificial Sequence; identical to SEQ ID NO: 8870
  Synthetic

SEQ ID NO: 8872 - protein, 185 aa, Artificial Sequence
  Synthetic
DELEELKEEVKRAVDENRETNKRALDRNHEISKDSEDHLRESSERIRRRIEELARLVEAGEDKRRLEEDVKRLLEESKKLIKENKDRNREVVRRSEKIAEDSKRHLDAVLEKVERTIRKLREETDRETVKKVLKELREEIERVKRESEKVVKAVRDNSKRSEEKVEEVLERNKRIVDDVLRKIKK

SEQ ID NO: 8873 - protein, 185 aa, Artificial Sequence; identical to SEQ ID NO: 8872
  Synthetic

SEQ ID NO: 8874 - protein, 185 aa, Artificial Sequence
  Synthetic
DELKEAEDRVREVVRENEERLRKALEENHKISRDSEKHLRDLERTIKEIVKRVRDLRRRGTDKEELKKELERVLDKVRKDITDNLRTNEEVLKRSERIAEESERHLDKVLKDLEDIARKLKDKTDKDTVEKVLRDLRRIIKEVKERSREVLKRVRENSDRSLKKVEEVLKRLEDIIRTVKEEIKK

SEQ ID NO: 8875 - protein, 185 aa, Artificial Sequence; identical to SEQ ID NO: 8874
  Synthetic

SEQ ID NO: 8876 - protein, 179 aa, Artificial Sequence
  Synthetic
EDAERALKKIEEIVRRLTEELKRVLDANRESVDRLRRELEEVLKRNRELVRKLEKILEERKDDQDTARKVIEDSERHIKELEERVERVIRENKKTVDDALKRVKDVVERLKEEVKRLEDRGVDREVVERLKKIIADLDRVVEEVIRTSRKVIKELEDTVRRVIEELKRVSDELKKKVED

SEQ ID NO: 8877 - protein, 179 aa, Artificial Sequence; identical to SEQ ID NO: 8876
  Synthetic

SEQ ID NO: 8878 - protein, 178 aa, Artificial Sequence
  Synthetic
DKLEELLKRVEELVERLKEESERVLRRNHELSEKLRRILEEILKRNHDLSRDLEDRLRKLKDKKEVDDLVREVLKRSKETVETLRRIVEEIKKRSEDSSEENRRRVKEALDELDRLVKRIEGDEVVKRVEDIIEKVREDLERSDEKLNDNVRRLEREVREVLKAVEDNARRLAEKTKT

SEQ ID NO: 8879 - protein, 178 aa, Artificial Sequence; identical to SEQ ID NO: 8878
  Synthetic

SEQ ID NO: 8880 - protein, 178 aa, Artificial Sequence
  Synthetic
SEAEKLLEEVKDLVRRLKKDLERVLRDNHRLSEELRRRLREILEENKKLIDTLREIREKLSDRDKLEKIVEEIVRRSEETVRRIKRVVEEVEKRSKESVEDLRRRVKTVLDRLKELVDRADGKEVAEKMRKIVEELRKEVEEVLKALKENLDRLRREVEKVVERIEDTLRELKKRATD

SEQ ID NO: 8881 - protein, 178 aa, Artificial Sequence; identical to SEQ ID NO: 8880
  Synthetic

SEQ ID NO: 8882 - protein, 182 aa, Artificial Sequence
  Synthetic
SEAEKVLEEVKRLVEDIERKLREMLRRDNEISRKVRDDLRKILEENNELSRRVEEEIRRIKDKDTLKKVVDEVRRELERTLERVRKLVEEVKRTSRKTLEDIKRIVETIKREMDRLLKEIEDRGLREEVVEALEKVVRDVARRLEDVIRRVAENAKRLEDDLRKVEEELKENADRLEERAKK

SEQ ID NO: 8883 - protein, 182 aa, Artificial Sequence; identical to SEQ ID NO: 8882
  Synthetic

SEQ ID NO: 8884 - protein, 175 aa, Artificial Sequence
  Synthetic
SEVEKLLEKLRELVERVEREARRILEENKELIKESLKRIRDLLEDNKRLIREVKEILRRGDKDERLLKDVRRRVKESKEELKKLLETNHRLARETVKKLEDVVRKLEELIRDIERKIDDKDVVKRIRDIAEKVRRDLKRVIDAVRDTSRESDRRLRDVIREVDESSRELVREIER

SEQ ID NO: 8885 - protein, 175 aa, Artificial Sequence; identical to SEQ ID NO: 8884
  Synthetic

SEQ ID NO: 8886 - protein, 175 aa, Artificial Sequence
  Synthetic
SDMERLLRELEELVKELRERLRRLLEENKDLIRRSLDRARKLVRRIEELVRKVKEDLDRGDNDERLLRKLEEDARRVLDELRRLLEENHELMKETIRKLEELLKEVTERAKDIRRKVEDEDVLRKIEETARRLVKEIEDVIREVERTSRESDKKLEDVIDKLRKIVRKVLEELRT

SEQ ID NO: 8887 - protein, 175 aa, Artificial Sequence; identical to SEQ ID NO: 8886
  Synthetic

SEQ ID NO: 8888 - protein, 175 aa, Artificial Sequence
  Synthetic
SEVEDLVRELERLVREAKKALDDLRRKLEELVRDSLRKAEELLKENHDLSREVKKLLEDGANDERLLREATERVKRSLERLKRLLEENHKLVRTVIKEIRELLDRVRKKARDIEEKIKDKKVADELRRIAKRLVEELERVIRELEKIAKESDERLKEVIDRLRENVERLVRELRR

SEQ ID NO: 8889 - protein, 175 aa, Artificial Sequence; identical to SEQ ID NO: 8888
  Synthetic

SEQ ID NO: 8890 - protein, 188 aa, Artificial Sequence
  Synthetic
KELEDLDRDVRRVVEELREELRRLEEEDKRSVEENEERLERLERRLRKKVKELEEKRKRIREKEKKEELKEEIKKVLREAEKIIEDSKRHIDENLKKSEEEIKRLKRKVEELEKKVEDIARELAEKRDREEVRRVLEELREKIKRVLEEIEEVLRRSREINKRLRDRTRTVAKRLKEIVDDVLRKVET

SEQ ID NO: 8891 - protein, 188 aa, Artificial Sequence; identical to SEQ ID NO: 8890
  Synthetic

SEQ ID NO: 8892 - protein, 188 aa, Artificial Sequence
  Synthetic
RELEELLKEVEKAVRENTKLLKDLLDKDKKSVKENEETLRDLERKLREVVERLKRELKDIRDDRMKKKLADKIETVRRDIKRIIDESEDHIRKNLEESKKIADDSRKHLDRVLEKAEDLIRKLKDKRDEKRVRDVLKRLREIIDTVKKVTKEVMERSEEINRRLLKRTKDVLRELEKIVKTVLDEVRK

SEQ ID NO: 8893 - protein, 188 aa, Artificial Sequence; identical to SEQ ID NO: 8892
  Synthetic

SEQ ID NO: 8894 - protein, 177 aa, Artificial Sequence
  Synthetic
SEVDKVREDVKRLIEDAERVSDDVDRRVKRLAEALKETSDKVKEDVERLVRDIKREIDKEEVKRRVDDALREIKEILERSKRHIDEVLKRVKDRLRESKRHLEEVLRRVKEILDRTTDEETLRRVLRKVEDVIRRNKEDNEKVLKDAKRVVEEDKRENEKALERIERIVRKLKEDTR

SEQ ID NO: 8895 - protein, 177 aa, Artificial Sequence; identical to SEQ ID NO: 8894
  Synthetic

SEQ ID NO: 8896 - protein, 177 aa, Artificial Sequence
  Synthetic
SEAEEVVRRVEKLAEDIKRVIDKSLEDVERLVRDAKRRSREVLREVEKLVEDITRRIRDEEVKRRVEKVLREIRRIIRESEKHLDKVLDDIEKILRKSKKHIDDVLREVKEIIDRVRDEEILRRALEKVERVITENKKENEDALRDAKRKIDKDKEDNKKVLDDVRRIIEELKEETR

SEQ ID NO: 8897 - protein, 177 aa, Artificial Sequence; identical to SEQ ID NO: 8896
  Synthetic

SEQ ID NO: 8898 - protein, 183 aa, Artificial Sequence
  Synthetic
DEVDRVAEEVKKLIDDVKRVSDEMLKRSEDLIREVKKTSDDVLETVERLIRDVERKVEERVDKEKARRLRKKLRELLEEVRKAIERSRKNLEDLLRKSKRSVERSREDLERIRREVEEVRKMKDDEVLKRLLDKIREDAKRNKDDNKRNLDESKKEVDRNKDENRRVLEKVKETVKRLKDEVK

SEQ ID NO: 8899 - protein, 183 aa, Artificial Sequence; identical to SEQ ID NO: 8898
  Synthetic

SEQ ID NO: 8900 - protein, 183 aa, Artificial Sequence
  Synthetic
KEVEEMLKEVKKLIEKVKRRSDDVLRRSEELARDLKKMSDDVLREVKKLIDDVKRTVDERVDKEKARRLREDLKRVLDEVREVVRESREDIERILRESKRSVEESRKNLEKLKTDVERASSVKDREFLKEVLDRVRERVEENERRNDENLKKSKKRIDENKEKNERVLRKIREIARRLKEELR

SEQ ID NO: 8901 - protein, 183 aa, Artificial Sequence; identical to SEQ ID NO: 8900
  Synthetic

SEQ ID NO: 8902 - protein, 183 aa, Artificial Sequence
  Synthetic
SEVDRVLKTVEELIRRVKRISDRVLTEVKKLVDDVRRVVEKSRRDVEELVKEVKRSVDERVDSTDAERLRRKLEKLVREVEEVAKRSEDDLERILRRVEEVIKRSRDNLEKLLRKVEEVSKIKDKEMLERALKEIKEEVKRNEDDNRRMLREIEELAKRNKEENKRVLDEVRDIVRRLAEEVK

SEQ ID NO: 8903 - protein, 183 aa, Artificial Sequence; identical to SEQ ID NO: 8902
  Synthetic

SEQ ID NO: 8904 - protein, 183 aa, Artificial Sequence
  Synthetic
EEVERVREEVDKLLKTLKEVSDRVLKASKDLLDRVKEIVEKSLRDVKRLIDDVKRKVDERVDKEEARRLREELEKVLREVEKVVEESKKDLERILEKSKRSVERSRKNIEELREEIERASRVERKEVLERLLKKAEEIIRKNKKENDDNLEESRKEIEKNEEDNRELVKRIEDEVRRLKKEVE

SEQ ID NO: 8905 - protein, 183 aa, Artificial Sequence; identical to SEQ ID NO: 8904
  Synthetic

SEQ ID NO: 8906 - protein, 183 aa, Artificial Sequence
  Synthetic
SEVEEVLRRVRELIERVKRIVDESEKEVRRLIEEVKKIVEESLKRVEELLRDVKRRVDERVDSTDAERLRRKLEKLLREVEEVVERSKRDLERLVRKVEEVVKRSRKNLEDVRREVERMSRVEDRKMLREVLEKIKKIVKDNEDDNRRALTEVRERVRENVEENKKVVDRVRKIAEDLRKEVE

SEQ ID NO: 8907 - protein, 183 aa, Artificial Sequence; identical to SEQ ID NO: 8906
  Synthetic

SEQ ID NO: 8908 - protein, 183 aa, Artificial Sequence
  Synthetic
SEVERVLEEVKKLIEDVKRVVKESEEEVEKLIRDVEREVERSKRTVDELVKDVKRAVDRDVDKEKAERLRRKLEELKREVEKVAERSKENLKRLLTRVREVVRESREDLERLLKKVEEMSRVKDREVLTKVLREVEEAVRRNKERNKRALEEVKKTVDRNREDNKRMVDKVRETAKRLKDEVR

SEQ ID NO: 8909 - protein, 183 aa, Artificial Sequence; identical to SEQ ID NO: 8908
  Synthetic

SEQ ID NO: 8910 - protein, 176 aa, Artificial Sequence
  Synthetic
SSIEKVREDVKELIRDVERAVKRVKEESKKLVDDLRRAVKRVEEESRKLLKDLERNKRREEVDKILKDNEKSLKELKDEVERILKENEDLLEKLEREVKRILDELKKRLDDADKIEGDDDVRRVLREIERIVKEVKDDLKRVLEESERSIRRVKEELRRVLEDNRRLLKEVKDRAR

SEQ ID NO: 8911 - protein, 176 aa, Artificial Sequence; identical to SEQ ID NO: 8910
  Synthetic

SEQ ID NO: 8912 - protein, 178 aa, Artificial Sequence
  Synthetic
SEVEAVLREVEERVDRVRKESEKTLREVERLVREAKRRSKKSLDDVKKKVEEVKKKIRDIKDEETLRRLIKRIEEELKEIVERNKKTVEEILRRLEEIIARDRRRIDKIVKDLRRIVEEVKDAEEVKREIEKLVEDVRRVSDRVVEEIKELVKDVERMSRKVVEDIKRLAEDVRREAE

SEQ ID NO: 8913 - protein, 178 aa, Artificial Sequence; identical to SEQ ID NO: 8912
  Synthetic

SEQ ID NO: 8914 - protein, 178 aa, Artificial Sequence
  Synthetic
DEVERVLEEVKERVDRVKRESEKSLKEVEKLVRTNERLSERTLKEVRDLVEDAKKKIDDIKDKETLKRLVDEIVKRLEDILRENREIVERVLKKLEEIVEKNERDITEIVERLRRIVEEVKDAEEVRREIEKLVEDVKRVSDKVVEDIRRLAEKLRRDNKRAEDEIRKLVRDVERRAK

SEQ ID NO: 8915 - protein, 178 aa, Artificial Sequence; identical to SEQ ID NO: 8914
  Synthetic

SEQ ID NO: 8916 - protein, 178 aa, Artificial Sequence
  Synthetic
DDLERVLEEVRKLVKELKERSRKSLEDVRRSNERNETESRRTLREVRELVKKVKEVIDRTKDKETLKKRVEEIVRELDKIAKRNKELVERVLEVNKKLVRDNTEEVRRILKELEDIVRSVKDAEKVKEDIRRLVEEVERVSREVVERIKKLADESRKKNKKVIDEIKELVKRVRDRAK

SEQ ID NO: 8917 - protein, 178 aa, Artificial Sequence; identical to SEQ ID NO: 8916
  Synthetic

SEQ ID NO: 8918 - protein, 178 aa, Artificial Sequence
  Synthetic
REMEEVLKEVEKRVRDIEDESRKTLERVDKLVKKNKRDSERTLKEVEDLVREVKKEIRRIKDKKTLKERIDKILEDLKRIADRNRRLMKKVLDELRKIIEEDRERIKEILKRLEDIVREVKDAEEVKREIKKLADRVREVSERVVREIEKLVRDIKRRNEEVIDEIRKLVEDVKREAK

SEQ ID NO: 8919 - protein, 178 aa, Artificial Sequence; identical to SEQ ID NO: 8918
  Synthetic

SEQ ID NO: 8920 - protein, 178 aa, Artificial Sequence
  Synthetic
KEVEDVLEEVKELVKELKRVSEETLRRVEKSNRENEEKSKTTLKEVEDRVERVKEEIKKTKDKETLKRLADDIVERLKAIVEKNKRILEEVERTNRELVEEDKRMVEEILRRLKKIVEEVKDAEEVKREIKKLVEEVRRVSEEVVREIKKLVDKSRRVNEKVIEDIKELAKEVEEAAR

SEQ ID NO: 8921 - protein, 178 aa, Artificial Sequence; identical to SEQ ID NO: 8920
  Synthetic

SEQ ID NO: 8922 - protein, 186 aa, Artificial Sequence
  Synthetic
SELEEILERVRKMAEDAERISEETLRRSEELIRRVKDLSRESLERVERLIRKVKKEIEEIKDDDTLRRLLEEVEKEIRKILKEDEEALEDVARKVKKINRDNERLLEELRKIAETLLKDILTKKGEESEEVLRVIKAIEDLLRRVERVSREASKTSEELLKDITRVSEKSKEDIKRLLDDVRRKVK

SEQ ID NO: 8923 - protein, 186 aa, Artificial Sequence; identical to SEQ ID NO: 8922
  Synthetic

SEQ ID NO: 8924 - protein, 186 aa, Artificial Sequence
  Synthetic
SELDEVLKTVEELVRRIKEKLKEILDRSRKLVEEARKLSEDSLREVKRVIDEIKREAERQKDDETLRKILEDVERIIRELLKRDDEVVRRVVEELRKLNDDIRRLVTEIKDRIRKIEEDIKTKKGESSEEVLKLVEDVRRLVEDVDRTVERMSRESKKLAEDIKRVSEKSKRDIERLLADVERTVR

SEQ ID NO: 8925 - protein, 186 aa, Artificial Sequence; identical to SEQ ID NO: 8924
  Synthetic

SEQ ID NO: 8926 - protein, 186 aa, Artificial Sequence
  Synthetic
DELDEVLKEVEELIKRVKRESERTLKENRDMVREIKRRSEESLREVRELIERVKDELRRTKDDDTLRRILERVRRRIKELLDRDKKLLKDARETSRKTIEDNERLLREVRRRIEEILKDIKRKKGESSERVARVVRRVEELLEDVERRSREVLKEMDKTAKEVKKASEKSEEDIKRLLEDVERTVR

SEQ ID NO: 8927 - protein, 186 aa, Artificial Sequence; identical to SEQ ID NO: 8926
  Synthetic

SEQ ID NO: 8928 - protein, 186 aa, Artificial Sequence
  Synthetic
KEAEDILKEVEDIIREAKKLSERTLDENRKVIRKAKEDSRRSLEEVRKIIEDVKEELDRIKDKETLDRILERVRKEIKELLDRDRDLLRKVEEISKKTIDEDREVLKKVTEEIDRLLKDLLRKKGESSERVLRVIREIEKLLEDVKRVSERSVKEMKKTLDDVRRASKRSEEEIERLLRDVERRVT

SEQ ID NO: 8929 - protein, 186 aa, Artificial Sequence; identical to SEQ ID NO: 8928
  Synthetic

SEQ ID NO: 8930 - protein, 186 aa, Artificial Sequence
  Synthetic
RSLEEVLKEVEELIRRAKEESKRTLDDVRKLIEEVKRESERSLRDVREMIERAKDRIRRIKDEETLRRILEEIKRIVEKLLEEDRKLLEDVTEEIKRILEENRKVLKEIKDRIARILERIKEEKGKDSEEVRKVVEDVERLLRDVERMSKEVEKRIRELLDDIRRVSERSRREIERLLEDVERTAR

SEQ ID NO: 8931 - protein, 186 aa, Artificial Sequence; identical to SEQ ID NO: 8930
  Synthetic

SEQ ID NO: 8932 - protein, 186 aa, Artificial Sequence
  Synthetic
DELEEILKRIEDRIREIKERSKKTLDDIRKVAERVEERSRESLKEVREVVEEIKDRIRRIKDDETLKRLAERARERIKELLDRDRKILEEVRKTVEKLLREDKRLLEEIAREVTELLKDILRKKGEESREVLKVIRDIEELLREVAEVSERSRREIEKLLEDVERVSREAIKRIKDLLRDVERTVK

SEQ ID NO: 8933 - protein, 186 aa, Artificial Sequence; identical to SEQ ID NO: 8932
  Synthetic

SEQ ID NO: 8934 - protein, 177 aa, Artificial Sequence
  Synthetic
KEIEELLDEIRRLMERSKENVRRSLKKSKDLIEEAKRRLEKSLEDSRELIRRIEDRIRRIKERDALKRVLDEIKKRVEEDIKRNEEILEEIRKLVEEDIKYNKDNLKRSEDLVRELEERVKSKEVLEEIRRLLEDLRRMNEKSIEDSKRLLEDVARAVKRSIDESRKLLEKIERDVD

SEQ ID NO: 8935 - protein, 177 aa, Artificial Sequence; identical to SEQ ID NO: 8934
  Synthetic

SEQ ID NO: 8936 - protein, 177 aa, Artificial Sequence
  Synthetic
KEMEDLLREAEELIRRSVENVKRSLEESEKLIRESKKNVERSLRRSEELAKEIKDEIRRIKERDEIKRVLDEAEELVRRDIDYNRRNLEETEKRVREDIKYNKDNLDESRDRVRKLEERVKSERVLREIRRLLRELEEINEKSIRDSKRLLEEIERVNRDSIRRSKELLEDVERTVR

SEQ ID NO: 8937 - protein, 177 aa, Artificial Sequence; identical to SEQ ID NO: 8936
  Synthetic

SEQ ID NO: 8938 - protein, 177 aa, Artificial Sequence
  Synthetic
SEVEDLLRRAEELIRRAKERLERSLRRVEKLIDDVRRKLERNNETVKRLVEEIKEKIKRIKERDMLKKVLEEAKKLAKESEEHLRKLLDDIRKKIEKDIEDNKKILEEIRRLVEDIRRKLDKEEMLKEIERLLEDIERVVRETIDTTRRLLEKIEREVREVIKSNRELVADLERTVT

SEQ ID NO: 8939 - protein, 177 aa, Artificial Sequence; identical to SEQ ID NO: 8938
  Synthetic

SEQ ID NO: 8940 - protein, 177 aa, Artificial Sequence
  Synthetic
DEVERLLEEVKRLIDRAREELKKSLDRVRRLVRENEEAVRKNNEDVADLIRKIKEKIEKIKEDEMIKKVLEEIKRRVEESLKHNKDLLREIRERAKKDIDDNKALLDEITELIKRVEDRVKMKKVLDDIRRLLKDIKDIVDKTIRDTKELLRDIEEKNRRATKSNKDLLEEIRETVR

SEQ ID NO: 8941 - protein, 177 aa, Artificial Sequence; identical to SEQ ID NO: 8940
  Synthetic

SEQ ID NO: 8942 - protein, 181 aa, Artificial Sequence
  Synthetic
DEVEKLLRRVEKEVDRIKRELEDNLRRVEKLVKEIHEENEKLMRKARKLVEDIKRIIDRGDKDSRVLDEVRKLIRTVEEEIKESVERAERLIRESEEHLKRVLEEAKETIRRLEEKVRRDVKSEEVKKAEKEIRRLLDELRRVVEEVTKKTKELLRRLKKSSDELRKTIKELLRELEEKVR

SEQ ID NO: 8943 - protein, 181 aa, Artificial Sequence; identical to SEQ ID NO: 8942
  Synthetic

SEQ ID NO: 8944 - protein, 181 aa, Artificial Sequence
  Synthetic
KEVDEILRELEELVKEIKKRLEELTREVKRLVDKIHKDNEDNLRDMARLVEEIKEIIRRGNKSSDVLKDIEKKAEESKKHLDESMKEARDLIRELEEKVKEILKEAERLIRRVKDLIRKTVKSKEVERVERDVERLLDELRRVVKEVLDRIRRLLEELERSSKRVKEETERLVKEVREAAK

SEQ ID NO: 8945 - protein, 181 aa, Artificial Sequence; identical to SEQ ID NO: 8944
  Synthetic

SEQ ID NO: 8946 - protein, 181 aa, Artificial Sequence
  Synthetic
SEVDKILEDLRELVERIHKKNKRIVEEDRELVKEIHRKNEENLKTMERLVEEIEKIIRRGDKSSKVLEDARRLAEESKKHLDRSMEEATKLVRESEERLDETVREAKKLIDEVREVIKRDVKSEEVKRVRKDVDRLLKELEDSSREVKERSRRTLEELERSSREVKERTERLLRKLEKAVE

SEQ ID NO: 8947 - protein, 181 aa, Artificial Sequence; identical to SEQ ID NO: 8946
  Synthetic

SEQ ID NO: 8948 - protein, 181 aa, Artificial Sequence
  Synthetic
DRLEEILKELRELVETIHRRNEEIVRKVAELVKRIHDHNEENTRRVEELVRRIKDIIRRGNKSSEVLKRAEELIKRSEEDLRRSVRDAERLIRELKEEVKKTVEDAKRLAKRVKEMLDRTVDSEDVERAKRDVDRLLKELEESSERVLRTIEKLLKELRESSKRVRDETKRLLDELREAVR

SEQ ID NO: 8949 - protein, 181 aa, Artificial Sequence; identical to SEQ ID NO: 8948
  Synthetic

SEQ ID NO: 8950 - protein, 181 aa, Artificial Sequence
  Synthetic
SELDEILKRLEKLVEDIKRKLEKLVRDLERLVKRIHDHNEENLKTVKKLVDEIKDIIRRGNKSSKVLEDARRLIEESKRDLDRSVEEVKEEAERVRREVERILREAEKLIRDVKKELDETVKSREVDRVREDVRRLLEDLKRVAERVKRDIERLLKELKESSDEVKKRTEELLEELERAVR

SEQ ID NO: 8951 - protein, 181 aa, Artificial Sequence; identical to SEQ ID NO: 8950
  Synthetic

SEQ ID NO: 8952 - protein, 181 aa, Artificial Sequence
  Synthetic
DEVDDILRRLRELVERIKKHLEDNLRELEELVKRIHDHNKRNVEEVKKLVEEIKKIIADGRKSDKVLRDARRLIKESKDDLDRSERKIERLVTESLKDLDDLLREAEKLIEDVKRELDKRVKSEEVRRVKEEVERLLEEVRRVVRKVKEESKRLLEELRRSSDRVKKETERLLEELERAVK

SEQ ID NO: 8953 - protein, 181 aa, Artificial Sequence; identical to SEQ ID NO: 8952
  Synthetic

SEQ ID NO: 8954 - protein, 174 aa, Artificial Sequence
  Synthetic
SEAEALVEEVKRIVEESKRRLEKVVEESRKLVEEVKKRLRDMLKTIEDLVKEVKELLDNGADEETVDRMIKRLKRLLEELRREVEEAIKTNEELLRRLKRESERTIKELEDLLRELKDNEEVKRKVERLLEEDRRVLEEVKESAKRTSKEVRDELREVSKRVEKLLKDVRDAAR

SEQ ID NO: 8955 - protein, 174 aa, Artificial Sequence; identical to SEQ ID NO: 8954
  Synthetic

SEQ ID NO: 8956 - protein, 174 aa, Artificial Sequence
  Synthetic
DEAEDLVRRVRDIVRKSREELKRVVEESDRLVEEVKRRLKKVVEDSKRLVDEVRKLREGGADERVVKRVIDENRRLLKELKETVKRVIETDRKLLEDLRDTSRRTIEELKELLDRLKDNEEVKREVERLLEDDERVLREVAKRSRETLETVRKVLEEVERRSRKTLEEVEKTAR

SEQ ID NO: 8957 - protein, 174 aa, Artificial Sequence; identical to SEQ ID NO: 8956
  Synthetic

SEQ ID NO: 8958 - protein, 174 aa, Artificial Sequence
  Synthetic
SEMDELVDRARRIVEESRRLLEEVVKRSKDLVKDVKKKLEDALRRVEEIVRRLDEELKGGADEERVKKIIRDLKELLKKLREEVAKVIRDNERLLRELDERSRKTLKELEDLLRSLKDNEEVKDEVRKLIEEDKKVLDDVRRKSERTLREVEDVLRRVEEEVEKLLRKVEESAK

SEQ ID NO: 8959 - protein, 174 aa, Artificial Sequence; identical to SEQ ID NO: 8958
  Synthetic

SEQ ID NO: 8960 - protein, 174 aa, Artificial Sequence
  Synthetic
DEAEKLVEDVRRIVEKIRKELEDVVEESRELVERIRRELERVVEESERLVEELRKELEKGGDEEIVKEIERLNKRLLDELKKRVEEAIREDKKLLEDLEERVRRVIERLKELLDRLKDNEEVKEEVKKLLEEVRDVLRKVKKASEETLRDVRRVLEEVKRRSEETLKRVREEAT

SEQ ID NO: 8961 - protein, 174 aa, Artificial Sequence; identical to SEQ ID NO: 8960
  Synthetic

SEQ ID NO: 8962 - protein, 182 aa, Artificial Sequence
  Synthetic
SEVEDIVRDVKRLVEENHRRNEEIVRRDEDLVRRNNELNKRILEEVEELVRRLEDVARKIRDKEELKRRVDEIERRLEDLLRKVEEANRKSLEDSKRLVRTVTELNRESVETLKKLVDDLRKDRSDVEEALRTAEELIKRLEDSLREVKDRSKRSLDEMKKSADDVRREIERLIKRVRDTTK

SEQ ID NO: 8963 - protein, 182 aa, Artificial Sequence; identical to SEQ ID NO: 8962
  Synthetic

SEQ ID NO: 8964 - protein, 177 aa, Artificial Sequence
  Synthetic
SEVEKIVREVEEVVERIRKKSEDSLREVRRLVEEIKRRSEKTVEDDEKLVKDAKDELRRIKDKETLARLVEEILDRSRKSLEKNKRLLDEIRRRLETILKRNEDLLRRAEEELKRLREELDKEDAKRRIEELMKEVRDVSRRALKEIKDLLREVEEVSKKALKRSKDTVDEVREEVR

SEQ ID NO: 8965 - protein, 177 aa, Artificial Sequence; identical to SEQ ID NO: 8964
  Synthetic

SEQ ID NO: 8966 - protein, 177 aa, Artificial Sequence
  Synthetic
DEVEEIVKEVARVVDEIRRLSKESLDRVRKLVEDIERELRKIVKTDRDLVEEAKRVLKDIKDKDTLREVLERIKRLSEESLREADRLVTEIVEDLKRILDENRRLLEEILKRAKDLLDRVEKREVEKEIRRLVEEVKEVSRKVRKEIEELMRRVEEVVKTVKEESKKTVREVEETAR

SEQ ID NO: 8967 - protein, 177 aa, Artificial Sequence; identical to SEQ ID NO: 8966
  Synthetic

SEQ ID NO: 8968 - protein, 177 aa, Artificial Sequence
  Synthetic
DEADEIVKRVEEVVRRAKETLERILKRVEEMLDRIRKESEKTVREDEKLVEEVKDRLRKIKDKDTLRKLLDEVKKRSEESLERNKRLLEEIKRIAEKLLREVRELLERIRRTLDKLLKEVDSERLLREIKRLLKEVEDEVRRVEKAIKELVDRVKEVSDRALERSKRTVREVEERVR

SEQ ID NO: 8969 - protein, 177 aa, Artificial Sequence; identical to SEQ ID NO: 8968
  Synthetic

SEQ ID NO: 8970 - protein, 181 aa, Artificial Sequence
  Synthetic
SEVEEVKEDSKRTLKELKDVAKKVDDDSKRLLEELERVARKSIEDSKRLLDELRERGVPEDILRRAEKLVEEDIRRNEEIVRRIADRIREMNEDNRRLLDEVAKEVEKSIREVDEAAKRGVDEKELRRLVEDDRRLVEEVKRDSERLLDEIRKLVEEIKERLRRSVEELRRRVEEIKKTTT

SEQ ID NO: 8971 - protein, 181 aa, Artificial Sequence; identical to SEQ ID NO: 8970
  Synthetic

SEQ ID NO: 8972 - protein, 181 aa, Artificial Sequence
  Synthetic
SSVEKVKRDSERTLREVEKVIEKVDRDSERLLRDVERVITEADERSKDLLRRLEESGVPKDIVDRARRLIEELNRRNKALAEEIRELVERVNERNKRLLETIEKLVRDSIRRVDELAKRNVDDTDLRRLVEEDRKLVTRVKEESKRLLEELRRLVETVRKRSEDLLREIKKRVDEILRRTK

SEQ ID NO: 8973 - protein, 181 aa, Artificial Sequence; identical to SEQ ID NO: 8972
  Synthetic

SEQ ID NO: 8974 - protein, 174 aa, Artificial Sequence
  Synthetic
DEIKEVIDRITKVLEDNERVVRKLSEENKKVLDDIRRRAEEIIRRNEEVLRRIKELAKRNTDRRKALEELRKISEESKKDLDRLLKEVEEISRRSEKENRRLNKESEDVARELKKRIDNEELKKALDDILRRLEESNRKNIEDSRRILEDVERIVRRVVEVSKDIVRKAEEDVR

SEQ ID NO: 8975 - protein, 174 aa, Artificial Sequence; identical to SEQ ID NO: 8974
  Synthetic

SEQ ID NO: 8976 - protein, 174 aa, Artificial Sequence
  Synthetic
SEVEEVIDELRKVLEENKRRVEELSRENDDVLRRIEERLKKIEDELEKILKDVRDLKDNNVDSKTLLERVAERVKEAATRLRELLRELEEISEKSIRENDRLNKESEDMARDLRRRVDNERLKEEITRILEELTRINEENKRRSEEILDRVRKDVERVLKRVEDILKEIEDELR

SEQ ID NO: 8977 - protein, 174 aa, Artificial Sequence; identical to SEQ ID NO: 8976
  Synthetic

SEQ ID NO: 8978 - protein, 185 aa, Artificial Sequence
  Synthetic
SSVEELEERLRRVLERSERHLRKLEKKVEEVLDESRKNLTRLLRDVERVLRDVEETVRREKSKSVADEIRKEVKRLLDKVKKILKENRDKTKRMLEEVKEVLDRNEEETKRLEERVDKALRDEIKDERKARELKRTVKRLAEESRKILREVEEKVRKVAEDSERILEEVERTVKRVVEEIDRTVR

SEQ ID NO: 8979 - protein, 185 aa, Artificial Sequence; identical to SEQ ID NO: 8978
  Synthetic

SEQ ID NO: 8980 - protein, 185 aa, Artificial Sequence
  Synthetic
SKVEKLLRELEEVLKDSERHVREDSDRLRRVLEDSERHVRKVLRDVEKVLREVEDMVRKRKDRDVIDKIRDKVERLREKVERALERNKRKLDKALEDSNRSDKKNEDKLRELKRRVDEVLRDDIKDEEKARRLEERVEEIVRESERTSRENNKKSRDIIKTSEDILREAADRVREVVERIRRTLT

SEQ ID NO: 8981 - protein, 185 aa, Artificial Sequence; identical to SEQ ID NO: 8980
  Synthetic

SEQ ID NO: 8982 - protein, 184 aa, Artificial Sequence
  Synthetic
KEVEEVIERSKKSNEENERRLRKILEEARRINEENEKLLRKILEEAKRVVEEVRRILKDNKEKKERIKELLERLEELLRKVKEDVERSVRELAKLLKKVAEEVRKSLEDNKRTADRVVERIGEEKKEELDKLREESKKILRHSERLLKEVEEEVKRILEHSEELLRRVEDKVRRLLKEIEDALR

SEQ ID NO: 8983 - protein, 184 aa, Artificial Sequence; identical to SEQ ID NO: 8982
  Synthetic

SEQ ID NO: 8984 - protein, 184 aa, Artificial Sequence
  Synthetic
DEVEEVEKKVDKIDKENEDLLRKVIRDAERINEENTRLLEDILRKAKKMVDDVREILKDRKDAKEDIDRLLKELKKLLEEVAEEVKKSLEKLKELLEKVKREVDESLKRLEDELRDVVRKIGKDLEEEVRRVAERVKEVVKHSRELLKRVEDMVRRIVEHSKRLLDEVRERVKDLLRKIAEARK

SEQ ID NO: 8985 - protein, 184 aa, Artificial Sequence; identical to SEQ ID NO: 8984
  Synthetic

SEQ ID NO: 8986 - protein, 181 aa, Artificial Sequence
  Synthetic
DEVREVVRRLEEIVRDVNKKNRESVREAERLVDRLREILEETSRRLKELVDRVKELIKGGTDSRDVRRVDRELEKIITDSDDTVRKIREELKRKVEDDLRRTAEIIKKLKDTVARVSERISNEKEARELEDAVRKLIERLKRSAEEVKKRVEELDEEIRRVVEEDRRTIKELKEEIDRADK

SEQ ID NO: 8987 - protein, 181 aa, Artificial Sequence; identical to SEQ ID NO: 8986
  Synthetic

SEQ ID NO: 8988 - protein, 181 aa, Artificial Sequence
  Synthetic
DEVEEAVKRIEDLVERLRELLEKTSREIEKILKESEDKLRESSDRIRRLLDELKKLIENGADDELVRKMLKDIKDILEESERTSKETLDRIREILKKSEDLVREVLERIERLLEDVARRITDEEKLRKAEDTVRRVIKDVRKMLEDDRRTVEEVIRRDREALEKDRKTVDDVIEDVKRVAK

SEQ ID NO: 8989 - protein, 181 aa, Artificial Sequence; identical to SEQ ID NO: 8988
  Synthetic

SEQ ID NO: 8990 - protein, 181 aa, Artificial Sequence
  Synthetic
SEVDEAVEEIKRILEESKKRLDETSEEIKRILEDSERRLRESSKRIRELVKELKKRIDGGTDDREVEKVEKEIEDILRESEEISKDTEDKIREILKRSREISETTIREIRRLLEDIERRITDKDKLTRIREVVDKVVKEDEDALREDERTVREVIKRDRDLLEEDRRTVEDVIRKVRETAR

SEQ ID NO: 8991 - protein, 181 aa, Artificial Sequence; identical to SEQ ID NO: 8990
  Synthetic

SEQ ID NO: 8992 - protein, 181 aa, Artificial Sequence
  Synthetic
SDAEKVVKRIKEIVEDSTRKVRDTSRDIRRILDESRKMLEDVVREIKDLVRRLEELIRGGVSEETVEKVLREIEELLKELKKTSERTLKEIEDILRRSEEESRRTIREIEELLRRLEERITDKDTLDKVREDAERVLEEDKKVADDDRKTVEDVIREDKRLLKRVEEEVKRVIKEVDDAAK

SEQ ID NO: 8993 - protein, 181 aa, Artificial Sequence; identical to SEQ ID NO: 8992
  Synthetic

SEQ ID NO: 8994 - protein, 181 aa, Artificial Sequence
  Synthetic
SEVDRAVETIRRILEESEKIIRKVVREIEEILDRSRRLLEKSSEEIEDLVRRLKELIEGGTDETSVEEVLRRIEEILKESERTSTETLKTIEDLLRELERISRKTLEEIRRLLEDVKRRITDERLLREAEKDVRRVVEEDEKVLRDVARRVEEVIKADKKLLREDEKTVREVIERVKETAR

SEQ ID NO: 8995 - protein, 181 aa, Artificial Sequence; identical to SEQ ID NO: 8994
  Synthetic

SEQ ID NO: 8996 - protein, 181 aa, Artificial Sequence
  Synthetic
DEFREAVRRIKEIIDDSRRKLEKNVKENEELLKRSDDELRKSSEDIKKLLEELRRLIEGGADERIVKRILEEIEDILRKSEKRSRETLEESKESLRRSEKTSRETEKRIKELLEELAKRIKDEKSLREVEERVERLLEDDRRLLEENARRVEDLIRKDKEALDRDRKTVEDVKREVEKDAR

SEQ ID NO: 8997 - protein, 181 aa, Artificial Sequence; identical to SEQ ID NO: 8996
  Synthetic

SEQ ID NO: 8998 - protein, 181 aa, Artificial Sequence
  Synthetic
SEVDEVVKRIAEIVKTSKDELREAVKRIEDIVRRSEKMVRDNLRENERLVRELDKLAKGGADERVVEEIKRRSEDSLRKSEELSKKTLDEIRKLLDDVRKRSKETLDRIRELLERIKKKIKDKEKLDRVTETVRRLIEEDKRALEDVERKVEDVIRRDREVLERNRREVERLIKEIEDKRR

SEQ ID NO: 8999 - protein, 181 aa, Artificial Sequence; identical to SEQ ID NO: 8998
  Synthetic

SEQ ID NO: 9000 - protein, 181 aa, Artificial Sequence
  Synthetic
KDAERAVEEIRKILEDSKEKMERNVRENEKLVRDSRRKLEENVERNEKLVRDLKRLKEGGADDEIVRRIKEESKKSLKESEKTSKKTLEESERSLRESEKVSKKTIDEIRRLLKEIRERITDKDTLKRVTDEVRRVVEEDKRVLEENRRRVEKLIEEDKRALDENRERVRKLIEDIDKDAT

SEQ ID NO: 9001 - protein, 181 aa, Artificial Sequence; identical to SEQ ID NO: 9000
  Synthetic

SEQ ID NO: 9002 - protein, 181 aa, Artificial Sequence
  Synthetic
DEVEDAVEKLKRLVDELERLLREAVRRIEKILEDSTRKVRKNLEENKELVKRLRELIKNGVPEDSVRKVLRESKESLRRSEETSKETLERIKRLLDEVRELVERVKRELDRLLRELEKRIKDKDLLRKVAEVVRRLEEEIRRLLEEAKRVVDEVIKKDRTVMERNREEVERLIREIEETAR

SEQ ID NO: 9003 - protein, 181 aa, Artificial Sequence; identical to SEQ ID NO: 9002
  Synthetic

SEQ ID NO: 9004 - protein, 181 aa, Artificial Sequence
  Synthetic
SEVDEVVERIRRIIKKSKEELDKAVRDIEEILRRLEKELRDNVRENEKLVEDVRRAIEGGMDRKDVKRVLKESEDSLRESEKRVEEVLRDIKRRLKEVRETSRRTIEEIERLLREIARRITDKDKLERVSREAKRVLKEDEEALRDVEKKVTDVIEAVKKMLEDNRDRVRRLIEEIKRRAT

SEQ ID NO: 9005 - protein, 181 aa, Artificial Sequence; identical to SEQ ID NO: 9004
  Synthetic

SEQ ID NO: 9006 - protein, 184 aa, Artificial Sequence
  Synthetic
DEIREAVKRIRRLLEESHRENKEIVDRLRKLVEESHRKNEKLKRELEELVKKLKEIIDKDKDKDTLTKIVEDIKRRLDEILKRADEENERINRKLREILEEVRRRNEEVNKEIKDLLDDIRRRVDSEDLKRAEEEIRKVSEDNKRSVDRVREVVKRLSDENRRSLEEVREVVKRLIREVEEARR

SEQ ID NO: 9007 - protein, 184 aa, Artificial Sequence; identical to SEQ ID NO: 9006
  Synthetic

SEQ ID NO: 9008 - protein, 184 aa, Artificial Sequence
  Synthetic
DEIRKVVKEITDLLKKSNDKNRKVVEEIRDLLRKSKKLADELVERLRKLVEDLRRRIDKLSDKRTAEDIVRRIIEELKRILKEIEDLARRINREIERLVEEVERDNRDVNRKIEELLKDIARRVDSEDLKRVEERAREVSRRNEESMRRVKEDADRVSEKNKEVLDRVREEVKRLIEEVRETLR

SEQ ID NO: 9009 - protein, 184 aa, Artificial Sequence; identical to SEQ ID NO: 9008
  Synthetic

SEQ ID NO: 9010 - protein, 184 aa, Artificial Sequence
  Synthetic
DRIRDVAREIRELLKRSNDENRKVVEEVRRLLKESNDTNKRVVDEVRELLERLKEIARRLKDKDTLKKEVDKIIRELERVMEDVKRKNDEINERLKKLLEDVKRKNDDVNRKIDELLKTIEREVDSEDLKRIRREVEKVSEDNKRSAKEVEDEARKVSEDNERSVRDVKEKADRVIKEVEDEDR

SEQ ID NO: 9011 - protein, 184 aa, Artificial Sequence; identical to SEQ ID NO: 9010
  Synthetic

SEQ ID NO: 9012 - protein, 178 aa, Artificial Sequence
  Synthetic
DEERKIKRVLDEVDKHSKRVIAEAKRVVDEVLREVEKVVRRNKEVLDEILREVKRILDEGKITEEVLKEAEKRLRDNKRRLEELLRDAERRLRDIKRELERLLEESRKVVEDVERKVRKDGAREELIKTIRKVNKEIEDRVRDLIKTVRDILRRIEEEVRKSIEDSKRLLRELEARAE

SEQ ID NO: 9013 - protein, 178 aa, Artificial Sequence; identical to SEQ ID NO: 9012
  Synthetic

SEQ ID NO: 9014 - protein, 176 aa, Artificial Sequence
  Synthetic
SVVEDLKRTVEEVVKKSEEILKEDRKTVEKVVEEVKKSDKEDRDDVDRVVKEVRKRIRDKRLEDELKKALDTNRKLVRESTEKLKKLLEDNERANKRNKEELDRLLDEVREVLRMDKKDLADKVKKDAEEVLKRSKEHVDRSIDRTREILKRLRETNEESIKRTRDILRKIAEEAR

SEQ ID NO: 9015 - protein, 176 aa, Artificial Sequence; identical to SEQ ID NO: 9014
  Synthetic

SEQ ID NO: 9016 - protein, 176 aa, Artificial Sequence
  Synthetic
SVSEELKKKVEKVARDVERSLERDATEVTKVVEEVKKSDRKDEETVKRVVKRVDELIRDERLKEELERALRDNERLVRESTKNLEDVKRKNEKILREIRKKLRELLEEVAKALRSDKREVAEKVIRDAEKVLDDIRRMNEESIRDTRRVLEENKRKNEESIRKTEEILRRIEEESR

SEQ ID NO: 9017 - protein, 176 aa, Artificial Sequence; identical to SEQ ID NO: 9016
  Synthetic

SEQ ID NO: 9018 - protein, 184 aa, Artificial Sequence
  Synthetic
SEVDEVLKELERINRENHREVEELLRRLERILRESKKHIKEVIEDLRRRLKELEDEVRRRKDEDVRRRLRELVERIEREVERVIRRNDKLVKEAEERVKEAVKRLERSAEELRKKVTRVVERLSDEKKVRELEEEARRVKRSTEEVIKRLRDSVEKLVKDSERVLRELKKEVERVVEEIDKMIK

SEQ ID NO: 9019 - protein, 184 aa, Artificial Sequence; identical to SEQ ID NO: 9018
  Synthetic

SEQ ID NO: 9020 - protein, 183 aa, Artificial Sequence
  Synthetic
DEVEKALEESKKSNEENHRKVKKVLESAKDINRRNHDLVRDVIRKLEEILRRIEKVVREGRDKREIKRIEEEIKKTVKKVVEDLRKSLDDLRKEVTKVLEDLKESLKRNEDRMRDVVEKIGRDFDKEVTELRESSRRSIESTREAVRTLEEAVREVIKSTDEAVKRLEATVKRIEEEIRKSMK

SEQ ID NO: 9021 - protein, 183 aa, Artificial Sequence; identical to SEQ ID NO: 9020
  Synthetic

SEQ ID NO: 9022 - protein, 183 aa, Artificial Sequence
  Synthetic
DDVERVLKKSRDSNRENHEKVKRVIEKSDRSNEDNHRLVEDAIRKAEEILEEVERLVTAGEDKRKAEEIVKELRDLVREVKRRLDESLKRNEEEIRKVVEELERSLDKNRKEIREVLERIGRDFKEEVDELRKSSEDSIRSTEDVVRKLEETSKRSIRSTEDVARKLEEAVRRIERRIRERTR

SEQ ID NO: 9023 - protein, 183 aa, Artificial Sequence; identical to SEQ ID NO: 9022
  Synthetic

SEQ ID NO: 9024 - protein, 183 aa, Artificial Sequence
  Synthetic
SEVEEVLKRSKESVERVDRDVRRVLRELEDLNRKNHKRVEEVIRDAERILREVEDMVRRGVEKEKLEKIVRDLRRTVEKVLKELRDSLREIKRKVDEVLERLERIIRENEELIRRALERIGRDLDKEVDELRKSSEKSVEDIKRVVDRLRDSARKIIKSTEDVVKELERRVREVIKRIKEEAT

SEQ ID NO: 9025 - protein, 183 aa, Artificial Sequence; identical to SEQ ID NO: 9024
  Synthetic

SEQ ID NO: 9026 - protein, 187 aa, Artificial Sequence
  Synthetic
SEIEEIIKRIEKLLRDDEKKIRDSIKRSEDLLREANRENKESIDRVRELLEKVKRLRERIDSEEVRERVERVLREIERLLEEDRKRNEDISRKNEKLLRETEDESRKSIETIKRLLEKVRTDSGDKKAEEEVRRLEKRVRDVLRELEKTLKRVTEVHKETTKENEKSARRVKREVEKVIEEVERTRT

SEQ ID NO: 9027 - protein, 187 aa, Artificial Sequence; identical to SEQ ID NO: 9026
  Synthetic

SEQ ID NO: 9028 - protein, 187 aa, Artificial Sequence
  Synthetic
SEIEEIIRRIEELEERLKRELDRSIRTSEKLLEDAREINKESIRRVEKLLEEIRRVVDKIDSEEVTRLVEKVLRDIERLVTEDEERNKRMTKRNEDLLKRIEEEVKRIIREIEETLRKVKEDSGDKKAEERVRALEKAVKDVLESLKRLLDEVRKRHKESSEDNERSLKRSKEEAEKVIKAVEDERR

SEQ ID NO: 9029 - protein, 187 aa, Artificial Sequence; identical to SEQ ID NO: 9028
  Synthetic

SEQ ID NO: 9030 - protein, 187 aa, Artificial Sequence
  Synthetic
SEIEDIIRRIRKLLEEDKEKIERSIRESRRLLEEAKRINEKSIEDVKRLLREIEDVVDKIDSREVEDLVRKIEEEVKRLVDEDRKRNEDMTRKNEELLKDVTEKSKKSIRDIEKLLEEAARRSGDEKMREKVERLREDVDRVRKELEKTLETVTRSHKRSSEENKRSLEESERTARKVIEDIRRRDR

SEQ ID NO: 9031 - protein, 187 aa, Artificial Sequence; identical to SEQ ID NO: 9030
  Synthetic

SEQ ID NO: 9032 - protein, 187 aa, Artificial Sequence
  Synthetic
KDIEEVLKRIKDLLEDIRRRLKESEERSRKLLEEAREINERSIERVRRLLEEIRRLKEEIDSKDVRELIEKVLKEIEDLLRDDKRKNEDMTRKNEELLKKLKKEIEDVLREIKELLDRARKRSGREEMERKVRELERAVREVIKEVEKLLTDVARKHKKVSRDNKESLRRSEEEARRVIRAVEETDR

SEQ ID NO: 9033 - protein, 187 aa, Artificial Sequence; identical to SEQ ID NO: 9032
  Synthetic

SEQ ID NO: 9034 - protein, 176 aa, Artificial Sequence
  Synthetic
STLETVEKKVEEVIRENEKSMRESEEKVDRSTKRIEDVLRRLEETIRKTSDDIAKDVKGERVKEVLEENRRLLEEAKKLVDEVLETNKKLLEDDKRLNEEVSKTLKKLLEEIKRVDTREDATRVIEEAKRILDEARKLNEETIRRSEELVRRIERVIEEIIKRSEKLLEDVRRESK

SEQ ID NO: 9035 - protein, 176 aa, Artificial Sequence; identical to SEQ ID NO: 9034
  Synthetic

SEQ ID NO: 9036 - protein, 176 aa, Artificial Sequence
  Synthetic
SVLDDVRKKVEEVLDRNRELADRSRRTVEEVLRENERVMEESKRTVDEVIKRVAEKLKGEKVEEVIRRLEKLAEEDRRRNKEVTEELKRLLEELRRKNEEVTERLKRLEEEIKRVDVREDAERMIERLKRILDRVEEENRRAIEELREVLERVRDDNRRTIEELERILKRVEEESR

SEQ ID NO: 9037 - protein, 176 aa, Artificial Sequence; identical to SEQ ID NO: 9036
  Synthetic

SEQ ID NO: 9038 - protein, 176 aa, Artificial Sequence
  Synthetic
STVETVREEVERVLKHSDDLIKEVEDVNRRVEEEIKRVIRELEEENERLVREVRKKVKGEILKEIEKRLRDNSEKVREVAERAKKLLEENTRRVKDILRESRKLVKDLLDEVERVTREEEAREIIKRLREVNKRTKEKLDELIKHSEEVLERVKRLIDELRKHSEEVLEDLRRRAK

SEQ ID NO: 9039 - protein, 176 aa, Artificial Sequence; identical to SEQ ID NO: 9038
  Synthetic

SEQ ID NO: 9040 - protein, 176 aa, Artificial Sequence
  Synthetic
DEVERVAKEVEDVLREVEKLIRDVRRKVEEVLKHSEEVAKRVRDTNRELVKEVERDIKSEELKEARKALEDNSRKVKEILDESEKLVRELLRRVEELLKKVRKEIEDLLRKVKDVKDEKELRDIIRRLKEVLDKLKKDLEDIIRRLEEVNRESERLAREAIRHSEEVLDKLRKDSK

SEQ ID NO: 9041 - protein, 176 aa, Artificial Sequence; identical to SEQ ID NO: 9040
  Synthetic

SEQ ID NO: 9042 - protein, 175 aa, Artificial Sequence
  Synthetic
REVEEVKKRIREALEESERVIRENKKKNEELLDRVRKEIERNKKKNEEVLKRAKEVTKAGRPKSRVLEEIRRIVEESRRHLDKVLEDVERILRDSKRHVDEVNRKSETIARELKKKVKDVEDVKRKIDRMVEESRKLVEDLKRESDRVEEEVRKLVKTIKDEITRSLDEVRKDAE

SEQ ID NO: 9043 - protein, 175 aa, Artificial Sequence; identical to SEQ ID NO: 9042
  Synthetic

SEQ ID NO: 9044 - protein, 175 aa, Artificial Sequence
  Synthetic
SEVDEVRKDIERILRKSERDIRRNKEENKRLLDEVRRRIEENRKENEDLLKRIEELRRAGRPESEVDEEVRKIIEKSKEHVDRVLEEIEEELRRSKEHLKRVNEESEEIAKELKKRVKDVEEVKKEIDKAVEDSKRLVEDAERVSDEVRERVRRLVERLKEESDRVEREVEKRTT

SEQ ID NO: 9045 - protein, 175 aa, Artificial Sequence; identical to SEQ ID NO: 9044
  Synthetic

SEQ ID NO: 9046 - protein, 185 aa, Artificial Sequence
  Synthetic
SEVEEVLRRAEKLSEDNKRENDESLERLRRIVEKVREENEESVKTLEKILKEVEEVVRRNKEVQEELRKIVEELRDLIDKDLRRTDDIIRELRKRIEEDLKRSKDIVKEIRDTIREVVERLKKDDKKEVIKRLEDEVRRLEEDNKRSIKKSEDEIRKLVERLKRSAERSDEVIRKLEKDAEDLIR

SEQ ID NO: 9047 - protein, 185 aa, Artificial Sequence; identical to SEQ ID NO: 9046
  Synthetic

SEQ ID NO: 9048 - protein, 181 aa, Artificial Sequence
  Synthetic
DEVERILEDSKRLVDELRERVERVIEESKRLLDDLRRKVEEVVRRLEKIVEDLKRMIEGGVDREVVRKVERDLKELVREVERRIEKVSKENTELLDRVEKEIRKVVRTNSELAKEALRRIGDEDKVRELKETADRSNEEIKRVLEKIKRMIEDTNRKIKKLLEEIRDVARRVLEEVREVAR

SEQ ID NO: 9049 - protein, 181 aa, Artificial Sequence; identical to SEQ ID NO: 9048
  Synthetic

SEQ ID NO: 9050 - protein, 181 aa, Artificial Sequence
  Synthetic
KEVEDVLRESKRLVEDLERRSERSIEESKRLLKELEDLVEEVIRRSEESIDRLRELIKGGTSEEAIKEVKKTNERLIKEVERLIREVSKRNTDLVEENRKLVEKVVRDNSRLLEELARRIGDEKKVRDAEREARDSNDKIRRSLEKVERVVRETNRRIKELLEKIERVIRDTDRKIAEEAK

SEQ ID NO: 9051 - protein, 181 aa, Artificial Sequence; identical to SEQ ID NO: 9050
  Synthetic

SEQ ID NO: 9052 - protein, 181 aa, Artificial Sequence
  Synthetic
SEVEKIVRDSEKLLEDLKRELEKVIKDSDDLVRELKKRVTEVLERLRRIVEELRKLIEGGASEEVLERVLRRLEELIRRVEEEIRRVVEENSKLVEELKRRIEEVSRRNTELVKDAARKIGDEEKVRRLEKEARRTNEEIRKLLEKVDEVARRSNERIKAVLEEIKREIEKLKREVEKDAK

SEQ ID NO: 9053 - protein, 181 aa, Artificial Sequence; identical to SEQ ID NO: 9052
  Synthetic

SEQ ID NO: 9054 - protein, 181 aa, Artificial Sequence
  Synthetic
SEIEEVLKKSKKLVDDLRKEVEETIRESKKTVDDLDKEIKEVVRRSEESLDRLKKLIDGGSSEETIKKVVRDNERLVKEVLKSIEEVLKRNKKLNDDSNERAKRVSDTNTRLVEEVVRRIGDERKVDEIRRAVEETNEEIKRVVDEDNKAVKRSLEEIERVAEEIKRVAEETLKAIEDARR

SEQ ID NO: 9055 - protein, 181 aa, Artificial Sequence; identical to SEQ ID NO: 9054
  Synthetic

SEQ ID NO: 9056 - protein, 182 aa, Artificial Sequence
  Synthetic
DEVEELVRRLEELVKRSRDTNRKIIKEIRELSERLKRELEKIARELEKLVEDLKEEVKRLKDKDTLRKMIRDVEEKIRRLLEKVERLVRESLRRHEKLLDDVRRTNKEISDRLKTLLDEIRRRNVDVEKIEDVVRRLLEENERVLRRTEEEARRVLETNRDLLRKIREVVDRLEKEIREAEK

SEQ ID NO: 9057 - protein, 182 aa, Artificial Sequence; identical to SEQ ID NO: 9056
  Synthetic

SEQ ID NO: 9058 - protein, 182 aa, Artificial Sequence
  Synthetic
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 9059 - protein, 182 aa, Artificial Sequence; identical to SEQ ID NO: 9058
  Synthetic

SEQ ID NO: 9060 - protein, 182 aa, Artificial Sequence
  Synthetic
SEADEMLRRLKELVDRSRDTNRKILKRSEDLVRDSKKKNDDIIRELRRLLEELRELARRLKDKDTLRKIVEEVKERIRRLLEEVERTNREVTERNRELLREVEERNRRISKELKDLLREAEERNVKTDDVRREVERLLRDNKRVLDETRKAAEESTRRNKKVLEESREVVKDVLKKIEDTDR

SEQ ID NO: 9061 - protein, 182 aa, Artificial Sequence; identical to SEQ ID NO: 9060
  Synthetic

SEQ ID NO: 9062 - protein, 182 aa, Artificial Sequence
  Synthetic
DEVREVAERLRRLVDESRKRNEEVIKESEALVDRVRKTNEEVMKRLRELIDKLEKDIRRLKDKKTVEKIIREVLKKIDELLKRVERTNREISKENKRLLDEVRKTNEEISRRLKKLLEDIRRRNVDVETIERVVRELLEENKEVLRKTEEMVKRSTETNKRLLERSKEVADRLRERIKEAAK

SEQ ID NO: 9063 - protein, 182 aa, Artificial Sequence; identical to SEQ ID NO: 9062
  Synthetic

SEQ ID NO: 9064 - protein, 182 aa, Artificial Sequence
  Synthetic
DEVDELLKRLRKLVDEVRKENDKMVKESKRLVEDLKRKIDEIIERIERLLEELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 9065 - protein, 182 aa, Artificial Sequence; identical to SEQ ID NO: 9064
  Synthetic

SEQ ID NO: 9066 - protein, 184 aa, Artificial Sequence
  Synthetic
DEVEEVKKKLREIVKRDRDLIERVREELKEILDRNREINRRAIEDLKRILEEVDELVKRGTDKKDLEKILRDIERLVEEVRRRSRELVERAKRLIEKVVTDSKKTVERIRRDVEKVLDDLRRKNKEELIRDVERVVREVLRRIEKSIRDLDRVIRDVLDKSRELIKRSEDVAKRVVDTLREKAR

SEQ ID NO: 9067 - protein, 184 aa, Artificial Sequence; identical to SEQ ID NO: 9066
  Synthetic

SEQ ID NO: 9068 - protein, 186 aa, Artificial Sequence
  Synthetic
DEVETVKKELKELADEVKERNERSIRDSERLLEEVKRRNEKSIRDLERLVEELEDVLRKRGSEDEDVKRKVEEVDRRIDKLAEDDKRINEKVLKENSDLVKRDEDINRKILEDVRRLVEKVRREIGDEKKVKEVTDEVKKVLDEIRELDKRSRDAVRRTNEEIKRLDKESKDVVDRVKKKVEDAVR

SEQ ID NO: 9069 - protein, 186 aa, Artificial Sequence; identical to SEQ ID NO: 9068
  Synthetic

SEQ ID NO: 9070 - protein, 186 aa, Artificial Sequence
  Synthetic
REVEEIIERLKKLLKEIAERNTESIKELEELVRRIAEDNKRIIEELRRLLEELADVVRKKGSESREVEEKVREVLRRLEKLLEDVRRINEDALRKIEELVKRDADENRTVLKRLEELVRDVARRIGDEKKVREVRKVAEEVLRAIEELDKRSRDAVRRVTKRVKDLDEETKRVVEDVLRRIEELMK

SEQ ID NO: 9071 - protein, 186 aa, Artificial Sequence; identical to SEQ ID NO: 9070
  Synthetic

SEQ ID NO: 9072 - protein, 186 aa, Artificial Sequence
  Synthetic
SRVEEIIEDLRRLLEEIRKENEDSIRRSKELLDRVKEINDTIIKELERLLKDIEKEVREKGSESEEVKKALRRVLEELEKLLRRVAEINEEVLRRNSKLVEEDERRNREVLKELKRLVEELMREIGDEDKVRKVREVAEKVLRDIDKLDRESKEAFRRTNEEIRKLDEDTRRVAERVKKAIEDLAK

SEQ ID NO: 9073 - protein, 186 aa, Artificial Sequence; identical to SEQ ID NO: 9072
  Synthetic

SEQ ID NO: 9074 - protein, 186 aa, Artificial Sequence
  Synthetic
SEVEEIIRRLEELVREVAKRNEDIIKRSRDLIRKVKEDNRRSEEELRDLSRRIADIVRKKGSESEEVKRELDKALRRLEELIKRDAEINEKVLRENSTLARRVEEINERILRELKKLVDDIARKIGDERKVREVRRVAKKVLEDVKTLDDKTREVARRTNEDIKRLDEKSRKVIEEVRREIEELKR

SEQ ID NO: 9075 - protein, 186 aa, Artificial Sequence; identical to SEQ ID NO: 9074
  Synthetic

SEQ ID NO: 9076 - protein, 186 aa, Artificial Sequence
  Synthetic
SEVDEIIKELERLLREIARENERIIRESRKLADEVRKRNEDAIRKLEELVRRLADMVRRKGSESEEVKKLIEDVLREIERLLKRIEEENREVVKRNSELVERVRRINEEILRRVKELVEKIARDIGDKDKVTKVKKVADDVLREIKKLDDETRRVIEDTNKKIKDLDKKTRDVVRKVLEEVKKLEK

SEQ ID NO: 9077 - protein, 186 aa, Artificial Sequence; identical to SEQ ID NO: 9076
  Synthetic

SEQ ID NO: 9078 - protein, 186 aa, Artificial Sequence
  Synthetic
SDVEDVIRKLETLVDDLRRKVERIKERSRELIKRIAEENRKVIEELERLLEELADVVRRKGSESEEVDRTAEEVRKKVKELLDRVARSNEEILKENSKLLDDIRREIEEVERRIKELAKDIARKIGDEKKVRDVRRVAEKVLREVRRLMEEVERVARKTNRDIERLDEETRRVVEKVRKEIEDLRR

SEQ ID NO: 9079 - protein, 186 aa, Artificial Sequence; identical to SEQ ID NO: 9078
  Synthetic

SEQ ID NO: 9080 - protein, 176 aa, Artificial Sequence
  Synthetic
SAKDKIAEVAKRVLTENKKLLEESEEVARRTSEESKRLLKESEDVVRRVLDEIRREIKGEKAKKVLDTLKEILDRDRKLNEESHERNKRLLDEVRRMNEEVSKELRRLLEEVREIRDERLIEEVIRRLEELLKEVKKKNEEVIRRSKELIDRDRDLNRRSIEELERLIREVRKESK

SEQ ID NO: 9081 - protein, 176 aa, Artificial Sequence; identical to SEQ ID NO: 9080
  Synthetic

SEQ ID NO: 9082 - protein, 176 aa, Artificial Sequence
  Synthetic
SAKEKIKEVAERVEKRNKELLEESERVIKEVSERSERLLDESRKVVKRSTEEIRDKIKGEEAEKVLRDNEDLLREDEELNKTSHERNKRLLDEVRKRNKRVSDELRKLLEEVSRIDDEELIREVIERLKELVDRVEKENRKAIETSRRLLKEDEDLNRESIKRSEELVKDVRRRST

SEQ ID NO: 9083 - protein, 176 aa, Artificial Sequence; identical to SEQ ID NO: 9082
  Synthetic

SEQ ID NO: 9084 - protein, 176 aa, Artificial Sequence
  Synthetic
DARKELEEVVRRVEEEIRRLLKDIEDVAREVNRRSEKLLRETEEVIRRSTEEIKRDVKSELVKEILERNEELLRRVKKLNEEVNEELRRILDEIRRLVEEVEERIKKLLEEAKRVNERERVKEIIERLRRLVEELKKLVDEVRKRLEDVVRELKERNKKVIDDSKDLVRRAREESR

SEQ ID NO: 9085 - protein, 176 aa, Artificial Sequence; identical to SEQ ID NO: 9084
  Synthetic

SEQ ID NO: 9086 - protein, 182 aa, Artificial Sequence
  Synthetic
DFSERLDEVLRKVRTDIKKLVEKVRRVVEDSRRRVEKLVEDVRRSSEEVLKTVKELLDRGLIEERVVEDVKRIIEETKEKLDRALEKAERDLRDSERHLDEVLKEIEKIIEEIREEVERLGGTDEVVRRLEKRLRDALKEAEDKVRRDEERNREVLERLEKIVRDLHRENEKAVEDVADRAR

SEQ ID NO: 9087 - protein, 182 aa, Artificial Sequence; identical to SEQ ID NO: 9086
  Synthetic

SEQ ID NO: 9088 - protein, 182 aa, Artificial Sequence
  Synthetic
DLSEEVKRVIEEVRKRIEELVDEVRKSTEEVIKRVRRLVEEVERVVEDSRRKVDKLLKEGRITEEVVKRAEKILRDSKKHLEEVERKVRDDLRRSEEEIRRVLKEIEDRLRELKKKIDKLGGTEEVVRRLKEELEKALRDAERIVKELHEENRKVLEDVKRMVDEDKKKNERVVDEVRRDAK

SEQ ID NO: 9089 - protein, 182 aa, Artificial Sequence; identical to SEQ ID NO: 9088
  Synthetic

SEQ ID NO: 9090 - protein, 182 aa, Artificial Sequence
  Synthetic
SLSEEVKKVIREVEEDVKRLVRELRESSERVLKEIKKLVDEVRRVLEESKERVKKLEREGKITDEVVREVEEEVKKSKENLDRVLEEIRKILERTKEKVDRVLEEIRKILKDIEDRIEELGGTDEVVRRLKKRLKEALDRLRDIARKLDKENKEALDEARRIVEENKRRNEKVVEDVERRAE

SEQ ID NO: 9091 - protein, 182 aa, Artificial Sequence; identical to SEQ ID NO: 9090
  Synthetic

SEQ ID NO: 9092 - protein, 185 aa, Artificial Sequence
  Synthetic
DEVEELKKDLKRVLEEVRKIVEDIHRTNEEVLREVEKIVEDIHRENKEVLEKVEKIMRELKDVDEALRRLKEEVERVLKRSEDKIKDLLDKVEKVLEESERRVRRLLREVERALRRVAEEVRKIDDEELVREVKRVVDELEKEVRDLLRRLKESTDKLREDVRRLAERLRDSLREMERDVREKTR

SEQ ID NO: 9093 - protein, 185 aa, Artificial Sequence; identical to SEQ ID NO: 9092
  Synthetic

SEQ ID NO: 9094 - protein, 185 aa, Artificial Sequence
  Synthetic
DEVERLKRELETVLRDVERIVEEIHRENKKNLDKVKKIVEEIHKENREVLEKVRKIMEELKDDDETLRRLLEEVDEMLDRSRRKIEELLRESKESADRSRKKVRDLLERVKEVADRVREEVKRIDDKKLVEEVEEVVKRVEEAVEELARRLEKSTRDVVEESKKLARELEKSLEEVKEEVRKLIT

SEQ ID NO: 9095 - protein, 185 aa, Artificial Sequence; identical to SEQ ID NO: 9094
  Synthetic

SEQ ID NO: 9096 - protein, 185 aa, Artificial Sequence
  Synthetic
KELEELIKRLKRVLEENRDIVRKIHEDNERNLDELRKIVERIHKENKRVLEEVKKIFEELKDDDKVLRELLEKVKRVADESRERVKRALERSKESVRESEERVKEALERSKKMLDDVREDVRRIDDERVVREVERVIKKLEDDSRKTVRDLEESTKEVEKRSKELADELEKSIEDLERRVDEDTK

SEQ ID NO: 9097 - protein, 185 aa, Artificial Sequence; identical to SEQ ID NO: 9096
  Synthetic

SEQ ID NO: 9098 - protein, 185 aa, Artificial Sequence
  Synthetic
REVEELKKELERVLKKVADLVEENERRNRKNLEDLRRIAEEIHRRNEEVVKRVRDTLERLRDVDEVLKRLLDEVEEVLKESEKRVRDALRRSEESVKKSEEDVKRILDEVKERLDRVREKLKRIDDEKLVRDVERVVEKVERDVKRLADRVREVLKESSDRSRELVERLRESLRKAREEVRKAIE

SEQ ID NO: 9099 - protein, 185 aa, Artificial Sequence; identical to SEQ ID NO: 9098
  Synthetic

SEQ ID NO: 9100 - protein, 186 aa, Artificial Sequence
  Synthetic
KDVDEVLKRLRELIDELRKTNERVKRELKKLVEDLERKNKDVERRLRELIRTLEEIARKTKDKETLRKILKEILDRIEKLLREAEETNRRAKEEIERLLKKAHDKNRKIEKEIDKLLKDITRRAKDDKDMVKKVRDVIEDLKREVERLDRETKEVVERVKRKIEKTNRDSKKVIDDLRREVERLRK

SEQ ID NO: 9101 - protein, 186 aa, Artificial Sequence; identical to SEQ ID NO: 9100
  Synthetic

SEQ ID NO: 9102 - protein, 186 aa, Artificial Sequence
  Synthetic
SEAERIVEELRKLIEDLRRKNEEVKERLKRLVREDEKRNEEVLKELEDRADELRKLVEKLSDKDTLKKILERAREEIKRLVKEIREENKRSVEKIEELLKRARDTNETILRRIEEEVRKAEKDLKDDKDVVDRLRRVIEDLKRTVEKSNEDSDRVIKEVKKRIDDSLKRVEDVIRRVKETIDRLEK

SEQ ID NO: 9103 - protein, 186 aa, Artificial Sequence; identical to SEQ ID NO: 9102
  Synthetic

SEQ ID NO: 9104 - protein, 186 aa, Artificial Sequence
  Synthetic
SDVDRVAKDLEKLIRDLEKINRDVSRENKELIEKDKKINEDVLRELDRLVEELERLVRELSDKETLKKILEDAVKEIRRLLEEIKERNDRSLERSKELLRRAEETNRDIERKIKDLLKRITDRIKDKKEMLEKIRKVAERLRREVERSNEESKKSADEAEKTIRKSLKEVEERIREVEKKIRDLKR

SEQ ID NO: 9105 - protein, 186 aa, Artificial Sequence; identical to SEQ ID NO: 9104
  Synthetic

SEQ ID NO: 9106 - protein, 186 aa, Artificial Sequence
  Synthetic
SEVDRVLKELDELIRTLEELNKKVSRENRELIKEDKKRNDEVVKRLEDLIRELKERVDKLKDKKTLKDMLRRMKEEIDKLLKEIRERNEESLKESDRLLREVHKLNRDIKKEIEDLLRDIERKIKDDKDALKKVREVIERLKEEVERLDRETKKSADEAKEAIKRSLEEVEDVVRKIREKIKKAEE

SEQ ID NO: 9107 - protein, 186 aa, Artificial Sequence; identical to SEQ ID NO: 9106
  Synthetic

SEQ ID NO: 9108 - protein, 186 aa, Artificial Sequence
  Synthetic
DEVERAKEELEKLVRKDEEDNDRVRKRLEELIRRLKEENDRVLEELRRLSEELDRLAKELKDKDTLRRRLEEARKEIEKLMREAHEENKRILEEIEKLLRDIEERNRESVERIERLLKKIEKDIKDDKEALDEVRRVIEEVKREIERSLRESREVIKELKERVKELDERTREVVRKVKEEIDELER

SEQ ID NO: 9109 - protein, 186 aa, Artificial Sequence; identical to SEQ ID NO: 9108
  Synthetic

SEQ ID NO: 9110 - protein, 186 aa, Artificial Sequence
  Synthetic
SEVDDVLRRLDKLVKDDKRTNDRIVTRDRETVKRVKEVNREIVERLERLVDRVREIVERLKDKDTLKKLVDEARKDIERLLKEAHDMNRESIERNRESVREVREINEDSVRKIRKLLREIETRVKDDEDALRKVREVIRRVEEDIKRSLRDSERVIEEVVTRNEKVDRETKKVVDEAKREIDERAK

SEQ ID NO: 9111 - protein, 186 aa, Artificial Sequence; identical to SEQ ID NO: 9110
  Synthetic

SEQ ID NO: 9112 - protein, 185 aa, Artificial Sequence
  Synthetic
SELEKLIEELERVLKRIEEVSRELDKELETVLDEIRRASKRLNDELRRALEEIARAATENKDIKELLEKLLREAKRVLDEVRKRSEELLRKLEEVLERVRKKSDDLLKELEEVLDRVKRTIERDIKSKLLERAEDVIRRVREALEELVRTNRESLERVERAARELNRRNEESLERARREVEKLRR

SEQ ID NO: 9113 - protein, 185 aa, Artificial Sequence; identical to SEQ ID NO: 9112
  Synthetic

SEQ ID NO: 9114 - protein, 185 aa, Artificial Sequence
  Synthetic
DEVRELIDRLRKALEEITRESRRLDEELRKVLEEVERRVEELSRRNKEMLDRVREKVTRRKDDTELLKEIERELKEILKRSDDEAKRILREVEEILRRVEEDSRRLLEKVRRVLKEVEERARRDVKSRLLEELKRVIDEVRREVERLNKKNKESLDRARRRVEDLLRRLEESVRRVEEELKKLST

SEQ ID NO: 9115 - protein, 185 aa, Artificial Sequence; identical to SEQ ID NO: 9114
  Synthetic

SEQ ID NO: 9116 - protein, 181 aa, Artificial Sequence
  Synthetic
SELERVIRESERTVEESHKHVREVIRKLRDIVRRSHEHVREVIERSKESVERVRDLVRRGVPREELKRILDEDKKRVDDVLRTNEELVRRIKEDVKRVLDENRKLLDEDRKRVKEVIDRITDEELVRRLKKVLDESEKAVTRNIEEIKKVLEDVVRKAEKNIREIAEVLERSTRAAKKDTD

SEQ ID NO: 9117 - protein, 181 aa, Artificial Sequence; identical to SEQ ID NO: 9116
  Synthetic

SEQ ID NO: 9118 - protein, 185 aa, Artificial Sequence
  Synthetic
ELEKRIDEVLKRVEDEIRKSIRENEEVLKDVERAVKELIKENERVLEEVREEVRKIIERVKEDKDLVRRLEEVAERIKRRVERTSRELDRMLKEVRKEVRRSSEESKRSLEEIRRKVEEAKRRIRSEDIVREVEKELEDILRDNRRLVRESIESLKDVVRRVAELVERSIRELKKMVDEIRKEAE

SEQ ID NO: 9119 - protein, 185 aa, Artificial Sequence; identical to SEQ ID NO: 9118
  Synthetic

SEQ ID NO: 9120 - protein, 185 aa, Artificial Sequence
  Synthetic
KLEERIEKVLEDAERDVRRSEEEIRRVLKEVEDRVRRLLRENEDALRRVEEEVKKIIDRVKDDERLVRDLKRTLDEIRERVKESNKRLEELLRRVEKTVREVLKRSRDSLRKVRTLVEEAKKRVRDEKIVKRVIETLRELLKENRKLVKDVIEDLKRIVKEVEELVRESIERLKDMVRRISEKAK

SEQ ID NO: 9121 - protein, 185 aa, Artificial Sequence; identical to SEQ ID NO: 9120
  Synthetic

SEQ ID NO: 9122 - protein, 180 aa, Artificial Sequence
  Synthetic
KEVEEIIETLKRLSEDLERKVREIIERLKRLSERLERENKEVIKELERLIDELRKLVEDGEDSSMVRRVEKKLEELLRRVKKLNEDVKEESKRLVEEARKVIEKVLRESKELADDARKKVDSEDLRKLDRVVKESERTIRDLLRKLDEVAKRSDDTIERVNDETAKVIERVKRKIEELEK

SEQ ID NO: 9123 - protein, 180 aa, Artificial Sequence; identical to SEQ ID NO: 9122
  Synthetic

SEQ ID NO: 9124 - protein, 180 aa, Artificial Sequence
  Synthetic
REVEEMIKELEELLKDLKEKNERASKRNRELVRRLEEENKRVIEELKKLVKELEDLVRSGEDEKVLREVLKRLEEVLERVRKLNERVLEKIEKSLEEVKRSNERVKRRLKELLEEAERRVDSEKLKELRDVIKEVKKRIDELDEYTRESIRRAKKEIERLNRETKKVIEEVVKRIEEERK

SEQ ID NO: 9125 - protein, 180 aa, Artificial Sequence; identical to SEQ ID NO: 9124
  Synthetic

SEQ ID NO: 9126 - protein, 174 aa, Artificial Sequence
  Synthetic
SEKEEVRRVIEELRRILKRVLEDLRRVVKENEDRLRELKKENEKSLRELEERARRIDIDEKVLRRIEKMIKDSEENVRESVRRNERLLEESKKHMKEVADRVEKILRELRDLVEKGVDVEDLKREIDRVAKEVEEVLEENRRRNEKSVEELRRDSKRNHERNEEVVKEAEDAAR

SEQ ID NO: 9127 - protein, 174 aa, Artificial Sequence; identical to SEQ ID NO: 9126
  Synthetic

SEQ ID NO: 9128 - protein, 174 aa, Artificial Sequence
  Synthetic
SEEERVRKALEELKRELDKVHENNKRSLRENEETLKKLLEDNERSLRELEEEMRRVDIDEKVLREAKRKLDESRKNVERSAKENKDLVDESRKHSDKVRREVEKILRDLEELVRRGVDVEELIKTLRRVAKEVRERSEENDRRNKKSVDELREDSKRNHDENDKVLKKLEKAAE

SEQ ID NO: 9129 - protein, 174 aa, Artificial Sequence; identical to SEQ ID NO: 9128
  Synthetic

SEQ ID NO: 9130 - protein, 178 aa, Artificial Sequence
  Synthetic
DEVEKLEEDSERSLEELRKTVEEVKKRSEDSLRDLERKSRENEKESRRTLRELREKDQDKRLIEELMRRDVEHIKRSLREHERILEEDLRRLKKVLEDLERRIREDLRRLEEVLKRQTDERVRKRVKDAAEKSRRVIEDLLREIKRVADDSRREAKRLLDRNKEVLERSKETADREKK

SEQ ID NO: 9131 - protein, 178 aa, Artificial Sequence; identical to SEQ ID NO: 9130
  Synthetic

SEQ ID NO: 9132 - protein, 178 aa, Artificial Sequence
  Synthetic
DEVEKLAEDSKRSLEKLRREVEKVKRESRESLKRLKEESEKNVRDLRRLLEELRRRPEDKKIIREEVEKALRHLEDSLRRHEEEMRKDVRRLEKVLEKLKKIITEDLRRLEEVLKRLTDERLLKRVKDVMDESRKVIRELLELIKEVIRESKETVKRLLDENKRVADEVRKVVDELRK

SEQ ID NO: 9133 - protein, 178 aa, Artificial Sequence; identical to SEQ ID NO: 9132
  Synthetic

SEQ ID NO: 9134 - protein, 184 aa, Artificial Sequence
  Synthetic
SEVEEVEREVKEVIEELDEIVKRVKEENDDSVRKSKRSLDEIEAEVRRVLKELTDRVTKRKTEDVRRELEKEIDRVRRKLEKILEDNRKKAEEDLTRTRKIAEELRKKIEDVVRRLEEIVKRLDKEEVLERLTRLIEKLKDVIRRLRERLKKSADDSRDVIRRTLEAIKEIIERLKEVIDRLDK

SEQ ID NO: 9135 - protein, 184 aa, Artificial Sequence; identical to SEQ ID NO: 9134
  Synthetic

SEQ ID NO: 9136 - protein, 181 aa, Artificial Sequence
  Synthetic
DEIEKLREDVKKTLEESRKSVEDLERRSEDSIRRSRESVERLKREVKEVIDRLRDARRRGTPEEKIEELLKRVRDRIEEVLRRNERLVEENKKEITRVLDTNRRLNEESNRELKRVLDKTRDKRVLDEIKKLADEDNKTVTDSLKRIRDSAKKVDEVVRESLERIRKVAEEITKVVEDVKR

SEQ ID NO: 9137 - protein, 181 aa, Artificial Sequence; identical to SEQ ID NO: 9136
  Synthetic

SEQ ID NO: 9138 - protein, 181 aa, Artificial Sequence
  Synthetic
SELETLEKSLRDVLKESRDSVEKLRKEVEDTIKESEDSVTKLLKEIEDVIRRLEDLRRRGVPEEAIKKLVREVAEAVKEVLRRNRELNKRSNERAKEVVDRNRKLAEDLLDEIRKVLAKVTDEDVLRRIRRAAEEVRKVAKESVDRIRDLAARDNEVVERSLKKIEEVLRRIKKVADDVAR

SEQ ID NO: 9139 - protein, 181 aa, Artificial Sequence; identical to SEQ ID NO: 9138
  Synthetic

SEQ ID NO: 9140 - protein, 181 aa, Artificial Sequence
  Synthetic
SEIERLEREVREVIKESEESVRRLKKRVDDTVRENEELVKRLEDRVRRMKERLEDARRRGRPEKDIEELLKTIAKEIKDVLEESRESNERSNTDIKRVLEENTKLVKDVLRRIERVLDKSTDDDVKRKIRKVMEEIKKRADDSRRKIEDVARKDNKAVERSLRRIERLLEEITRVVEEIKK

SEQ ID NO: 9141 - protein, 181 aa, Artificial Sequence; identical to SEQ ID NO: 9140
  Synthetic

SEQ ID NO: 9142 - protein, 181 aa, Artificial Sequence
  Synthetic
SELEKLDKESRDSIRKSEDSVRRLEEESEESIERSKRLVEELKRLADEVIRRLEDMARRGTDKTKIRELIKRLKELAEEVVKRNSELVERNRRRIEEVERTNEELVRRNEETIKEVLKKTRDEDVLRAIEESMKRARKAVEDSLRRIRESLEKVKEEVRRSNEKIKKIVKEVREVVERIAD

SEQ ID NO: 9143 - protein, 181 aa, Artificial Sequence; identical to SEQ ID NO: 9142
  Synthetic

SEQ ID NO: 9144 - protein, 181 aa, Artificial Sequence
  Synthetic
DELEDLEREVREVIEESKRLLEELEKRVKEVIKTSRDSVRRLKERVDRVIKELRDAKRRGEPREKIRELVERLKREVEKVERENDDLLRRVAEEIERVVEENSRLLEEVKRRIEEVLARTRDEDVLRKIRELLEEIRRVIEETNRRIKKLLEEIKRVADDSRRRIRKVAREVEEEAKEIEK

SEQ ID NO: 9145 - protein, 181 aa, Artificial Sequence; identical to SEQ ID NO: 9144
  Synthetic

SEQ ID NO: 9146 - protein, 181 aa, Artificial Sequence
  Synthetic
SVRERIDELEKKIKRVVEKVLKENKDSLKRVEERVRRLLEENKRSLDEVREAVERVLSEVRDKRELLEKLRRILRENEKRNTESLREHERILEENKRRNEESLKRHKDLLDEVKELIDRARDLEDVEKLERDVEKVIEDARRTSEEVKRENDKALKDLDRLSEEVEKENRKALEDLKRTSD

SEQ ID NO: 9147 - protein, 181 aa, Artificial Sequence; identical to SEQ ID NO: 9146
  Synthetic

SEQ ID NO: 9148 - protein, 181 aa, Artificial Sequence
  Synthetic
SVRETIDKALKKIRDVAEDLKRRNDELLKEIEEVARDSSEKIRRALEEVERRVREVLKRVKDRRELLRTIEELLKEIRKEVEDVHRRNKRLLEEIRKIVKRSKDEHERLLKEVKETVDRMRDLEDVEKLKKDIERIIRELEELSDRLKKIIEEVIKKSEDLVRRLRESLERVLREIDKTTK

SEQ ID NO: 9149 - protein, 181 aa, Artificial Sequence; identical to SEQ ID NO: 9148
  Synthetic

SEQ ID NO: 9150 - protein, 181 aa, Artificial Sequence
  Synthetic
SVREEIDRILREIEEVVKTSSERIKRLLEKIEEVVKRLIEENRRVLKRTDEEADRLLKEVKDDKDLLRELRDLLKKARELNTEITERLKRLLDRIRELIEKVHRENEKLLREIRERIKEARELEDVDTLRKEVKEVIDTSEDLVRRLEEEVRKAAKRLKDLVDDSRRLNTEILRTLRERRR

SEQ ID NO: 9151 - protein, 181 aa, Artificial Sequence; identical to SEQ ID NO: 9150
  Synthetic

SEQ ID NO: 9152 - protein, 177 aa, Artificial Sequence
  Synthetic
DDLKRLEEDVRRIIEENDRIVKDIAEKSKKSIEDNRRLLKRLRDESERTIDDIRRLKEEGQDRRRLEEVLEEDHRLVKEINERSKKILDEDHKLIEEINKRSKDLLDRIRRLAEKAAEKRDVEEIRRLLKEITDVVRESNRRIKRINETAHEVVRRSNTETTKVNKKAHDVVEEVKR

SEQ ID NO: 9153 - protein, 177 aa, Artificial Sequence; identical to SEQ ID NO: 9152
  Synthetic

SEQ ID NO: 9154 - protein, 181 aa, Artificial Sequence
  Synthetic
SLIEKIREIVKEIIKRSDDSVEEVKRRNEESIRRSEESVKDNRRRIEDIIRKLKRLKEEGRDRRDVEDLVRRIVEESKKTLRENEKLLEDDRRINEKILEDNKRLLKKAREDLKRVLEKTTDDDMLRKIEALAREVTEVSKRALEEIRKLMEESTEVSKRALERIEASVEEVRRVAEEVKR

SEQ ID NO: 9155 - protein, 181 aa, Artificial Sequence; identical to SEQ ID NO: 9154
  Synthetic

SEQ ID NO: 9156 - protein, 181 aa, Artificial Sequence
  Synthetic
SLLEEIEKEVREIIKRSRKSLEEVKRRNDDSIRKSEKLVEDNKREIEEVKERARKLKEDGTDRKRIRELMERIERSSEETLKENSRLVTRDREINEEVLRRNRKLLEEIRRRLEEVLRRTTDKRVLEEIDRLAKDVKRVSDEVLEEIKRLAKESKEMADRSNEEIKKSVEEVRRVVEEVEK

SEQ ID NO: 9157 - protein, 181 aa, Artificial Sequence; identical to SEQ ID NO: 9156
  Synthetic

SEQ ID NO: 9158 - protein, 181 aa, Artificial Sequence
  Synthetic
DEIEELEKLIRKAIKDSRDLVRKLEEENKRSIDTSRELLKELERMLDEVRRRLEDLKRKNGSSEELRDLLRRIKERAKRVHEKNEELLRRDDKRNRDVHRRNEELLREVEKLVRDVARKIDKEELLREIKKLLDTIRRVIEESSERIKKLAEDSREVVKESSTEIKRLLETITEVVDRVTK

SEQ ID NO: 9159 - protein, 181 aa, Artificial Sequence; identical to SEQ ID NO: 9158
  Synthetic

SEQ ID NO: 9160 - protein, 181 aa, Artificial Sequence
  Synthetic
DEVEEAEKLIRKVIKDSEKLLRDLADLNRKSIRRSEKLVEDDRRANEDVIRKLEELRRNNGSEEELRRLLKEVEDTNRRSHETNKRLLDEDRRLNKEVHDRNEKLLRDIKRLVEEVEKRIDKEELLRRIKKLLDEIKKAIEDSSREIKRLLEESERVAKRSSEDIKRTLDDTRRVVEEVRR

SEQ ID NO: 9161 - protein, 181 aa, Artificial Sequence; identical to SEQ ID NO: 9160
  Synthetic

SEQ ID NO: 9162 - protein, 183 aa, Artificial Sequence
  Synthetic
DVEETVRKLIEDVKRVMERVRKSNTDLIRRSKEVLKDARRLHEELTKEVKDVLRRLEEEVKDEDTLREIRKKITELLKENERVLRDVERNVREDVKRLKENLDDNKRKAEEVIKDLERVMSSDKREVVKRVEEDVRKKLEESTKDSKRVERESEENLRRAKEKSKRVLKKLKDDLRRLEEESR

SEQ ID NO: 9163 - protein, 183 aa, Artificial Sequence; identical to SEQ ID NO: 9162
  Synthetic

SEQ ID NO: 9164 - protein, 183 aa, Artificial Sequence
  Synthetic
SVKETVKDLEREVREVLKKLRDDVRKLIEESDKALKRLKKIHDDLSRDVRRVLEDLRRRVKDEDTVREIERKARELDKKNRDVARDVERNVREDIKRLEDELRKLEDEIRRLEEELREVSKIEDKKMIDDVVRRVRKKLKEIDEKVKDVERKSRENLKRLKEKSDRVAEDLKKILDELREEVR

SEQ ID NO: 9165 - protein, 183 aa, Artificial Sequence; identical to SEQ ID NO: 9164
  Synthetic

SEQ ID NO: 9166 - protein, 183 aa, Artificial Sequence
  Synthetic
SVEETITELIKEVRKVAEEVKKSNKEVIEESEEALKELERTHTELSEEVRKVLRELEEEVKDEDTLRRIRKAIRDLDEENKRVLERVRKNVKEDIERLRENLKRNEELARRVIRELEKVMRVDKKEVVTEVVKEVKKRLEESKDDSRRVMEESRRNLKKLREESKRVVEELRRELRRLKEEVR

SEQ ID NO: 9167 - protein, 183 aa, Artificial Sequence; identical to SEQ ID NO: 9166
  Synthetic

SEQ ID NO: 9168 - protein, 183 aa, Artificial Sequence
  Synthetic
DVEETVRKLIEKVKRVLERLEEEHKRLSDDSRRVVKKLKDDVEDLIRRVEEVLKELERRVKDEKTLKDIRKKIEELIRELREVAKRLEDNAREDDKENREVLKRVREEIRRLIEKLKDMMRVEDRKAVDEVRKEVDRRLEELKRDSERVVKKSEENLRRLEEEVRKVEEKVRRTLKRLKEEAK

SEQ ID NO: 9169 - protein, 183 aa, Artificial Sequence; identical to SEQ ID NO: 9168
  Synthetic

SEQ ID NO: 9170 - protein, 178 aa, Artificial Sequence
  Synthetic
DKLEKVLEEIKRRLEENERLLRKVERDLKRLSKENEDRLRKMLEDLRKLSEDLLRSVEKDKDLKEEIRDVIEKLRRLNDELRKDTERSLKRLRELNEEARKRSEDSARRLRELIKELKRDRDVEKVDELLKEVEEIIDRSRKEIDRTRKDNERSVKRSEDAIRKTLDENEKSLREATR

SEQ ID NO: 9171 - protein, 178 aa, Artificial Sequence; identical to SEQ ID NO: 9170
  Synthetic

SEQ ID NO: 9172 - protein, 178 aa, Artificial Sequence
  Synthetic
SDVEEMEKRIRDRLRENRRIVEDVAKKLRDLSRRLEEEVKKVAEELRRLSDELRKRVTRRKELRRDIEEVLKRLRELNKRLREDVDRAMRELRELNKELDKRSEESLKRLEELARDLARRKDVERVKDLLREVKRVIDESKKTIRDTLEENEDSIRRLRERIDETLKENEKSIKELKD

SEQ ID NO: 9173 - protein, 178 aa, Artificial Sequence; identical to SEQ ID NO: 9172
  Synthetic

SEQ ID NO: 9174 - protein, 178 aa, Artificial Sequence
  Synthetic
SSVEEVKKELDKILEELKEKSERSKEEVERVLKKLREKSDRVEREVRKAEERLRRKVKDIREDELKEELTKEVKEVLEKNEEIAKELTREVKEVNRKNEKILDELRREVERVEEKIRRRLEDDETVERLLKKLKDVLEELRRRHEEVSKRLEKVLKELVDRHKKVTEDLKRVLDELRK

SEQ ID NO: 9175 - protein, 178 aa, Artificial Sequence; identical to SEQ ID NO: 9174
  Synthetic

SEQ ID NO: 9176 - protein, 184 aa, Artificial Sequence
  Synthetic
SLEETLKKLIEEVEEVLRRSEEIAREAIRRSERVLEELERRHKKVTDEIKEMLRELRERIDDKDTLKKVTDKIRELLRENEDVLRRVREEVRRDVEELRRALEDNKRKVERVIEELEEVLKKLKREELVERVLDKVRRDLEDSRRHLEEVKRKSEESLKKLKKETKDALDTIREKLKRIADELR

SEQ ID NO: 9177 - protein, 184 aa, Artificial Sequence; identical to SEQ ID NO: 9176
  Synthetic

SEQ ID NO: 9178 - protein, 184 aa, Artificial Sequence
  Synthetic
SMEEKVKRIIKKVDDVLKDSERRITELIKKSRDVLRELEKRHEELTKRVKDVLDDLRRKIRDKDTAKKVEDDVRRLLEENKRVLEEVRESVKRDIERLEEVLRRSRKHIEEVKERLDRVLKKVTDDRAVDTVRKEVEKALEENRKTVRDVEEESDRSLRRLREKTDEVRRRVEEILKRLKERVD

SEQ ID NO: 9179 - protein, 184 aa, Artificial Sequence; identical to SEQ ID NO: 9178
  Synthetic

SEQ ID NO: 9180 - protein, 184 aa, Artificial Sequence
  Synthetic
ELEERIKELIKKVRDVLRKSKEEVDKVIRKSEEVVRETEKLVEDIIRRVEKVLDEVRKRIKDKDTLKEVKELAETVIRKLEKILRDNKELVDRDIERLKKVARESEKHIREVERELEEVLKKLKTKELVRTLERRVEEVLRRNEELVKRVREESDRSIDRSRRSLERAEEDVDRVLKEVKDRTT

SEQ ID NO: 9181 - protein, 184 aa, Artificial Sequence; identical to SEQ ID NO: 9180
  Synthetic

SEQ ID NO: 9182 - protein, 184 aa, Artificial Sequence
  Synthetic
DLEKKVEDVIREVEKVLRELRRRHEELTKRSEDAVKETKDRVKEIEDEVRRVVDKVRKDIKDKDTLERVERKAEEVIRRLRRILEENKKSADRDVRRNEDMLRRVEKTVRDVKRKLERVLKDLKTDELVKELKRDVERVLKRLKERSDEVRKESEKSIKKSKDSLEKAEREVREMLRDLDRETK

SEQ ID NO: 9183 - protein, 184 aa, Artificial Sequence; identical to SEQ ID NO: 9182
  Synthetic

SEQ ID NO: 9184 - protein, 184 aa, Artificial Sequence
  Synthetic
SMEERVKELIRRVRKVLEDTERRAKEIIEDVERVLEELKKRHEDLTRKVDKVLKELKKEIRDEDTLREVEKTVRDVLRKNETVLREVEETVRRVIKRLEEILRRNRKKIEDVERELDKVLKKVTDEKLVTKVEEDAERALRESEESLRKVEREVKRVLEELKRKTEKVARELDKILKELKDRTR

SEQ ID NO: 9185 - protein, 184 aa, Artificial Sequence; identical to SEQ ID NO: 9184
  Synthetic

SEQ ID NO: 9186 - protein, 184 aa, Artificial Sequence
  Synthetic
SLEDELRKLIEDVKRVAKETEDRVREILKRSKDVLDELKKEHDKLTREVERVLDELAKEIKDKDTLREVKKRVDDLLKRNEDVVREVEKIVEEDLDRLRRILEENKRLAEEVIRRLEEVMKKLKTEELVKKVKKEVEDVLRRSKESLKKAEEDSRKSLEELKKKTEDLKREVKEILDRLKERVR

SEQ ID NO: 9187 - protein, 184 aa, Artificial Sequence; identical to SEQ ID NO: 9186
  Synthetic

SEQ ID NO: 9188 - protein, 184 aa, Artificial Sequence
  Synthetic
SELEKLKREVDEVLKRNKELVDELRKRVRKALEESRRSVEEVERRVEEVLKRLEDDLRREKSKEVIDKLRKLVEDLIRELEDLLRKNKEKAERLLEELKKLLDESRRHIEELEKELKKLLDRLDKEELKEKVRRILKEVRRVLDESRRDVERVLREVEKVMRESIKKARDAIRKVEEVLRELER

SEQ ID NO: 9189 - protein, 184 aa, Artificial Sequence; identical to SEQ ID NO: 9188
  Synthetic

SEQ ID NO: 9190 - protein, 184 aa, Artificial Sequence
  Synthetic
RELDDARRKVEEVLKTNKDLVDKIRKEVEETLERLDRSSRKVREIVRRVLEELTRRATERKTEDVERELAEVVDRVIKELRRIVEENRKLSEKSIKELRELLERSERHIKRVIDELKSLLDRIRTEELKRLVEKLIKEVEDVLEESRKAVEDVIREDKRRMEESKREADELIREVKKVLDDLRK

SEQ ID NO: 9191 - protein, 184 aa, Artificial Sequence; identical to SEQ ID NO: 9190
  Synthetic

SEQ ID NO: 9192 - protein, 184 aa, Artificial Sequence
  Synthetic
KELEDLEREVREVLKRSDESLKRLEEEVRRVLDENDKEVKRVKEKVKKVLDELREIVTRRKTEDVKRKVKEDVTRLLDELEKELRRSEDHIRRLIERLEKELRKNRERIKELKERLKSLLSRLDKEELKREVERLIREVEEVLKKSEEAVRRLIEEVDRALKRSREEFTKAREEVKKVLEDART

SEQ ID NO: 9193 - protein, 184 aa, Artificial Sequence; identical to SEQ ID NO: 9192
  Synthetic

SEQ ID NO: 9194 - protein, 182 aa, Artificial Sequence
  Synthetic
DEIDKARKDIEDMLRRLRDLVRKLEDLNRKVVEELKDLVRKDRKLNEDIVRRLERLVRERPDVQEDIERLLKEVRKMNKDTLRKIRELLEKIKDLNRRIEEEIKRLLKEARELVRDVEKRIDDEEVKRRIEELLRRVDKVADEVRREVERTNRESEEVVREVEEDVRRSLEEIDKVIKDVRT

SEQ ID NO: 9195 - protein, 182 aa, Artificial Sequence; identical to SEQ ID NO: 9194
  Synthetic

SEQ ID NO: 9196 - protein, 182 aa, Artificial Sequence
  Synthetic
SEIDELRKRVEEVLRRLDELVKRLKEENDRVVKKAEDLIRRLEETNREILKKLRKLVKDDKDNQEAIDKLAKDAHKTNRDILREIRELLKRIHEKNREMVERIRKLLRDVERMLRKVEKEIDDRDVLEKIKDLLRRVKEVADEVEKKIRELNKKTEDVVRELEERVRKLDEDVKRVIEEVKR

SEQ ID NO: 9197 - protein, 182 aa, Artificial Sequence; identical to SEQ ID NO: 9196
  Synthetic

SEQ ID NO: 9198 - protein, 182 aa, Artificial Sequence
  Synthetic
SELDEIRERIERIEKDLERLVEEVKRVNDTIVERIKKLIDEVRKENEKVIKTLRDLVREVPELKEKIRELLKRAHEVNRRVEKTIEDLLREVEKVNDEIRREIEKLLETATRLLDEIRRRIDDEKVEREIRRLLERVKEVIERVKDRVRRVDKKSRDVVREARRAIEEVDRRVRKVVREAEK

SEQ ID NO: 9199 - protein, 182 aa, Artificial Sequence; identical to SEQ ID NO: 9198
  Synthetic

SEQ ID NO: 9200 - protein, 182 aa, Artificial Sequence
  Synthetic
DEIKKLEDEVKKILDDLRELIRKLEETNRDVERRLRELIAELRKRNDEVVKRLRDLVRRSKDSKEEIDRLAEEIKKENEDILRKIEKLLEEARETNERILRRIDELLKEAKRLIDDVLRKIDDEDVKRKIEEILRRVEEEIRRLKKEVERLDRESKRVIRELREDVKRTNTDVKRVVDEVRK

SEQ ID NO: 9201 - protein, 182 aa, Artificial Sequence; identical to SEQ ID NO: 9200
  Synthetic

SEQ ID NO: 9202 - protein, 181 aa, Artificial Sequence
  Synthetic
SLVERLEERVKRIIDELRRILEENRRRVKKVSDENRDLLRRLEEENKKIIEDLRDLKRKGRDRKEVKRLVDRVRKTNERVLETVDRTATRLREKSKESLERLRKTVREVVEEIRDVMRKVDDEKAKDKLRRLEEEIRKVAKEVEDELRRSTEYVKKSLEDAKRKLEELTKRTEDVAEEVER

SEQ ID NO: 9203 - protein, 181 aa, Artificial Sequence; identical to SEQ ID NO: 9202
  Synthetic

SEQ ID NO: 9204 - protein, 181 aa, Artificial Sequence
  Synthetic
DLVERVEEKVEDIKRKLRRILEEVDRRNKEVSKENKELLDRLEEENERIIRELEKAKRDGTDRRKLKELIDRLRRINEDVRRKVDRTVKELKKINKKILEELEELVRRVKEEIKRVMDEVQDDRAREKLKRLVEDIDRVAEEVKRTLEELSRYTDKSLEDAERSLERLTKETDEVLKRVTT

SEQ ID NO: 9205 - protein, 181 aa, Artificial Sequence; identical to SEQ ID NO: 9204
  Synthetic

SEQ ID NO: 9206 - protein, 178 aa, Artificial Sequence
  Synthetic
SIVERLKKLAEDVIRRLERLSKELAKRNKEVIERLKELSKRLEDKNRRVIEELRRTKDEEEIKRLLEEARRTNKKVLDDSKKLLDEVRETNRTVAETSKDILREIEEVVKRVLDEVRELEEVKRAIEELRDRIRKVIEDSERTIRKLNDDTRKVVEDSRRTIEELNRTTDKVIEEVRR

SEQ ID NO: 9207 - protein, 178 aa, Artificial Sequence; identical to SEQ ID NO: 9206
  Synthetic

SEQ ID NO: 9208 - protein, 178 aa, Artificial Sequence
  Synthetic
RKVDELRKEVKRVIDELRELSERLRKENERVIKTLEDLVRRLEKLLERVERELERTKGKEEVRKIMKRIEDVARKVLRELEELLRRAEKINKDVLDRSREIAKRARDILKKVLDDVKDLEEVKKEIDRLRRELDRVIKESEDTIRRLNDETRKVIEKVRRAIEELLRRIEEVIKKVEK

SEQ ID NO: 9209 - protein, 178 aa, Artificial Sequence; identical to SEQ ID NO: 9208
  Synthetic

SEQ ID NO: 9210 - protein, 178 aa, Artificial Sequence
  Synthetic
SIVEELRELVKEAIKRLKKLSDDLRRKNEEVIRTLKELLDRLKRKNEEVIKRLEDTKGKEEVDRLMEEAKELNKRVEDTLRELMDRARRTNEEVERRSKELLKEIEKVLRDVLRRVSTLEEVKREIEKLKRDVERVIEDSRRTIEELNRKTEEVIERVRRTIERLNEETKKVIDRVRT

SEQ ID NO: 9211 - protein, 178 aa, Artificial Sequence; identical to SEQ ID NO: 9210
  Synthetic

SEQ ID NO: 9212 - protein, 178 aa, Artificial Sequence
  Synthetic
REVDELRKRVEEVIRELEKLSEDLAERNRRVSERNKELVETLARLNKRVIDELRRTKDKEEVDKLLKEVRELNKRVEEEIDKSLEEARRVNEEVVERSKRILERAEKILEDVLRKVKDLEEVKKAIDDLRRELEEVIKRSKKTIDDLNRYTKKSIEDVREAIKKLNKETDDVAREVKK

SEQ ID NO: 9213 - protein, 178 aa, Artificial Sequence; identical to SEQ ID NO: 9212
  Synthetic

SEQ ID NO: 9214 - protein, 178 aa, Artificial Sequence
  Synthetic
SIVEELKKLVEEAIRKLEKLLEELEEKNRDAIRRLKELSDELRKKNEEVIERLKRTKDKRELERLADEARRTNEEVVRRSDKLLEEIKRTNEKVKRELDELLRRIEKIVKDVLDRVRELEEVKRMIEKLRRDVEKVIREVRDEIRRLNDTTRRVIDKSRKTIEELNRTTEEVIERVKR

SEQ ID NO: 9215 - protein, 178 aa, Artificial Sequence; identical to SEQ ID NO: 9214
  Synthetic

SEQ ID NO: 9216 - protein, 176 aa, Artificial Sequence
  Synthetic
DEEEVMRELKKEIDEALERSKEINDRLRKEIRDVLEKLERIVREVKERSERVLEDVRRKVDSKKLERVEKIIRESEKHVDEARKEIEKRIKELEDRVRENTERVKRIIEELRDRVRKLGGVKEAVDEIRRILREALEEDKKSVEDIRRDLDKIEKDVKKVLEDNERLLKRLREEVK

SEQ ID NO: 9217 - protein, 176 aa, Artificial Sequence; identical to SEQ ID NO: 9216
  Synthetic

SEQ ID NO: 9218 - protein, 176 aa, Artificial Sequence
  Synthetic
DEEEVMKELEDRIREVDKKIEDRLRELKERSDRVLDRSRRINKKLKDEIEDALRRVRRDVDSKDARDVDRIIEELKRRVEENSRRVEEIIRRSRKHVEDLLRRAKEIIKKLEDEVRKLGGIKEAVDTIERKLRKLEEDLKKVERDNKKLLDDMERDDRRSLEEIKRILDELLEKVR

SEQ ID NO: 9219 - protein, 176 aa, Artificial Sequence; identical to SEQ ID NO: 9218
  Synthetic

SEQ ID NO: 9220 - protein, 176 aa, Artificial Sequence
  Synthetic
REEEVMKELDREIEEVLERSREIVERLRREIEEVLKENKKIVETLKREIKKVLREVREKVDSKDARRAEEIIERLERRVEENEKRVKEIIDELRKLVKRALEESEKSIRELKDRVRKLGGSEEAVKRIRDILEKDERDVREVVRRIREILKASLEDSERSVEEIRRILDELRKEVE

SEQ ID NO: 9221 - protein, 176 aa, Artificial Sequence; identical to SEQ ID NO: 9220
  Synthetic

SEQ ID NO: 9222 - protein, 176 aa, Artificial Sequence
  Synthetic
REEEVMERLRREIEKALRESHEIDDRLRKRIEDVLRDSERKLEELRRRIKKVMDDVRRDVDSERLREVEKIIKELEERVDDLRKKSRDSARRLKELVDESNKRSRDIARRLKEEVDRLGGSEEAVRKIREELERMKEENDRVLKEIDKDLKDDDRKIEEVVERIERILRELRERVR

SEQ ID NO: 9223 - protein, 176 aa, Artificial Sequence; identical to SEQ ID NO: 9222
  Synthetic

SEQ ID NO: 9224 - protein, 176 aa, Artificial Sequence
  Synthetic
DEKEVADELERKIDEALKESHEIDKRSDDHDKEVLKKSEKRLRELDEEIKDVLRKLEKKVDSELLKRVRDIITKLEKEVRDLLEESRKSIEDLHKHNRESNKDSRDIIRELRDRVRKLGGSREAVETIERILKRMIERNRAVVETNKKLNKEDEDKIREVVKRIREKLRKADEEVR

SEQ ID NO: 9225 - protein, 176 aa, Artificial Sequence; identical to SEQ ID NO: 9224
  Synthetic

SEQ ID NO: 9226 - protein, 181 aa, Artificial Sequence
  Synthetic
ETEDKVRELLKRIRDVAEKAREKVEELVRRNEEVLKRARETVERLVRKNEEVLREVAERARSRKLDEIRREIEKTIRDHKRIVEEVRKEIKRSIEEHRRKVEKVIRELEEVLKTIERIMRRKERDKKELEDTVRKVLEDLERKLERLEEESREVERRVKKVLDELKRKSEESEKRLEEAAR

SEQ ID NO: 9227 - protein, 181 aa, Artificial Sequence; identical to SEQ ID NO: 9226
  Synthetic

SEQ ID NO: 9228 - protein, 181 aa, Artificial Sequence
  Synthetic
DAEEVVRKLEEELKRLIDKLRKVMEESLKRVKESMDRSRKRIEELVRRLEKILRDLKRDREEIEEVIRELREIIERLKDKIKKDLDTSRRIADENRKDIEDVVRDLERIAEELRRIAARDGREDVLRKLKETVERVRRKVEEVIKKSRESVKRVEETNTRSLRELEETVREVEKRVREESR

SEQ ID NO: 9229 - protein, 181 aa, Artificial Sequence; identical to SEQ ID NO: 9228
  Synthetic

SEQ ID NO: 9230 - protein, 182 aa, Artificial Sequence
  Synthetic
SEVEKLLKDLKELLEEVKRRAEESHRDLRRLLEEVRKRVEDSNRELERELRRAEDLVRRGNKSSDLVEELRKIIEEMEKKHKDLVDELRELIKKVIDDHEKLIRDLERLIRRVEEELERKTRDRKMERVVEEIRREVKKVLEDLRRILKESEDAARKVLRDLERLVKHSKDTAREVLKRLKK

SEQ ID NO: 9231 - protein, 182 aa, Artificial Sequence; identical to SEQ ID NO: 9230
  Synthetic

SEQ ID NO: 9232 - protein, 182 aa, Artificial Sequence
  Synthetic
SEIEKLLRDLERLLEEVKRKAEKTNRDLEKLLEEVKRKVEDSHRKLKKVLDEVKDLVRRGDKSSELVRRLEEIVRRAREEHERLVRELEELIKEVERRHEEIIRELEELIREVDDRMRRTTKDERVKRLVEDVRRRVKEVLDDLRRIIEHSRRRAEKVLRELEKLVRESETKAREVLKDLKK

SEQ ID NO: 9233 - protein, 182 aa, Artificial Sequence; identical to SEQ ID NO: 9232
  Synthetic

SEQ ID NO: 9234 - protein, 176 aa, Artificial Sequence
  Synthetic
SEAERLLEDSKRVLDEIREDLKRLLKESEDVMREIEKTLEKLVRDVERVLDEVRKSRDDKKKVLDELRKILEEVEKRAKDLNEENKRIMDKVRREVEELIKRNEDIMREVEERAKRDNVDERVLRTIKDLHRRLSEEVKRVLDEAEELHRRLSERVREVLEDIRRLVEELIEEVRK

SEQ ID NO: 9235 - protein, 176 aa, Artificial Sequence; identical to SEQ ID NO: 9234
  Synthetic

SEQ ID NO: 9236 - protein, 176 aa, Artificial Sequence
  Synthetic
SEAEDLLRRSKERLDEVRKRLDELRRRSERVVEEIRRLLKELLDDVERVRKEVKEARDDKKKVLEELRRILKRVEDEVRDILRKNEDAAREVAKEVKRIDDDNERILRRVADKARKDKIDDRVLRTIEDTHRRLSEDVKRVLKEAEELHRRVTEEVKDVLRKIRETAERLEEEVKK

SEQ ID NO: 9237 - protein, 176 aa, Artificial Sequence; identical to SEQ ID NO: 9236
  Synthetic

SEQ ID NO: 9238 - protein, 176 aa, Artificial Sequence
  Synthetic
KEAEELLDTSRRVSEEVEKRLEKLLRESERVAEEIRKRLEELLRRVEKVLDELRKARDDKRKVLEEVTRALEDVERRVEEINRENKEEADRVRRDVERIDEENKRAAEEVKERARKRGIDEKVLKTIEDEHRRLSESVERVLRTAKRLHDEVSKEVRDVLEEIRRTVEKIIREVRT

SEQ ID NO: 9239 - protein, 176 aa, Artificial Sequence; identical to SEQ ID NO: 9238
  Synthetic

SEQ ID NO: 9240 - protein, 184 aa, Artificial Sequence
  Synthetic
SVEEVLKTLEDLARESSEEVRRVAEEIERSNRRVVKEVEKVLREIEELNRKILEEVERDLDSKDVDRLRREIERSLDESRKIIEKLRRDIEEVNKKSRKTIKDLEKENRDVVRKVRDIARKEDKMEEVLRELLKEVAKVVEDTRRKLEELLKENEEMDRDLKRKLDELLERNREVLERLKRKVD

SEQ ID NO: 9241 - protein, 184 aa, Artificial Sequence; identical to SEQ ID NO: 9240
  Synthetic

SEQ ID NO: 9242 - protein, 184 aa, Artificial Sequence
  Synthetic
SVEEVLKELEKLVRDSSREIKKVLEEIDKSNTDLLREVEDALRRIEERVKEALESVDRTVRSEDARRLKEELEELLKRVREIIERIKREIERVNERSREIIERLREDNDRVRKEVKKIIDKEDRVREMLERLLDTLRRRLEETRKELERLLTENKKKDDEVKEKLKRAEEELEDVRRRLEEKLR

SEQ ID NO: 9243 - protein, 184 aa, Artificial Sequence; identical to SEQ ID NO: 9242
  Synthetic

SEQ ID NO: 9244 - protein, 185 aa, Artificial Sequence
  Synthetic
SAEEVLRRLKEAIKRLIRDSERVLEEIRRTNEELIKRTEEVLRRVREKAERLIDDVRRRLSDDKRVKEVIDELKEMLERLEKKIREDIEELERNLRRNEKRVRDDIRRLEEMLKELERKISEVRGIDEALRRIEKEVRDVEKRSKETLEDSKRDSERVRKKSEDTLREIETRVEDVRRKAEEEVR

SEQ ID NO: 9245 - protein, 185 aa, Artificial Sequence; identical to SEQ ID NO: 9244
  Synthetic

SEQ ID NO: 9246 - protein, 176 aa, Artificial Sequence
  Synthetic
SESDRIRAIVKKVVDESKESLKRLKEETERVKRELDRVLKENKDKVRRLKEKAEEMKKLEDRKALKKVVDELRDALRESEEHIRKVLEDNERVLRRVEKEVKDDIRRLEKILEDIERELRSDVLREVAERVTRLIRDSERVLEELAREHEKASRKVKKVLDESKKIVDDVIRRVDR

SEQ ID NO: 9247 - protein, 176 aa, Artificial Sequence; identical to SEQ ID NO: 9246
  Synthetic

SEQ ID NO: 9248 - protein, 176 aa, Artificial Sequence
  Synthetic
SESEEIERTVEDVKRKSDKSLEESRRNVERLKEESEESLERNKDLVRRVAEKVEEVKRDSREEALRKVVRELEEALKRSEDHVRTDIKRLKDNLDRNRKKIEDDIDRLRRILEDIERRIRSEAADRVREEVTKVIKKSEDVLRDSERLHREVIKTSRDVLDKSRRLVEEIIRRVRR

SEQ ID NO: 9249 - protein, 176 aa, Artificial Sequence; identical to SEQ ID NO: 9248
  Synthetic

SEQ ID NO: 9250 - protein, 181 aa, Artificial Sequence
  Synthetic
SDVERVLREVEEIIRKARDRSREWLERVKKIIEKVKEDSKRWLDEVRKLIRDVEDIRRRGKADDKTVEKITREARKRDEEHKREVEKVAKTIEDLNRKHEEEVKDILRRVKELLEDLRRRSDTERVREVIDRIRKLLKDIIDEARDVNKKVRDLLKRIVEEVTEVNKRVKELVEEIVRRIK

SEQ ID NO: 9251 - protein, 181 aa, Artificial Sequence; identical to SEQ ID NO: 9250
  Synthetic

SEQ ID NO: 9252 - protein, 181 aa, Artificial Sequence
  Synthetic
DELREALKRVADIVRTIEEAVRKSLEDSKRIVDDIRRASKEALEEVEKIVRTLVEIVRNGRADEKVVRKIATDAEDLSRKHKEALDRILDELKKLNEENRRALEEILRRVKRLLEELKKDVDRKEVRDVIREVEKLLREVEKIVRDVNRESERLAKEVRDDATEVNERVKELLKRAEAAVR

SEQ ID NO: 9253 - protein, 181 aa, Artificial Sequence; identical to SEQ ID NO: 9252
  Synthetic

SEQ ID NO: 9254 - protein, 179 aa, Artificial Sequence
  Synthetic
SVVEELRRTVKELLDEIKRRDDRLLKEVEEVAREVERKDDELRKKVEEILRRIKELRDRGRVDKRDIDRIVEELRRISEEHKKEVERLKDDIRRRSREHEKEVRRLLEEAKEVLKRAKEENRVDDRVLKELKELMDEAKKNSERVNKKVEDLLRRLDESSRRVNEEIEKRLTELLKAVE

SEQ ID NO: 9255 - protein, 179 aa, Artificial Sequence; identical to SEQ ID NO: 9254
  Synthetic

SEQ ID NO: 9256 - protein, 179 aa, Artificial Sequence
  Synthetic
SVVEELLKRVRERLEDVDRVLRTWLEEVERLAEEVKRLDRELEKDVKRILDTIEELKRQGRVREEDIKRILTEAEKRSREHEKRVRDLLERLKREDDRVNEELKRLLEELKDELRKAKEENNVDDKALEDIKRLLEELRKRVEDVSRRVNKLLRDLEENSKRVNDELRKRVETLVERVR

SEQ ID NO: 9257 - protein, 179 aa, Artificial Sequence; identical to SEQ ID NO: 9256
  Synthetic

SEQ ID NO: 9258 - protein, 175 aa, Artificial Sequence
  Synthetic
REIEKVLKELRDIVRELEKLLEDVVRKIRKIVEETRKLLEDVVRESDKIHRDAKELMERAGVDERLVRRLDKHAKDHKKDVEDIIRENEENLKKLDKEVRDIIRELRELLKELEKANIREDELRKRIAELAERVKRMVKKLDEHAKRDFRRVEEEVRRLRENVKRVKDEVDEAVR

SEQ ID NO: 9259 - protein, 175 aa, Artificial Sequence; identical to SEQ ID NO: 9258
  Synthetic

SEQ ID NO: 9260 - protein, 175 aa, Artificial Sequence
  Synthetic
SEIEKVLEELRRRVEELEERLKTVVDELKKIARRTEEKLDKVREEIERIYREAKDLLRRAGVDERLLKRLDEDLKRLEKKVRDVKKENRDNLKRLEDRIREIIEELRRRAKRLEEANVRSDELRKAIAELERRVDKMLKELRDHITRDEDRVRRILEELRRHVERSLKRVREEVN

SEQ ID NO: 9261 - protein, 175 aa, Artificial Sequence; identical to SEQ ID NO: 9260
  Synthetic

SEQ ID NO: 9262 - protein, 181 aa, Artificial Sequence
  Synthetic
SELEKVLEDVERRLRELKERNDRVLEEITKIHEDAKRENDEVLKEISRAHKEATEELERKIGDKKRLEELKKELEKHNKEIEDSVRELKKKLRKHNEDLRKSVEEMKEELERALKEVREVIRDSSLEELRRKLKELEERSERHLEELRRSAETVLRESREHLRRLEDSLRRVRKKVKEETD

SEQ ID NO: 9263 - protein, 181 aa, Artificial Sequence; identical to SEQ ID NO: 9262
  Synthetic

SEQ ID NO: 9264 - protein, 181 aa, Artificial Sequence
  Synthetic
SEIETVLRDVKDKLEKLKRDNDKVLDEITKIHEEAMRRNDKVLEDIRRALEELKKRLEEKIGDKEELKELKKELDDALRRLKESVDKVKKELRDHNKTLEESVRRVKEKLDRVLEEVRKVAETARLEELKKELKKLEDESRKHLEELRRSLEEVTRRSDKHLKELKDRLEELRRKVEAATD

SEQ ID NO: 9265 - protein, 181 aa, Artificial Sequence; identical to SEQ ID NO: 9264
  Synthetic

SEQ ID NO: 9266 - protein, 181 aa, Artificial Sequence
  Synthetic
SELEKVLEEIRRELEKLERANKKVLDDAKRIHDKAKEDLRRVLEEIKRRLEELEKRLEEAIGDDKRLEELRKKLRKVLEELEKRARDVERELDEHNDRLRDSVRRMKRRLEEALKRIARVIETSRVEELRKELEDLRRESEEHLERLRDSARRVLEKVRRILKELRDRLRELAEEVKRATD

SEQ ID NO: 9267 - protein, 181 aa, Artificial Sequence; identical to SEQ ID NO: 9266
  Synthetic

SEQ ID NO: 9268 - protein, 181 aa, Artificial Sequence
  Synthetic
DELETVLKRVEDLLRRLAEELRRVLEEARETLERLKAANEKVLEEITRTHEEAKRRLDRDIGDKKELEELKKKLDRHNEEIRRSVEEVKKRNEEMLDTIRRKVETVKRKLDEALKRVAELIKTSRVEELDKEAKDLVKEVDEILKRIREELKKLKEDNDKHLEELKESLKRVKDEVDEARR

SEQ ID NO: 9269 - protein, 181 aa, Artificial Sequence; identical to SEQ ID NO: 9268
  Synthetic

SEQ ID NO: 9270 - protein, 181 aa, Artificial Sequence
  Synthetic
SELEDVLRDAERIIREAKEDNERVLRRLKETVEKLIKDNDEVLKKLTESHKKLTKELKDAIGDKKRLEELKKKLDEHNRRLKESVERVKRKNKKVLDELRRSVEEAKKENDRALDRLRRAIETSRVEELKEEIKDILRRNREHLEELKRRIDELRKENEKHLRDLEESIKEVEKEVRESRR

SEQ ID NO: 9271 - protein, 181 aa, Artificial Sequence; identical to SEQ ID NO: 9270
  Synthetic

SEQ ID NO: 9272 - protein, 181 aa, Artificial Sequence
  Synthetic
SEIETVLEDAERKIRELKKRLEDVLRRLAEIYTRAKELLKRVLDELRKIYEDLKKKLEEKVRDEKRLRELKRKLDEALRRHEKNIRDISKRLDDELRRHEEHIKDIMRKLDEILEELRRLAEKVRVEELKKRLDEVARRVEKVLRENEEEIKESLKEVEKMLRRNRKEIKDSEKEVDDEVK

SEQ ID NO: 9273 - protein, 181 aa, Artificial Sequence; identical to SEQ ID NO: 9272
  Synthetic

SEQ ID NO: 9274 - protein, 181 aa, Artificial Sequence
  Synthetic
DELERVLEDAETKIRDLKRKLKEVLDKLRRIYEELEERLKRVLEEIEEIYRRAAEALRRKVKDEDKLRELVKELKRMLDEHRDNIRRIKEDLRRRLKEHEDDIERAKEELDRILERLRRLIDKVRVEELKRELEEVAKRVEEILRRNEEEIKKSEEKIRKVLRDNREKAKRSLDRVREALK

SEQ ID NO: 9275 - protein, 181 aa, Artificial Sequence; identical to SEQ ID NO: 9274
  Synthetic

SEQ ID NO: 9276 - protein, 181 aa, Artificial Sequence
  Synthetic
DELKKVLDDARETSDRLKKENETVFRELEEIYRRLEKELRRVLRELEEIYRRAEDKLTKSVRDEDKLRDLRRRLKEELDRHRDNARRIVEKLKEMLDRHREDLERIREENDRLLEELERLIDDVDVSELDKRIRELERRNRESVKENRDRLKESADDVKRALDRNREELEESERRVKKAVD

SEQ ID NO: 9277 - protein, 181 aa, Artificial Sequence; identical to SEQ ID NO: 9276
  Synthetic

SEQ ID NO: 9278 - protein, 181 aa, Artificial Sequence
  Synthetic
SELEKALRDAEEIIKKAKKLLKEALDEAEKIYREAAKLLDDALREAEKIYREAADALDKKVKDEKRAREAKEELKRALKEHRDDAKRAKDELRKALEDHRRNIDKARRELDEIAKELRKLIKDADAKELRDRAKEAADRAKRAAEENRKKARESLERAKRAAEDNRKKAEESLKRAEETAR

SEQ ID NO: 9279 - protein, 181 aa, Artificial Sequence; identical to SEQ ID NO: 9278
  Synthetic

SEQ ID NO: 9280 - protein, 181 aa, Artificial Sequence
  Synthetic
SEIEDVLRRAKEISDRLKRENDRVLDELRRSYEDLERELEEVLRKLEETYRRAKEELRKKVRDKDKLKEIMKRLDEELKRHEEDIRRIVEELRERLDRHRRNIDKLKKENDDMLRELEKLVDKVDVSELRERIERLKERNRKSLEKNKRDIARSEEEVRKALERNEDEIRRSEEEVKKALK

SEQ ID NO: 9281 - protein, 181 aa, Artificial Sequence; identical to SEQ ID NO: 9280
  Synthetic

SEQ ID NO: 9282 - protein, 181 aa, Artificial Sequence
  Synthetic
RELEKVLEDIREISERLEKRNRDVLKELEDIYREAKKRLDDVLRKLKETYDRAEEELRRKVRDEKKLRDIVRELRDLLRRHEEDIRRIKKELDDELRRHEEDIERIRRRNEEALRELTKLIDKVDVSELRKDLRKLAEDNRRSLEENKKEITESLKEVEKVLERNKDEIRKSKERVDKALE

SEQ ID NO: 9283 - protein, 181 aa, Artificial Sequence; identical to SEQ ID NO: 9282
  Synthetic

SEQ ID NO: 9284 - protein, 181 aa, Artificial Sequence
  Synthetic
SELERVLDEMRKIIERLEEELRKVLEDLRRIYEELKRKLDDSLRESERRVRELKEELDRKVRDKDKLREVKERIDDALRRSRKRIEDIKRKLDDALRRHAEDIERIIKELRDILEELRKLIDKVRVEELKDTIDKVKKRVEDALEKNRRDIDESRKEVDDELRKDEEKAERLAREVEKAKE

SEQ ID NO: 9285 - protein, 181 aa, Artificial Sequence; identical to SEQ ID NO: 9284
  Synthetic

SEQ ID NO: 9286 - protein, 178 aa, Artificial Sequence
  Synthetic
SSDETVKEKVKKVARDVDRHVEKLRKALEEMEREVREHVKRLEDELRRMDEEVKRVREEPVDEERLKRITDRLREELRKLHEDSKDTIRKLREKLEKLKKETEDTKRRLRKKLEDLRREKGADEKVLRDAERIVRELERKLDKVDTEIAETVKRLEDTIRDVNRKIKDRVDKLRKELE

SEQ ID NO: 9287 - protein, 178 aa, Artificial Sequence; identical to SEQ ID NO: 9286
  Synthetic

SEQ ID NO: 9288 - protein, 178 aa, Artificial Sequence
  Synthetic
DSDEKVKRVLEELRKEVKEHVERLRARAEDMSREVKDHVRKLKEDLERMERDVERVKRKPTDEKTLKEIADRLRKILEDLERETEETKKRLEEKLRKLHKETEESKKRLEDKVDTIRKEKGASEEVLERVRTEVERLKRELDKVNEDIRKRVEELKKELDEVDDEIRKEVDRLEEALK

SEQ ID NO: 9289 - protein, 178 aa, Artificial Sequence; identical to SEQ ID NO: 9288
  Synthetic

SEQ ID NO: 9290 - protein, 178 aa, Artificial Sequence
  Synthetic
SSDEEVKKKLEEVKEEVKRHVERLKRALEKADRDVKDHVRRLKEVLKRMADEVEKVRREPVDEDRLEKVVRDLERKAEKLKRETEETAKRLRDILKELKDRTEKTKKRLRDKVREIRKEKGADEKVLKDVEEKIRRLEKELDEVNEDIERKVRELEKELRAVDEEIKRIVDRLRKELE

SEQ ID NO: 9291 - protein, 178 aa, Artificial Sequence; identical to SEQ ID NO: 9290
  Synthetic

SEQ ID NO: 9292 - protein, 178 aa, Artificial Sequence
  Synthetic
SSSERVKTELDRMRKEVKRHVEELEKELKRLTEKVKRHVEESKKNAEEITRKVEDVRRKPTSEEDLKRIIEDLRRNLKENRDRTERTKEDLRREVERLKKETEDTKRELERKLKRLREEKGASEEVLREVTREVTRLREELDEVNKRVEKRLEELERELDRSDEEVTRIVEELVDELR

SEQ ID NO: 9293 - protein, 178 aa, Artificial Sequence; identical to SEQ ID NO: 9292
  Synthetic

SEQ ID NO: 9294 - protein, 178 aa, Artificial Sequence
  Synthetic
SSEEDVRRKLEKMRKEVDEHVRKLEEDLKRLAEEVKRHVEDLERVAKEVADRVEEVRRQPTDKDELRKIVEELRDTLKKLRDRTEESKKRLEKLLRDLKKETEETKKRLRESLRKLEEDKGADKKVLDTARDILRKLEKKLDDVDEKIERIVEKLKRELDEVNKRATETVERLIRELK

SEQ ID NO: 9295 - protein, 178 aa, Artificial Sequence; identical to SEQ ID NO: 9294
  Synthetic

SEQ ID NO: 9296 - protein, 178 aa, Artificial Sequence
  Synthetic
RSDEELEKKLKELKEEVDEHVKRLEETARRLDKEVRRHVEESKRNLEEMDREVKEVRRRPTSEDELREIVKKLEDNLRRNRERTERSKERLERELDRLRRETEETKKRLRDKVKEIRDEKGADDKLLERAERTVRELERRLDEVNDRIRRIVEELKRKLDRSNEEVTRKVRELSKELE

SEQ ID NO: 9297 - protein, 178 aa, Artificial Sequence; identical to SEQ ID NO: 9296
  Synthetic

SEQ ID NO: 9298 - protein, 178 aa, Artificial Sequence
  Synthetic
DELERVVEEVRKRIERLKEELRRVHERSREIVDRLRKELEKSLEEVRRIVEDLKRKLRERGVPEEMLTRLERKLEEDEKRVKDIIRELERKLEEIAKTDKEIIDRLDEKLRELEERLKRGLREEDLERMADKLRKDVERAVRKNETDADKLRREVEEVVRRNKKTAKELEDEVRKELT

SEQ ID NO: 9299 - protein, 178 aa, Artificial Sequence; identical to SEQ ID NO: 9298
  Synthetic

SEQ ID NO: 9300 - protein, 178 aa, Artificial Sequence
  Synthetic
SEREKVAKEATDIVEELKKTLKDVHRRSKEIVERLVKKLADVNKDSRDKAEELKKRLDDRGVDKRVKKELEDRLRKLHRDDERIIKRLRDELKRIEKEDRDIIRRLDKELKDLARLLDKGLREEDVKRIAKKLEEDVRRVVRKNEEEIKKLAEEVDRVVEDNKRLVEELKRRVDEALK

SEQ ID NO: 9301 - protein, 178 aa, Artificial Sequence; identical to SEQ ID NO: 9300
  Synthetic

SEQ ID NO: 9302 - protein, 181 aa, Artificial Sequence
  Synthetic
DADDELRKIVEEADRRSKESVREIEELLRKLEREVEDIVRRIKKLSDDTRKRIDDLRKEGKTEELKKRVEKELRDNKEELKKILEEVRDRARRAREVLKEMEDRSREVVERIRKVLEDLRRKGVVSEEVLKRVEEIIKRLEEENRKVLEELERSVRKLEEDIRKVLEDNDRVVKELARRID

SEQ ID NO: 9303 - protein, 181 aa, Artificial Sequence; identical to SEQ ID NO: 9302
  Synthetic

SEQ ID NO: 9304 - protein, 181 aa, Artificial Sequence
  Synthetic
SAVEKLEELVERVARRIDELVKKIKELLDDVERKSEKTVRDLERLSEETKRSIDDLRREGKTEELLERVRREAKKNREKVKRVEERSRDLVRRVREMLKKIKREVDELLREAEESLKELKDRGVVSEEVLKRVRETLERLERKIKKVLDELKKRVEELRKKNEDVVRRNEEVVKKLVEDIR

SEQ ID NO: 9305 - protein, 181 aa, Artificial Sequence; identical to SEQ ID NO: 9304
  Synthetic

SEQ ID NO: 9306 - protein, 184 aa, Artificial Sequence
  Synthetic
SVEDVIRDLRRVITESRELSERVLERIEETTRRSKEESKRVADKVKKSSDDLREAVERIRTPEEEKDRLEKELRKLVEENRKSLEESKRDLDDLLRRNRKTVEESRRELDELRDRVEKVLKRGVSDEKAKELLRRVKEVVDRNKEKLDRDLERNKRRIDENRRKLEEDLRRNRKVVEELRKRLE

SEQ ID NO: 9307 - protein, 184 aa, Artificial Sequence; identical to SEQ ID NO: 9306
  Synthetic

SEQ ID NO: 9308 - protein, 184 aa, Artificial Sequence
  Synthetic
SVEDVAREIREVLRRLEESVRKVAEDNRRNNEELRRLVEEVLKRIRDSSDRLRKVVEDIDVPEEKKKELDKRLKKLIEDNEDSIRRLREKIERSIRENEERLKRITDRLRKLRKEVEDVLRRGVSDEVLERLLRRVREAVKELEDELERSSREDNRRSRELEEELKKDLKRNEDEIRDVERALK

SEQ ID NO: 9309 - protein, 184 aa, Artificial Sequence; identical to SEQ ID NO: 9308
  Synthetic

SEQ ID NO: 9310 - protein, 184 aa, Artificial Sequence
  Synthetic
SVEEVLRRAEEILTRSKEESRRVFEEIRETTERSKEVSKDVARRNKEILDDLKRKIEEVDVPKKDLERLEKRLRELEEHLERFLRESKRELDELLRKNEDTLRKSKRKLDELRKEVKEMADRGVSDDVLRRLLEKIEEVVRDNERELKEDLDRNRKVIEENRKKLEDHLRRTEEEVDDIRRKLK

SEQ ID NO: 9311 - protein, 184 aa, Artificial Sequence; identical to SEQ ID NO: 9310
  Synthetic

SEQ ID NO: 9312 - protein, 184 aa, Artificial Sequence
  Synthetic
KVEEVSKKLKDVLRELEELVERVLERNRENNERLRDKVRKVLEENKEVLDRLKKEVDDIDVEERKLRKIKRELEELERHLRETARRLEKKIRDSIEKNERDAERLRRDLKRLDEELKEVEARGVDEEDLRRLLEKIKREIDRLAKELEDSSRDDNRISRELDEELKRHLEETRRAVREISEKLR

SEQ ID NO: 9313 - protein, 184 aa, Artificial Sequence; identical to SEQ ID NO: 9312
  Synthetic

SEQ ID NO: 9314 - protein, 172 aa, Artificial Sequence
  Synthetic
SRAEEVLKKVEEEVKKLEDELRRSSERNNRESRRLEDELKKVLDKNRKLVEDLRRARLDEEDVRRTLEESEEENREIDKRARDELRKMEEENKDVLRKAREKLERIRKEIEEANLPKEVVDELRRVLERLRRVIEDVIRRNKEDTDRLEREIERVRKELKDINKKLEEDVRR

SEQ ID NO: 9315 - protein, 172 aa, Artificial Sequence; identical to SEQ ID NO: 9314
  Synthetic

SEQ ID NO: 9316 - protein, 179 aa, Artificial Sequence
  Synthetic
DEAETLLRDVERKVEELKRRSEKLLRDVEELVRRLLRSNEESLKKVKEDLKRLKDLVRRGDVDEETVKEVKKRLKEILDEDKKELREVIERAKEISKRHKEEVEKAVEDLKRILEDMARKGVRDEVLREVDRVIDDVRRALKKVNEEIEEVIRRLKRESERVNKEAEEIIRTLEDALRK

SEQ ID NO: 9317 - protein, 179 aa, Artificial Sequence; identical to SEQ ID NO: 9316
  Synthetic

SEQ ID NO: 9318 - protein, 172 aa, Artificial Sequence
  Synthetic
DDLERVLEEIRREIERIRRELEESNEENKDIVRRIEEELKELLKDNKRIVETVTKANLDRDDVRRVLEESKRKNRRVLERLERLIRESERRNKELLDRAREKIDRLRKRLEEANLDREVLERLEKELDRLRKDIERVADENRKINDTLRKRIEEVMARLDEINTDLKDRVET

SEQ ID NO: 9319 - protein, 172 aa, Artificial Sequence; identical to SEQ ID NO: 9318
  Synthetic

SEQ ID NO: 9320 - protein, 177 aa, Artificial Sequence
  Synthetic
SSDEVLKEIEEIIRRLEEEVRRVNKEVNKSTEDLRREVEEVLRRTNELIEELERRVTRTEELKRVIDELRDRDRKVRRRVERVIEESKKRDDESRKRLTRAVEKLRKDLKKLADDNVPEEALRKAIKDVRDIVKKVKDELKEWRDRNKELVDRLSEELKEWLKDVERVLKELTDKDR

SEQ ID NO: 9321 - protein, 177 aa, Artificial Sequence; identical to SEQ ID NO: 9320
  Synthetic

SEQ ID NO: 9322 - protein, 177 aa, Artificial Sequence
  Synthetic
SLEEVLERIKRIIDELKREAKRVLDETNTLIREVKKRLEDVNRDVNRLIEELRERVTDTEELKRVIERLRREDEKSKREIEREVETLKKRDDEVRKKLDDVAKKLRDDLKEAAERNVPEDMVRDLERRIREVVKRLKEDLERWKKEVEDEIKRLEDRLKEWLDRVREMLEKLREEDR

SEQ ID NO: 9323 - protein, 177 aa, Artificial Sequence; identical to SEQ ID NO: 9322
  Synthetic

SEQ ID NO: 9324 - protein, 177 aa, Artificial Sequence
  Synthetic
SSEEVLKTIKDIIDELRKEAEEVLRRTNESTKELEERAEEVNKRVNDSTRELAKKVTDTEELKRIIEESKKKDEDSRREVKKVLDESRKRDEEVRRSLKKIIEDLEKELRDLARKNVPEEMLDEVKKRAEKVVEDLRRELRKWLEDNKRLVEKLEKELRDWLKENKELVKELEDRDR

SEQ ID NO: 9325 - protein, 177 aa, Artificial Sequence; identical to SEQ ID NO: 9324
  Synthetic

SEQ ID NO: 9326 - protein, 177 aa, Artificial Sequence
  Synthetic
SSEEVLDTLRKLIEDLRRRAEEVLERTNRSTDELRKRVEKVLEETNRLIKKVEDDITRTEEAKTIIDKLREDDERVKRRIERVLEESKRKDEEVRKRVKDVLDRLREELKRLREENVPEDMLREALERIKEIIDRLERELEEWIKTNEDLVRRLTEDLERWLRTVAEILKRLKDEDD

SEQ ID NO: 9327 - protein, 177 aa, Artificial Sequence; identical to SEQ ID NO: 9326
  Synthetic

SEQ ID NO: 9328 - protein, 181 aa, Artificial Sequence
  Synthetic
DELERVEEEIKKLSDDSRRVIEEVRRRLEESNKDLERRLREVEKRLKELTDDIKRTAERNNVDKTLEKKLRELNERNRKSKEDLKRRSDETRERNDETIRESRKENDELERRVEEASRRGLDRELLRKLLDDVRRVVERNKRKLRKDLEDNKREIERVKREADKDLEDHERVIRKLKEDIR

SEQ ID NO: 9329 - protein, 181 aa, Artificial Sequence; identical to SEQ ID NO: 9328
  Synthetic

SEQ ID NO: 9330 - protein, 181 aa, Artificial Sequence
  Synthetic
DELERVVEEIRELSRDSERAIEEVRRELKRTNDENRESAKRVAEELKKLTDKIKEEADRNNVREDLDRELRRLNEDNKRSIRENEERLKKTKRENERTIEESKKRNKELEDEVEKAIKDGLDRELLRELLKEVRRVVEENKRRLEEDLKKNRKKIDDSNKELRKDLEDHRRVIEKLEREIR

SEQ ID NO: 9331 - protein, 181 aa, Artificial Sequence; identical to SEQ ID NO: 9330
  Synthetic

SEQ ID NO: 9332 - protein, 175 aa, Artificial Sequence
  Synthetic
DELEKVKEDIKRLLDDVRREVEKVNRDSRRLLEDLRRVVKEVSDRSKELAEDLERKVGRDEDVERVKRELEKLNRELERILEEAAREVKRLNKEHDDKLKKAEDDVRKLLEELERDNLPVEDVLREVKRLAEEVKKETKRVLDEIKKLVEDVARELERILEDSERLIREVEKRAT

SEQ ID NO: 9333 - protein, 175 aa, Artificial Sequence; identical to SEQ ID NO: 9332
  Synthetic

SEQ ID NO: 9334 - protein, 175 aa, Artificial Sequence
  Synthetic
DEIEDVLRRAKKLLDDLRRVVKKANDDSRRLLKKLKDKVEEVSRRSRRLAEDLERTVGRDEDVERVARELERLNRKLEDELRRVATEVRDLNDKHRRLLEKAEREVKRLIDELRERKLPVEDVLREVRKIIEDVKRASEKILEESRKLIEDVERRLEEILKRSEDLIRTVKERKR

SEQ ID NO: 9335 - protein, 175 aa, Artificial Sequence; identical to SEQ ID NO: 9334
  Synthetic

SEQ ID NO: 9336 - protein, 185 aa, Artificial Sequence
  Synthetic
DELERVLEEIKRLLDDVHRESKRVNEESERLVKKLHDDSRRVLTEIKKLLDDVRRVVEELPKTDELRRKLEEAERRIRELLEELKRRDKELEERAKRLNEKTKEDDKDAARKVEDLLRRLKDENGTREKVEEILRRVRELVKKWKTELERALEENEREVERWKRDLDRILEEVRRVVERVEREIR

SEQ ID NO: 9337 - protein, 185 aa, Artificial Sequence; identical to SEQ ID NO: 9336
  Synthetic

SEQ ID NO: 9338 - protein, 180 aa, Artificial Sequence
  Synthetic
DELEKLLEDIRRELKRVREDDKRHNDKVKETLDRVRELIKRLLELIKKVADEIRSLKRRVPREEIRKRLKELEKRLEDLRRTIDKLLKDLEDTSRRWNEESKKRLEELRRRLEKAERDVPRTREVEEVKRRIEEILKEAEETNRRSHEKAKRVLEELKDIVRKVLEELRRLLRELEEEVR

SEQ ID NO: 9339 - protein, 180 aa, Artificial Sequence; identical to SEQ ID NO: 9338
  Synthetic

SEQ ID NO: 9340 - protein, 180 aa, Artificial Sequence
  Synthetic
EELERLREEIKKILDEARERDETLLREIRREHEKNKRADEEHNRRVEETLERIERLAERVPREEIKKRLEELKRRSEKWNRDSERSLDEIRRRLKKWNDESRERLERAKRRLEKARRDVPDTEEVRAVERELRKILDEIRKTNKEVHDRIRELLERSKRSNDESHKKVEDVLRELKKRVD

SEQ ID NO: 9341 - protein, 180 aa, Artificial Sequence; identical to SEQ ID NO: 9340
  Synthetic

SEQ ID NO: 9342 - protein, 181 aa, Artificial Sequence
  Synthetic
SETDEVRKELRKLLEDSRRAVEEVKKKLDDSNKEVRDRVRRIREELKKLEKEVREIKRKNSDEKELADVVRRIREKAKELKKELRKILEDLDKKYKDLKKENKDILDDLDRRAEELKDRLRKNNVEEELLKELEEVLKRLRELHKRTIDEVEKSAREVKDEIRRLEEELDRVLKKLEDALR

SEQ ID NO: 9343 - protein, 181 aa, Artificial Sequence; identical to SEQ ID NO: 9342
  Synthetic

SEQ ID NO: 9344 - protein, 181 aa, Artificial Sequence
  Synthetic
SLDEDVERLIKELKDEARKLNEEMKEYVRDSERKVRRLNEEIRRLIEELKRKAEELKRGNLRRDDLKRRLDELREEVKEIKRRIEKVSEDLKKENDEAKRRLEEVSEELKKKVEEIKEELERRNVDDRVKERLERVLDEAEKSNEETLRELDDVSRRIEESNRRTLAELEKVLRDIEKDVT

SEQ ID NO: 9345 - protein, 181 aa, Artificial Sequence; identical to SEQ ID NO: 9344
  Synthetic

SEQ ID NO: 9346 - protein, 173 aa, Artificial Sequence
  Synthetic
SELEKLVEDLRRAAKESHERNEKLLDESRKTVEDVKRKLEEILRRSEEVVREIKKKKKDIDKEKVKRDLDELHKRTRDLLEKLKRELDELHKRSKEELEDNKRRLEELLEKVERDGADEEVRRRVEKLIEENRRSSRRVEEEDKRLLKELKDAIKRVEEEDKKLVEELRRSEK

SEQ ID NO: 9347 - protein, 173 aa, Artificial Sequence; identical to SEQ ID NO: 9346
  Synthetic

SEQ ID NO: 9348 - protein, 173 aa, Artificial Sequence
  Synthetic
KEVEDLVKEVKERIEESHKENKRILDKARRVVERVETDLRRILEESKRTVEDIERRKERIDEREVEKRLEELHRETKKLADKLRDELRKLLEDIERELRENEERLRRLLEKVERDGVDEEMKKAVDELIERNKRSSDRVREEAKKLIDRLEEVIEKVERDDEKLVRDLEEELR

SEQ ID NO: 9349 - protein, 173 aa, Artificial Sequence; identical to SEQ ID NO: 9348
  Synthetic

SEQ ID NO: 9350 - protein, 185 aa, Artificial Sequence
  Synthetic
SSLETLEKIARDLLREVKETLDRVREESRRLLEEVRRVAEESRKEVERLLKELEEVIRREVRDEKKVEELKRKLEELKRRVDEEHKKSDKRLKEILEENERTLKEVEDRLRELEKRVEDDLRRGLDDELLRELAERVRRVVKKIKDELRDDLRRTREEVERLKERHKELVKRVKEAVDKIREEIR

SEQ ID NO: 9351 - protein, 185 aa, Artificial Sequence; identical to SEQ ID NO: 9350
  Synthetic

SEQ ID NO: 9352 - protein, 179 aa, Artificial Sequence
  Synthetic
KEVEEILRDVARLVEDNRRVLERILREVEKLIRDNEERLKEILERSKDLVRRIEELIRRGEVDEDTVREIIERSEELNRRLEKHARDSERRLEKLAEDLRRHAKRSLDELKRLLDELEKRRSDVEEVRRAIEELLKDVERAYEEVVRRIEKLLDDLRRKYEEVKKENERLNRRVEEAAR

SEQ ID NO: 9353 - protein, 179 aa, Artificial Sequence; identical to SEQ ID NO: 9352
  Synthetic

SEQ ID NO: 9354 - protein, 179 aa, Artificial Sequence
  Synthetic
DDVEDILRDVERLVEENRRRLEEIVRESEDKVRKNDETLKKILEDVKREVERVERAIERGEVDEETVERIKKKLEELLEELRKHMRKSREESKDLNRRLREHAERSLRTLEELVRDLKRRRSDVKDVVRAIEELLKDVEEKYRRVSERNKELNKRVEDTYREVMKEIRRLLERVDRRAR

SEQ ID NO: 9355 - protein, 179 aa, Artificial Sequence; identical to SEQ ID NO: 9354
  Synthetic

SEQ ID NO: 9356 - protein, 175 aa, Artificial Sequence
  Synthetic
TEVERLVERVKEIVEEHRKKLEELARRSEELVERHEKKLRDLLRESRELVERAKKENSKDRTVLKELRDLVRELNKRSKELSEETRRRVAKTNDDSRKTSKRTREEIERLLRELERDDARDEIKERLKELLREAEEVSRRVNKRNEDLLRRLEKVSREVNERNEDLLEELDRTVN

SEQ ID NO: 9357 - protein, 175 aa, Artificial Sequence; identical to SEQ ID NO: 9356
  Synthetic

SEQ ID NO: 9358 - protein, 175 aa, Artificial Sequence
  Synthetic
DEVERLVEEVEKLVEEWIRDLERILDESRRTVEEWKKELKRLLDRSKRLVEDAKRKNSKDERVLRELDERVRRINEESKRRNDEAKKESERSLREIEKRNKEVADRVRDILEELRRKDAKKDIERRLERLMEELHRVSKEVLDADRELLKELHDVSREVNKRNEELLDELRKTVT

SEQ ID NO: 9359 - protein, 175 aa, Artificial Sequence; identical to SEQ ID NO: 9358
  Synthetic

SEQ ID NO: 9360 - protein, 175 aa, Artificial Sequence
  Synthetic
DEVEETVKRVREEVERWKEELKRIADEVRRLVEKVKDDLRRLLDESRKLVEEVRRENSRDDTVLKRVRDEVRKINEDSKRLLEEAKRRVEKIRREIKKRNDELEERARRILRELDRRDAKSEIKRRLEELLKELHKVSKDLDKILEELLREVEEVVRRVNETNKKLLKELDETVR

SEQ ID NO: 9361 - protein, 175 aa, Artificial Sequence; identical to SEQ ID NO: 9360
  Synthetic

SEQ ID NO: 9362 - protein, 175 aa, Artificial Sequence
  Synthetic
SEVEELVKRAAELADEARKRLERIMEEVKRLVDEWEKELKKLLDESKELVEKVRRENSKDERVLREVKKKIEEINKRSREENKKVAEKVREIEERIERLLEELKELIKRIEDKARREDLKEKVREDLRRLLDTLRKVVEELKRRLRELLKKLHDVSRKVNEENERLLRELEETVR

SEQ ID NO: 9363 - protein, 175 aa, Artificial Sequence; identical to SEQ ID NO: 9362
  Synthetic

SEQ ID NO: 9364 - protein, 175 aa, Artificial Sequence
  Synthetic
DEAEKLVDEVRELVRRHKETLKEILERVKELVKRWKDTLDKLLRDSEELVRRVKEENSKDERVLRKARKEVRDINEESKERNKELEKRMRRLEREIERVDRETEERIRRILDDARRKDLRDRVKEELKRLLKELKEMSKRLTEELRRLLKELHDRSREVNERNKRLLEEVDRTVK

SEQ ID NO: 9365 - protein, 175 aa, Artificial Sequence; identical to SEQ ID NO: 9364
  Synthetic

SEQ ID NO: 9366 - protein, 181 aa, Artificial Sequence
  Synthetic
DEIREVEERNRRSNEEMKKAVREVEKDIERVAREIRKRAEEVSKRNEDINREIRKTLRDKKKLTDILRESKELNRKLEELVKRIKDELDKLLEDLRREVRKIEEESKRTNEDLKKKAKDGTSDETLRRVIRKSEELLKRLKDRLDEVRKRVEEILKRAEERLREVIKRSEELLEEVKRESD

SEQ ID NO: 9367 - protein, 181 aa, Artificial Sequence; identical to SEQ ID NO: 9366
  Synthetic

SEQ ID NO: 9368 - protein, 177 aa, Artificial Sequence
  Synthetic
SLLEEVEKTLRKIVEDSDREIKRVSKKNKETVKRLEELMREVNRRSTEIVKRIRDSDLRTEELKRLEEEARKLNDESREILERVTRESERLDRELKKHADESRERAKDLIRRLKKLGDKEMLDRIIEEAKRLHEENKRKLEEVERRSEELLKELKRRLEELIKRNDDLLREVEERKR

SEQ ID NO: 9369 - protein, 177 aa, Artificial Sequence; identical to SEQ ID NO: 9368
  Synthetic

SEQ ID NO: 9370 - protein, 181 aa, Artificial Sequence
  Synthetic
DEVEEVIRRAEELVKEVKKRLEELIRESEALLERVKRRLERLIEESRRRLEEVKKKVSSGLDEKTLKEVLDRLRRDVERINEESKRVLDEVEKEIRRTNKKIKEILDRIRKKVEDLEKELRDRGAKDEIKKRLRKLLEEIKKVVDDVRETNKRTLERLEELARRVNEENKKILDDLEEAVR

SEQ ID NO: 9371 - protein, 181 aa, Artificial Sequence; identical to SEQ ID NO: 9370
  Synthetic

SEQ ID NO: 9372 - protein, 181 aa, Artificial Sequence
  Synthetic
KEVDEVVKRAEDLLREVKKRLDEVIEDSERLLREVRKRLEEIIRESEKLLEDVRKVVERGLREDELKKLLDDIRKKIRETDEKLKKTLEDLRRAADEINRRTEDILRRIEEKVKRLRDELRTRGAKKEIEKRLEEILREIKKLVEEVNRRNEDILRRLEREVEKVRRVNEKTLERIEETVR

SEQ ID NO: 9373 - protein, 181 aa, Artificial Sequence; identical to SEQ ID NO: 9372
  Synthetic

SEQ ID NO: 9374 - protein, 185 aa, Artificial Sequence
  Synthetic
SLVEDIRRDVKRILKEIDKLVKDIEEENRRASRESERLVETIRREVKEVLDRIRKLVRDVPLDEKTLRRIEERIERLRDSIEKMERRMEELNKEHERRVEKILREIEKLLRELDKELEDVAKEPGDRKLIEEIRRRLKKALEDIRRLIEESRKRVEESLTRSRKLAEDIRRELEDVLRKVDEDAK

SEQ ID NO: 9375 - protein, 185 aa, Artificial Sequence; identical to SEQ ID NO: 9374
  Synthetic

SEQ ID NO: 9376 - protein, 177 aa, Artificial Sequence
  Synthetic
SRVKEVADRVRDIVRRIKDEIKEHVDRLRDVIRRIKEKLEEHSRRLREIVERIRASNLDKDEVKDKLDKMKKNAEEVHEDIKRKLEDAKRRTEKTKRDIERKLEKLERDVRRAADTVDEELLKRLEDIIRKLLEDIKRVVKELEEVSRTLLREIEELLEENRKSMEKLLRDIEEEAR

SEQ ID NO: 9377 - protein, 177 aa, Artificial Sequence; identical to SEQ ID NO: 9376
  Synthetic

SEQ ID NO: 9378 - protein, 177 aa, Artificial Sequence
  Synthetic
SKVDEVVKRLEDAVREIKKEIDKHSKELADEVEKIKKELKDVSDRNREVVRRIREANLSEKDVTETVKEAEKRNRDIEKRIREELKRLEDNVRDMHRKLDKKLKELKRTVEEMRRSVDEKKAEELRKRVDDLLEEIRRLLEENKRTVDKLLDEIKRVLEDHRRSVEELLREIDKDAK

SEQ ID NO: 9379 - protein, 177 aa, Artificial Sequence; identical to SEQ ID NO: 9378
  Synthetic

SEQ ID NO: 9380 - protein, 175 aa, Artificial Sequence
  Synthetic
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 9381 - protein, 175 aa, Artificial Sequence; identical to SEQ ID NO: 9380
  Synthetic

SEQ ID NO: 9382 - protein, 175 aa, Artificial Sequence
  Synthetic
SEIEDAVRRIEKRVEEVHRENKKLTDESRKLVREVDEENKKVSRESKKLVEDARRRNADEDIIRELLKELKRRSEEVSKRNEKILKELDDKSKEVAKRNKRVLDEIKRTLKEVLDRRKDARELSEKVREVLEKIKKSLEDHRKANEDLLREIRDSLKKHRDENRRLLKELEETRK

SEQ ID NO: 9383 - protein, 175 aa, Artificial Sequence; identical to SEQ ID NO: 9382
  Synthetic

SEQ ID NO: 9384 - protein, 175 aa, Artificial Sequence
  Synthetic
SDLDRVAKELTEIVERIIRELERLTEKSRDIVRKVHKENEDAVRKIRKIVEEVKRKKIDEDTVREILRRIREELKRLKERNEEILERIKEESERVERTIRKVLEEMKRKLDRVRERRPDARELEKRVRDLLRRVEEALRRHKEENRKLLEDIKRSLEEVAKEVERVLKEIKDTAR

SEQ ID NO: 9385 - protein, 175 aa, Artificial Sequence; identical to SEQ ID NO: 9384
  Synthetic

SEQ ID NO: 9386 - protein, 175 aa, Artificial Sequence
  Synthetic
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 9387 - protein, 175 aa, Artificial Sequence; identical to SEQ ID NO: 9386
  Synthetic

SEQ ID NO: 9388 - protein, 175 aa, Artificial Sequence
  Synthetic
DEAREILKEIRDIADELRKRLERLTERSERIVREVDKENRRVVEEIREIVERVKKAKIDEDTVRKILREIEEKLDRVAKRNEKILKKIEDDSRRVAKEVREILKKIEDILDDARRKRKDVRELKKEVERVLEEIRRLLEEHERANRKLLKEIRDSLRELKKRVEEVLREIKEATK

SEQ ID NO: 9389 - protein, 175 aa, Artificial Sequence; identical to SEQ ID NO: 9388
  Synthetic

SEQ ID NO: 9390 - protein, 175 aa, Artificial Sequence
  Synthetic
SEAEEMLERIKRRVEEVNKENKKMTDESKKIAEDVDRDNREVLREIKRIVDEVRKRNIDEDTVRKIEREIEKTLEDVRRRNDEILKDIRRLSEEASRRNKEILDTIRETLKRVRERRKDVKELEKEVERVLKEIKDSLRRHRKENEDILREIKESLDELDKEVKRVLKEIRDTAR

SEQ ID NO: 9391 - protein, 175 aa, Artificial Sequence; identical to SEQ ID NO: 9390
  Synthetic

SEQ ID NO: 9392 - protein, 175 aa, Artificial Sequence
  Synthetic
SELEEVAKELRKTLEDSTRENKKHTDDVRRIVDEVDKRNRKAVEDIRKIVDEVRKRKIDEDLVREILRRIAEKLRRLREENRRILEEIKKSLRDMERRNEKINRETKEKLDRVKERRKDARELEEIVKRLNERDKEVLEKDAEDVKRVLEEIKESLERVARDVERVLEDIKRATD

SEQ ID NO: 9393 - protein, 175 aa, Artificial Sequence; identical to SEQ ID NO: 9392
  Synthetic

SEQ ID NO: 9394 - protein, 181 aa, Artificial Sequence
  Synthetic
SALEDLERKVEELIRRLDELLREHRETLERLIRELDKLLTDHHRRNRELLERIKDVVRKAGRELEDIREILERLKKLNEESADIVRRVKEELKRILEKSEKEVRELKETLRRTVEEVKRVKDEDKLRKIVEELERLVDEVRRSLEKASKRLKDLVKEVKKRLEDITRESEELVRRVEERTR

SEQ ID NO: 9395 - protein, 181 aa, Artificial Sequence; identical to SEQ ID NO: 9394
  Synthetic

SEQ ID NO: 9396 - protein, 181 aa, Artificial Sequence
  Synthetic
SALEELKKEIKRVIEELKRALERHHKENEELRKRIDEVLKEHHDANRRLLEEIKELVRRAGRDLEEIRRIEEELKELDKESEERVRKIKEELKKLNEDSRKKVEDLKKELEDDLKRVDKVKDEEKLKEIVKEIRKKVEELKDDLRRMSEESRRLVEELEERLRRLTERSKRLVEDVRRRVT

SEQ ID NO: 9397 - protein, 181 aa, Artificial Sequence; identical to SEQ ID NO: 9396
  Synthetic

SEQ ID NO: 9398 - protein, 172 aa, Artificial Sequence
  Synthetic
SEKEELDRKIEDVRKKVEETSRKLKRVNDESKKEVKRTSDELRKKSKEVNEAVEREGVREEILKEITDLSREMEERSEKLNREVDRLVKESRKRSKELNDEAERLLRDLARKKELDVEEAIRRLKETLDRHREEVEDLIRKSREVLKRHEERVRELIKRHEDTLRELKKRAK

SEQ ID NO: 9399 - protein, 172 aa, Artificial Sequence; identical to SEQ ID NO: 9398
  Synthetic

SEQ ID NO: 9400 - protein, 178 aa, Artificial Sequence
  Synthetic
SEVDELMKRLKDEAEDIKEKVERLIREWEEAARKIAERVEKLVRDWERVIETLRDLKKRVDKEELKKRLKDLEEEVKREDKKSKDDLRRLEERVERENKKSEDRLEELRKRVKDNENEDKDLAERLRRVLREVERLVRTVNKKHREVLEEIRKEVERVNDEHRRVLEEIKRRVEKDVK

SEQ ID NO: 9401 - protein, 178 aa, Artificial Sequence; identical to SEQ ID NO: 9400
  Synthetic

SEQ ID NO: 9402 - protein, 184 aa, Artificial Sequence
  Synthetic
SAEEKLDTEVRRIAEEVKRIIDELRKVTEEVEKRIREINKTSEDTSREVKKTIREVLKRLTDEETVRRVEEKLRKLDKESRDTLRRSEETLRELKRRSDETIRRLERILEKLEEEVEDMKRKPLDEDTVEEVLERLRRALEKADKLVKDHIKRLKDVLRAIEEDHRRHLERLRRMLEEIKKEVT

SEQ ID NO: 9403 - protein, 184 aa, Artificial Sequence; identical to SEQ ID NO: 9402
  Synthetic

SEQ ID NO: 9404 - protein, 184 aa, Artificial Sequence
  Synthetic
SVEEKLTREAERLLKRIEEVIRRLRDANRRSADRIRRIDEKTRREVEKLKKKIRELAKRVKDEEVLRRIEKLLRDLKREVEEVSRRNEEILRESNKRLREVEEKLREILRRLKERLDRVREKGIREDLVEKVIKTMRKIVEDLERDVRKVIRDDEELVERLRRENEEVIKKLREIVKRLEDETR

SEQ ID NO: 9405 - protein, 184 aa, Artificial Sequence; identical to SEQ ID NO: 9404
  Synthetic

SEQ ID NO: 9406 - protein, 184 aa, Artificial Sequence
  Synthetic
SLIERLREVAEDLKRRIRKVLEDLRRANEESAKRIRDIDRRTREANRESNERIKEIAKRVDDKRVLDELKKIVEDSNDEVRRVSERNEEILKRSNEDLKRVEDDIKRVLDELEKTLEEVDRKDIKEEKVKKVIDDMERIVREIEEKIKRVIERDKKLVKKLEEDNRRVIKKDKDLVRRLEERTR

SEQ ID NO: 9407 - protein, 184 aa, Artificial Sequence; identical to SEQ ID NO: 9406
  Synthetic

SEQ ID NO: 9408 - protein, 177 aa, Artificial Sequence
  Synthetic
SLKERLRDDAKRLLDEDRKVLEDLERRAKEINDRNEEIVKKLRDKVREILERIDREVRDKDEVTRVKRKIEEILRTLEDRIKKVNDRTREILDRVRKKSEDSLRELKRLLDEVRRVDKEEVIRRILEELRELVERSERTVRDIERELDELIDKSRRDVEEIIKDLERELEELKRKTK

SEQ ID NO: 9409 - protein, 177 aa, Artificial Sequence; identical to SEQ ID NO: 9408
  Synthetic

SEQ ID NO: 9410 - protein, 177 aa, Artificial Sequence
  Synthetic
RVREELEKAAEEVRRRDRRVLEELEKEVRRINEDNKRVHETSREVVERILETIDRRVRDKDKVREVKRDVERILEELEEINKKVNEDTKRIRDTVEKISEESERRLKRLTDEVRRVTDEDVIRKIVRELEELVRESKETVDDIIRRLEELIRKSREDNRKIVEELKKLLDDLTREEK

SEQ ID NO: 9411 - protein, 177 aa, Artificial Sequence; identical to SEQ ID NO: 9410
  Synthetic

SEQ ID NO: 9412 - protein, 177 aa, Artificial Sequence
  Synthetic
SLKETLEEVVKRVLETDKRLLEKNDRTVREVNERNRRVHEESRRAVERILEEIDREVRDDKRVREAKTRVREILRRLEEENREVNKRTKRSLEESRKTSKKSLDDLKRLLDEVRRVTDEDTIRRIAKEADDLLEDSRRKVEDNSRRLKRLLEESKKSNEEIVRRLEDLLRRLKKESE

SEQ ID NO: 9413 - protein, 177 aa, Artificial Sequence; identical to SEQ ID NO: 9412
  Synthetic

SEQ ID NO: 9414 - protein, 177 aa, Artificial Sequence
  Synthetic
SLKEELEEDVKRINDRNEEVLKRLREVAKKLLDDDRKLLKELKKVVEDVLRDVDREVRDKDKVKEVKERIKKILKEAEEMSRRSLEELKRILAEVERRVAELNKETKRILDEARRVKDAEVIKKILEELEKLIKDSEDTAREIIKELKELVERSKRKVEEILKELEDLLEELKRRAD

SEQ ID NO: 9415 - protein, 177 aa, Artificial Sequence; identical to SEQ ID NO: 9414
  Synthetic

SEQ ID NO: 9416 - protein, 178 aa, Artificial Sequence
  Synthetic
SMEEKAEEVIKEVDEENKRLIEEAEKVIEDVEREDRRLVDELRKVIEKVERTIERDLKDLKELLEEARKRLREVEDRLRRLHERTRREVEEVRKRLKELLDESKRNLDKVREDLERTGDKDVIEEIIERLRRHVEDSEEKIRRIIRRLEEVLKRSKEDIERIIEELERLLDEMRERAR

SEQ ID NO: 9417 - protein, 178 aa, Artificial Sequence; identical to SEQ ID NO: 9416
  Synthetic

SEQ ID NO: 9418 - protein, 178 aa, Artificial Sequence
  Synthetic
DMDRKLKEEIKRAERRDKELVKDIERVIEEVLRANKELIERIEKVIDDVRREIEKRLKDLKELLKRAKDELDKVRKDLKRLLEESKKNADRVREELKKLHEKSKEDMERIKRELDETGDKDVIEEIIERIKDILRESEREIRRIIKELREHLKKSADRIEKIRRELERLLEKLEDDAR

SEQ ID NO: 9419 - protein, 178 aa, Artificial Sequence; identical to SEQ ID NO: 9418
  Synthetic

SEQ ID NO: 9420 - protein, 182 aa, Artificial Sequence
  Synthetic
SEIEKILRELEEHIKDSEREHRELVERLRDHIRRSKEEHRDLIRKLEERIREVERRVRKDGKADERLREDVERLLRDIRRELKRNEDNVKEVNDRIRKRVEDNERDVDRENKRIKDELARSDNKELKDRLKRVSEEHKRRIEDLLRRTKRVSERHREEIRKLLETTERAIKKARETIERLRK

SEQ ID NO: 9421 - protein, 182 aa, Artificial Sequence; identical to SEQ ID NO: 9420
  Synthetic

SEQ ID NO: 9422 - protein, 182 aa, Artificial Sequence
  Synthetic
SEIDRLLERLEDHIRKSAKRHRDLVEELREHAERLKRDIERLLEELEKTVRDIEKEVRERGKVDKRIEDRMREVLKRLEDRLRELREDVRRVNEEIKREVRDNEEDVKRVNRELRERLKDSDDEDMKRKLEKVSEEHERKIKELLDRTKRASEEHDERVKRLLDELRRVLKEAEERLRELKR

SEQ ID NO: 9423 - protein, 182 aa, Artificial Sequence; identical to SEQ ID NO: 9422
  Synthetic

SEQ ID NO: 9424 - protein, 182 aa, Artificial Sequence
  Synthetic
ERIDRIIKELEDLVDESRKRNDDLVRELKKHIKESKDEHDRLVEELDRFVEEVRKRVEKDGKLDDRMEKEVEELLREVEDRLRRNKKNVDEVNTKIKEDLERNREEAERALKRLEDDLKDSDDEDAIRKLEDVLRKVRETHERLLDKSRDVSRKHREDIKELLKKTKTVIDRVRKRIKELRK

SEQ ID NO: 9425 - protein, 182 aa, Artificial Sequence; identical to SEQ ID NO: 9424
  Synthetic

SEQ ID NO: 9426 - protein, 182 aa, Artificial Sequence
  Synthetic
SEVERIEEELRREIEKVDRDNKKIVDEARRSIDELRKDVEDILRDLRRLVDEVEKMARRGEVDEETVKEIERRLEKLLREIEEKSRRHLERLEERLRKVHKENREVEKRLKERLEEVRRRGLSEELLKRVEDVVDEVRKRLERIDEKTRKAVKEVTDRNDELLKRVREVVKEVRARLEEIRR

SEQ ID NO: 9427 - protein, 182 aa, Artificial Sequence; identical to SEQ ID NO: 9426
  Synthetic

SEQ ID NO: 9428 - protein, 173 aa, Artificial Sequence
  Synthetic
SEKEKVDKVVKKVAKRIKDLLDEIKRVADESNERLERLLRRLEEASKRSKKKLKDDNLPEDLLKEVTERNERLLREARKVIKRVKEENKRLADEVKEEIDRVRETLKTLRDLVDERDVDTLIKELEDRIDEVEKRIRELIERDKRLVEEVERRIAELIRRDERLVEELKKREE

SEQ ID NO: 9429 - protein, 173 aa, Artificial Sequence; identical to SEQ ID NO: 9428
  Synthetic

SEQ ID NO: 9430 - protein, 173 aa, Artificial Sequence
  Synthetic
SEKEKLKDVVRDVERLIKELMERLERVHERTNREITRLLEDARRAMERSNKKLTDLNLDEDELREARKRNKELLREVERIIEEVRRRDEELRRRNKKTIDDVRRELKRIEEEADEKDVDDLLRRLKELIERVRKLIEDSIKELRDIVKEVKDRIKTLIERDKELVKRLEDRAR

SEQ ID NO: 9431 - protein, 173 aa, Artificial Sequence; identical to SEQ ID NO: 9430
  Synthetic

SEQ ID NO: 9432 - protein, 180 aa, Artificial Sequence
  Synthetic
SEVDKLVRDLERHIEEAKRRVEELLKEIKKLVEDTKREAKKLLDTLRKKVEDVERENSKDRKDVKKVEEDLARVREEIEKLLRDDERLLREIEERAKKEVDKVRKDNERLREDVERRLKDLEEMLRKMREVSERHKKTIDELRKELKKVLDEWRRRSEKIFEELDEVLKRVEERVKEVER

SEQ ID NO: 9433 - protein, 180 aa, Artificial Sequence; identical to SEQ ID NO: 9432
  Synthetic

SEQ ID NO: 9434 - protein, 180 aa, Artificial Sequence
  Synthetic
SEVDELVRRLREHIRRAKERVEELIKRIKTLAKETTDRARKLIEDLKRHIDDARRKNSKDERVLARVREDNDRLEEEIKRLLKEDRDRLEEIKREIDKDVKKVKDDNDELEKRVRKDLKDLREVLKKIKEVSDEHRKEIERLRKRLEEVLREWEDTSREVLERLKEVSKRHRDEIREVAR

SEQ ID NO: 9435 - protein, 180 aa, Artificial Sequence; identical to SEQ ID NO: 9434
  Synthetic

SEQ ID NO: 9436 - protein, 180 aa, Artificial Sequence
  Synthetic
SEMEDLIRRLREHIEDVRRKVEELIRELEDHIRRAEESVKKREDDLRRHIEEVRKRNSKDEDDRKKVEEDNRRLDEDIKREVRKVEEDNRRLMKRVEDLVREVEKNNEELRKRVEDRLKDLKEVLDEARRVSKEHKDTLEKLLRKAEEASERHKREIERLLKELKEVSEEHRRRIDEVRR

SEQ ID NO: 9437 - protein, 180 aa, Artificial Sequence; identical to SEQ ID NO: 9436
  Synthetic

SEQ ID NO: 9438 - protein, 178 aa, Artificial Sequence
  Synthetic
SEVEELIEDLKRHLKEVADRVEELERELRKHLEEHHRRVREIIRRLEDLLRKAEETRTDEKLKEDLERMLREVEREVRDSERHAKEVNKRVREKVRRIEEHVKRRNKDVEEKVERDVRREDLKRRIEKVSRDHERTVEKLVRDLERVSREHERTVKENKERIKKVLDDARKRVDEVKK

SEQ ID NO: 9439 - protein, 178 aa, Artificial Sequence; identical to SEQ ID NO: 9438
  Synthetic

SEQ ID NO: 9440 - protein, 173 aa, Artificial Sequence
  Synthetic
SEVEKLVRELEDVLRKIERKVRELSKDNKRVLDENKKRVEDVSRDNERAMREIEELRRKVDAKDIRERLKEIRDKNRRINEESKRLLRELEKKNEKMLREIEEDLRRLADEARKKTRDEELKKVLEDVKREVEKLLEEIKRSLEEARKTVKESNDEIRESLERLEEKVRRIEK

SEQ ID NO: 9441 - protein, 173 aa, Artificial Sequence; identical to SEQ ID NO: 9440
  Synthetic

SEQ ID NO: 9442 - protein, 173 aa, Artificial Sequence
  Synthetic
DEVKDLVKRLEEVIKRIDEVVKEVDRRNREVLERNRELVERSIRELREVLDRIRRRKKDVDRKDIEKILKELEDKSRKINEESKELLDRLRKENEKILREIEERLRELEDEARKKRRDSELDKVLEDVKRKVEEILRRIKRSLDEVERDVRRSNEENKKVTKEVREAAEEIKR

SEQ ID NO: 9443 - protein, 173 aa, Artificial Sequence; identical to SEQ ID NO: 9442
  Synthetic

SEQ ID NO: 9444 - protein, 173 aa, Artificial Sequence
  Synthetic
DEVEELVRRLREVLEEIRELVERVNDRNRRVLEENRELVTRSIEELRRALERIERLSKDVRREEIRKILEELEKRSRDINRESEELLRRLAKENKEILDRIKKILDDLREEAKRKTRDEKLKKVLEEVERRAKKLLRDIEESLRRVAREVERSNEENKKVTKEVADAVREIER

SEQ ID NO: 9445 - protein, 173 aa, Artificial Sequence; identical to SEQ ID NO: 9444
  Synthetic

SEQ ID NO: 9446 - protein, 174 aa, Artificial Sequence
  Synthetic
DEEKKARDVLERWRKRSEDLLRKAEDVLREWRERSERSFKRLRDVLEEARKRVEELNVPEEILREIRRRLEEMKREIEKLLKEDRDALKELADRIRKIVEDDRRKLRRIEKIVRETKIDDELVREIEEVVKETEKRVEELIKEIREMVKKNEREVREIERRLEETLEKIDRDRK

SEQ ID NO: 9447 - protein, 174 aa, Artificial Sequence; identical to SEQ ID NO: 9446
  Synthetic

SEQ ID NO: 9448 - protein, 171 aa, Artificial Sequence
  Synthetic
SEEEEIEKALRDWREELKRLLETIERLLREWKRRVEELKKRIEEALKELKKILDDKGVPEEVRKEIEERIRRLRRRVEEDEETVDREIRKIEEHVKRDATEVDKLIRELKKRREDVEEVKKKLEKEIKKNRENVDRLRRRLEEEVKRNERSVEEIKRRLDEIARELDERKK

SEQ ID NO: 9449 - protein, 171 aa, Artificial Sequence; identical to SEQ ID NO: 9448
  Synthetic

SEQ ID NO: 9450 - protein, 171 aa, Artificial Sequence
  Synthetic
SEDEEIKEALKEWRDEVRRLEEKIRRVLEKWERDVRRLKEEIKKSNEDLRRRLEEKGVPEEVRERIKERSERDKKKVKEDEEEVRRRKREIEEHLERDKRRVEKLIDDLRKRRDDVEEVKKRLKRLIEENRKNVKRLEERIREAVKKNEKSVEDSERENRDIARELDEKRK

SEQ ID NO: 9451 - protein, 171 aa, Artificial Sequence; identical to SEQ ID NO: 9450
  Synthetic

SEQ ID NO: 9452 - protein, 182 aa, Artificial Sequence
  Synthetic
EEVERLKERLERLSERSKEIAKRVHEENKKLSEESRKLVEDVHRENEEAAKRLEDVARRNELPEEVLRKELDDVRKRNKEILDTLREISKEVEKRNRKILEEIRKRSEEVRREVEEVERRLRGRELLERLRRVLEEHREVNERILEEIKRSLDEHKDTNRKLLEEIEKSLRDLEEIVRRLEK

SEQ ID NO: 9453 - protein, 182 aa, Artificial Sequence; identical to SEQ ID NO: 9452
  Synthetic

SEQ ID NO: 9454 - protein, 182 aa, Artificial Sequence
  Synthetic
REIEEIEKEVRDVSKESEDIVRTVHDENRRASERSRELVKRVDEENRKAVEDLERVARENREPKEALDKRLEDLKRRNEEIEKRLEEISREVSRRNEEIKKTIEKLSREVAKRLKEAEDRLKGDELLRRVRKLLEDHKRVNERLLEEIEKSLKRHREENERLLEEIRKSLEDVERVVEEIKR

SEQ ID NO: 9455 - protein, 182 aa, Artificial Sequence; identical to SEQ ID NO: 9454
  Synthetic

SEQ ID NO: 9456 - protein, 182 aa, Artificial Sequence
  Synthetic
SELEELEKRLRKAVRDLEEIVDRVRKDLERASDDSRRIVEEVHRENRKVAKELKEVRDRNEEDRTVLRDKLRRVAKRNEDILRKIKEDSKDVKRRARKILKEMADLLDTVRKEIEEVAKDLKGEELLEALERLLRELEKIVRKLLRELEEMLRRHEKTNRELLERIRRSLEELAKIVEDLET

SEQ ID NO: 9457 - protein, 182 aa, Artificial Sequence; identical to SEQ ID NO: 9456
  Synthetic

SEQ ID NO: 9458 - protein, 182 aa, Artificial Sequence
  Synthetic
DEIEEIKKELDELSKRSEKIVRDLERELREASKESERLVRKVHDDNRKALEELRDVRRRNDEDDKVLEDRLRKVEEENKRIKDELKKRSEDVAKRIEDILRDIERRSKEVAERAKEMEDRLKGDELLKEVRRALEEHERVNRELLERIRRVLEEHKRVNEELMREIDRSLKELAEIVKRLKD

SEQ ID NO: 9459 - protein, 182 aa, Artificial Sequence; identical to SEQ ID NO: 9458
  Synthetic

SEQ ID NO: 9460 - protein, 182 aa, Artificial Sequence
  Synthetic
DELEELRKELKKMVDEIEEIVRRVDKENRDASRESEELVERIVEEVRKAVTELKELKKRNESDRKELEKKLKEVAKRIKDLLRRLKEISDRVAEKNKRILEEIEKRLRDVEERIKRIEDELEGDELLKEVRKALERLKEEVKRVLEDIRRSLEEHRKVNERALRRIEEVLRDLERIVEEVKT

SEQ ID NO: 9461 - protein, 182 aa, Artificial Sequence; identical to SEQ ID NO: 9460
  Synthetic

SEQ ID NO: 9462 - protein, 182 aa, Artificial Sequence
  Synthetic
SEVERLKDELRKASEELKKEVEEIEKRLREMSERSRKLVEELKRTLKEIEKELKDIVRKDKEKKEELKRIVEEADRLVKEIEDRLRRLNEKSEEDAKEVDDRLKRKLDESRKRIKEVEKDLKGDRLKEEVERVLREHEKSLERLRERLKELLERHHKTNEELLREIKEALERLEKIVKDLTD

SEQ ID NO: 9463 - protein, 182 aa, Artificial Sequence; identical to SEQ ID NO: 9462
  Synthetic

SEQ ID NO: 9464 - protein, 182 aa, Artificial Sequence
  Synthetic
DEVEDAERRLREMSERIEDLVRRVEERLRRMSEESKKLVEDVKRENDKSVEELDRIVRRDKEKKEALRKIVEDDERRVKEVKERLEELNRRSEEDVRRVKEEAKRLLEESDRIAKKLRDDLKGDRLKERLEKLLRDHRRSVEEVIKKLDRLLKEHHKVNEKLLRDIDKSAKEVKKVVEDKTR

SEQ ID NO: 9465 - protein, 182 aa, Artificial Sequence; identical to SEQ ID NO: 9464
  Synthetic

SEQ ID NO: 9466 - protein, 182 aa, Artificial Sequence
  Synthetic
SEVEEAEKELREMSKTSTRLVEELEERLRRASETLKKLVDDVKRELDKRLEDIDRRVARNKEKKEELDKELEEVDDRARKVKRTLEDILRESKRLVEKIEEDLKKLDEDSRRSVDDVRRRLKGDRLKERVDRLLEEHHKVNKRLLERIEEVLRRHETTLRELIKEIDKLLRDLKKRIDDVKK

SEQ ID NO: 9467 - protein, 182 aa, Artificial Sequence; identical to SEQ ID NO: 9466
  Synthetic

SEQ ID NO: 9468 - protein, 182 aa, Artificial Sequence
  Synthetic
DEVREVKKELKKIAEELRKLIEEVREELRKMSKRSEELVRELKKRNEKSVRDLERIVRKDKEKKEELDKIVKEDKDDVRRIKKELKDLNDESRKRAEEAKRELERIVDRVRERVEDVRRKLEGDKLKEELKEALKDLERELKELIEELKRLLDEHHKRNEDLLREIDKSVRKVEEDVRRLKK

SEQ ID NO: 9469 - protein, 182 aa, Artificial Sequence; identical to SEQ ID NO: 9468
  Synthetic

SEQ ID NO: 9470 - protein, 185 aa, Artificial Sequence
  Synthetic
SEVDEVRKELERLVREIKKLVEDSKRNLDRLSKELEERVRDLERDARRLVKELRDLLKENRDEKTVKELIETLKDRVRRTLERIKREVDENRRYLERNKRELERLIRELKKRLEKLLRDVEREIKDKEVRDDVRRLIREVDEELKKAKEDLDRAHEEHEKSTERLRERIKEVVDRVREDIERTKN

SEQ ID NO: 9471 - protein, 185 aa, Artificial Sequence; identical to SEQ ID NO: 9470
  Synthetic

SEQ ID NO: 9472 - protein, 171 aa, Artificial Sequence
  Synthetic
DEERRIEKVLKEWEKRTRDLARELERVNREHKKTSEDVLKKLEEINREVRRVVKEENLPEDALRELEKRLEEDHERIEREFRKDKKRLEEDHRRVREEVERSRKKLEELRRRVKDVEKLRRLIEEVIREDERRVERVKRNNKRLSEETEKLVEDVRRNNERLVKEVRDRSR

SEQ ID NO: 9473 - protein, 171 aa, Artificial Sequence; identical to SEQ ID NO: 9472
  Synthetic

SEQ ID NO: 9474 - protein, 171 aa, Artificial Sequence
  Synthetic
SEEEEIKKVLDEWRRRTEELRKDLDRVLEEDRRSVEEVKRRLDKVNEELRRRIDELNLPEEEVRRLRDTLKKDHDRIREEIKRSRDNTRRLREEVEREVKKSRDRLEELRKRVTDVERAKEEIKKVIKEDEDLVRRVRKYIEENSDELRRLVEEARKNNTRIAKEAEDTSR

SEQ ID NO: 9475 - protein, 171 aa, Artificial Sequence; identical to SEQ ID NO: 9474
  Synthetic

SEQ ID NO: 9476 - protein, 171 aa, Artificial Sequence
  Synthetic
SEKEEIDKVLKEWEEMTRRLVEELKKSHDEDRESVKRLLERLRDVNRELKEIIDRANLPEESVRRLEEKLRRDHKRVERAVDESRKNTERSEEEVRRAVERSKEKLEDLRRRVTDVEKAKETVRKVIKEDRDLVREFKKYNEENSDRMRKLVKDIKENNRRIVEEARERSR

SEQ ID NO: 9477 - protein, 171 aa, Artificial Sequence; identical to SEQ ID NO: 9476
  Synthetic

SEQ ID NO: 9478 - protein, 174 aa, Artificial Sequence
  Synthetic
SKEEKLREALKKVRKDVKDLERHIDRSVKRNKEEVDKAKRELERSLEELRRRLEELRRTEELDRELKRLEEKNKEMLKRIDESLKESKKRNDKVKRELREELKRLEEEIRDAERKGLPVEELLERLERTLRRMREKVRKLDKENKDHTEKVKEDVKRVHDENDKVREDVDRKDK

SEQ ID NO: 9479 - protein, 174 aa, Artificial Sequence; identical to SEQ ID NO: 9478
  Synthetic

SEQ ID NO: 9480 - protein, 185 aa, Artificial Sequence
  Synthetic
REVEELVKEIERVLEETKKRSEDTKREVEKVLEDTKRLVERLRKTLEELLRELDKRVRSGLDEETLERVLREVRKKLKELADEARRVSEEDEKRLRKLEEDSKRLSDEDRKKLEKLEDEARKKVDGEELRRTLEKVLREWRDVNRKVNDTDRKVLEDWERVNRTVNEELKEVLERAKEDIDRVAT

SEQ ID NO: 9481 - protein, 185 aa, Artificial Sequence; identical to SEQ ID NO: 9480
  Synthetic

SEQ ID NO: 9482 - protein, 185 aa, Artificial Sequence
  Synthetic
DEVERLVEEIKKRIDETRKLLEELKKRIRKVLEETKDLVRRLLKRLRELLKELEERRRRGLREDELKRVLDDARRKIRKIEEDAKKMSREDRKKLRDLAEEAKDINRKDEEDLRRTEEELRRRVDGEELRRELKRVLDEWKKANDEVRRAMEEILKEWEEVNRKVNKDLRDVLEEVKERLREVAK

SEQ ID NO: 9483 - protein, 185 aa, Artificial Sequence; identical to SEQ ID NO: 9482
  Synthetic

SEQ ID NO: 9484 - protein, 185 aa, Artificial Sequence
  Synthetic
SEVEKLKKRLRDLLEELKRLSRRTKEDVRRVIKETRDRSKKTKEELEKLLREIRELRKRGLREKELKEVLDDARRKIEELARRSEELNRRDEDKLRKLAKESEELLRRAEERLRRLKKEVEEKVKGEDLRTEIKKILEEVKREIDRVRETDEKVLRDWKKANDEVRETDREVLRKIREDLKEVAR

SEQ ID NO: 9485 - protein, 185 aa, Artificial Sequence; identical to SEQ ID NO: 9484
  Synthetic

SEQ ID NO: 9486 - protein, 174 aa, Artificial Sequence
  Synthetic
RERETIEKVLDENRKSLEEVTETVKRVLDRWDETLKRLEEEVRRVNDKTRKVLEDLLREDKDLARRVKEELEKNLREVEDDKRRAEERMRELKRDVERVRKENEEELKKLRELLEKIDVKELKKRVKELSEKLREVLEELERRVREIVKRNKETVDESRKRNEELIKRAEDAAK

SEQ ID NO: 9487 - protein, 174 aa, Artificial Sequence; identical to SEQ ID NO: 9486
  Synthetic

SEQ ID NO: 9488 - protein, 182 aa, Artificial Sequence
  Synthetic
SEIDEVRKRVEKHSRDAKRLVDELREKNDRAIKTLERLLRELEKRNKKVIRDLEDVRTKNTEPEESLRRILKTVHDENRKVEEELRDILRRVEEENRRVIEELDRSLRESRKDLAEIEKRITDEDMVRELRRVLKENDESVRRLKREIEEVHKETERVVKEVLEEIRRVDEELKDVARKVET

SEQ ID NO: 9489 - protein, 182 aa, Artificial Sequence; identical to SEQ ID NO: 9488
  Synthetic

SEQ ID NO: 9490 - protein, 182 aa, Artificial Sequence
  Synthetic
REIEEVIKELKRHSEELEKELDRLRRENKEAIRTSKKLVEDLRRENTRAKEELEDVKRENRRDRTELRKLLERVHKRNEEVRETNRRLTERVARRNEEVKERLKRSLDESRRRVREVERRITDERALERLRRVVRENEESVERVLKKIDDIHEETKRVSDRSEKEIEDVDRDLKRKVEEVEK

SEQ ID NO: 9491 - protein, 182 aa, Artificial Sequence; identical to SEQ ID NO: 9490
  Synthetic

SEQ ID NO: 9492 - protein, 184 aa, Artificial Sequence
  Synthetic
REREKIKRILDELRKRVEELNRRNEELLRRLDKVVRDVNRTNKRLLEKLRKVADDVRRKLKDEPEEVLRTLDEILKKVEKEIKDTNDKTRKILEDARRLAEEVNRTSKKILEEVEREVKEVERENDREVDKVERTVEEIEKELTRLVEESEKEVKRIIEELKELLERSRKSVEDIIREVRKLAE

SEQ ID NO: 9493 - protein, 184 aa, Artificial Sequence; identical to SEQ ID NO: 9492
  Synthetic

SEQ ID NO: 9494 - protein, 184 aa, Artificial Sequence
  Synthetic
SEEEKLDRLLEELKKVAEEVNRENEKLLEDLERVVRDLNEKNKAALKKLEDAVRRLKEAIKDKPEDVLRTLEDDLRKVRKKVEDVNRESKEILDRVRKEIKETNEESKRILDRVEREADRIRRDKDDSVDRVEERLREIIKTLRKLLEDSKESVRKIIEELKRLVDRSIEDLERIIKELEDKVR

SEQ ID NO: 9495 - protein, 184 aa, Artificial Sequence; identical to SEQ ID NO: 9494
  Synthetic

SEQ ID NO: 9496 - protein, 184 aa, Artificial Sequence
  Synthetic
DRERRIETVLRKLKKVVEEVNRRNEKLLDDLRKVVTRLLEEDRRLLEKLRRAAERLKEELKDGPEEVLRTLEKILRDVERRSRESLKRLKEILDRAEREVREVNRTSREILERVKKEAERVKRDQDDDVTRVKEKIEKIIEELKKLLKDSKKRVEEIIRELEKLVDDSRREVEEIIKELKDRSR

SEQ ID NO: 9497 - protein, 184 aa, Artificial Sequence; identical to SEQ ID NO: 9496
  Synthetic

SEQ ID NO: 9498 - protein, 185 aa, Artificial Sequence
  Synthetic
DMREELERILKTLRDVSRESRRELKRLLDENEKTIREVKKRVDEILEKLRKVIDDVRRQGNDERAEDELRKILERVKKIADELKDRLRDSLKKSKEDIDRVARENEKLLRDAEDRIRRVAEADSRSKKVVDEVDKEIRELIRKDEEIVKEVAERVKKNSEDLRRLLEKARREIEEIIKELEERRR

SEQ ID NO: 9499 - protein, 185 aa, Artificial Sequence; identical to SEQ ID NO: 9498
  Synthetic

SEQ ID NO: 9500 - protein, 181 aa, Artificial Sequence
  Synthetic
DEDEIVRDVIRRLDEVLKKLEKTNTELDEELKRVVEELRKVNRTVDEELKRVLDELAKRIEDEDKVRRLEDRATKLIKKNEDHLRELEKAVEELEERNKRHLDRLREEAEKLKEEVRKVREDGRANDKLVKDLKRVLDKLEESSRRMLKKLSDALRELEKSSDKVVKDLRKVLKELREEVK

SEQ ID NO: 9501 - protein, 181 aa, Artificial Sequence; identical to SEQ ID NO: 9500
  Synthetic

SEQ ID NO: 9502 - protein, 181 aa, Artificial Sequence
  Synthetic
DEDERVEELLRELEEVLDRLAKLNKKLDERNKEVAEESKRLNETVDRELKEVLKRLEEKLEDKDKLRELKKKAEKLVRENRKHLEESERRHRKTAEDNKRHLERLEESARKLLEDLRKVKEDGRANSELVERIRRELERLKRSSEEVVKKLTEELKKDKKSSEEVVKDLRRALRELERAVD

SEQ ID NO: 9503 - protein, 181 aa, Artificial Sequence; identical to SEQ ID NO: 9502
  Synthetic

SEQ ID NO: 9504 - protein, 174 aa, Artificial Sequence
  Synthetic
SELEKVKEDIRRLLKRLKEDIKRIKDEIDRLLEELKRHLKEVEEEVDRILEELKDLKRRGTTEDTLRRVREEIKRLIKESEEALEKVKREIEEIKKRSEEKLKRARTEIKKIKDNVPRREKLERVKEDVERVLEEYRKRSEDLARRVEKVLREYKKRSDELEKRVEDVIKEVAD

SEQ ID NO: 9505 - protein, 174 aa, Artificial Sequence; identical to SEQ ID NO: 9504
  Synthetic

SEQ ID NO: 9506 - protein, 174 aa, Artificial Sequence
  Synthetic
KELEEVARKIDEELKKLDKNIRDIADEIRRILEELEKDLREIEKRIRDILRRLEDLKRRGTDERTVKRAEREIREIAKDSRRKLEEVRERIERIMRRSKKTLDDVKRRIEEEAKNVPRTDELKTVEDKVRKALREYEEKTRKVKKDVDEVIKKYKTDSDRVLDEVEKALREVER

SEQ ID NO: 9507 - protein, 174 aa, Artificial Sequence; identical to SEQ ID NO: 9506
  Synthetic

SEQ ID NO: 9508 - protein, 181 aa, Artificial Sequence
  Synthetic
RVEEKLKRVSDELKRAVDESNKKIEELLERLKRVHDETNKEITEILRELKEVVDKAREDGLDDERLKRILDEARDVIRRVRETDDDLRRRNKEMVDRLKDLNRKLEKRAEELIREVKDKIRTDELVEDIERKIEELIRRDDDLVRRAEEEVEKSIRELRRLVDEVRKEIKKIVKKIEDDVR

SEQ ID NO: 9509 - protein, 181 aa, Artificial Sequence; identical to SEQ ID NO: 9508
  Synthetic

SEQ ID NO: 9510 - protein, 181 aa, Artificial Sequence
  Synthetic
SREDKARELLRELEKVDDDHRRRVRELLERLKKVLEDHRRAVKDIIKRLDDELKRIKEEDDKGDKIEEILRRVRKKIRELEEHVKKTNEDIRRKIEELRRHLDETNKETNRKIERLRRELKEKKIDEEVAKEVKDIVREVEDHLRRVEEEVRRIIREVEEHIRDLERRVRELLEELKRRSK

SEQ ID NO: 9511 - protein, 181 aa, Artificial Sequence; identical to SEQ ID NO: 9510
  Synthetic

SEQ ID NO: 9512 - protein, 181 aa, Artificial Sequence
  Synthetic
SEEEKVRRLKEELRRVIEKHKKDVKEIEDRLREVDDRHRREVKKLIEELKKVLEDAKRRKREGKDMEKRLDELREIIKKLMRHAEKFNRETNKKIEEEKRHLEEANKELEKEIRDLEREVKETKIDEEVAKRVKEIIEKVERHITEVKKRAEELVEEVERHIRELKKRVEDLVEEIERDTK

SEQ ID NO: 9513 - protein, 181 aa, Artificial Sequence; identical to SEQ ID NO: 9512
  Synthetic

SEQ ID NO: 9514 - protein, 180 aa, Artificial Sequence
  Synthetic
DEKETAEELLRRIEKVIKRLEDTMRKLNKKLKEAIERHHRTAKKLLDDIERVIREVEKDRGDDRDVRRVLEDIKRKLDELRKRIEDVDKEVEDHLKRNHDKVRKILEDLKKLLDELRRLLDELRREELEDDVRRIIEEIDRLLRESEEDHEDLIRRLKRSLEELKRLAEDIIRKLSEDRK

SEQ ID NO: 9515 - protein, 180 aa, Artificial Sequence; identical to SEQ ID NO: 9514
  Synthetic

SEQ ID NO: 9516 - protein, 180 aa, Artificial Sequence
  Synthetic
REKEAAKRILDRIEKVIRDHHREAKRLNDELEKVIREHHETVKELLKRIKEVIDKFKKDKGDDRDVERIRKRLEELLKKLEDDARRVDKRLRDVLRRNHKEVREVNEEMRELLKRLADLLDELSVEELEETARRIIEKLKKSLEDSKRDHERLKKEIEDSLKRLTELVKKIIEEIERDRK

SEQ ID NO: 9517 - protein, 180 aa, Artificial Sequence; identical to SEQ ID NO: 9516
  Synthetic

SEQ ID NO: 9518 - protein, 180 aa, Artificial Sequence
  Synthetic
DEDEEARRLLEEIRKVIEEAEEEAKRLNERLRRVIKEHHRKVKELLDEIERVIEKVLRARGDDRDVRRIIKEIRERLERLREEAERVDRKLKEHLERNEKKVEEMRKRITKLLDDLRKRLKELSVDELRERVREIKEKLRKDLKDSEDDHRRMEEEIKKSLERLERLVREIIKDLEEKLR

SEQ ID NO: 9519 - protein, 180 aa, Artificial Sequence; identical to SEQ ID NO: 9518
  Synthetic

SEQ ID NO: 9520 - protein, 180 aa, Artificial Sequence
  Synthetic
KDEERAKRLLDEIERVIRRHHKTARDLNRELERVLKEHHDTARKLLEDIKKAIDDLKRTRGDDRDVDRILRDLERLLRELEKKIREVDKRAKEHIKENERRVKKVNDELRELLERLARLLRELDAKELEDKVKEIIDRIEKSLEESDKNHKKLIRELEKSLDDLRREAKEIIDDAREKAK

SEQ ID NO: 9521 - protein, 180 aa, Artificial Sequence; identical to SEQ ID NO: 9520
  Synthetic

SEQ ID NO: 9522 - protein, 179 aa, Artificial Sequence
  Synthetic
SAAERAEEVLRKLRESLERHKKVNKDLLEEIERSLREVAKDVDRVLKDIKRVLDELKRRRRDLEEVEERVRRILRTIEKLLKELEDDNRRILEELKRKSEEVAKRNEDIARELKDRLRKDKGARDEVEELVRRVHRENEKFSKESEDLVREVHERNKELVKRIRKILEDATRELEKAAK

SEQ ID NO: 9523 - protein, 179 aa, Artificial Sequence; identical to SEQ ID NO: 9522
  Synthetic

SEQ ID NO: 9524 - protein, 179 aa, Artificial Sequence
  Synthetic
DMKEEAEEVLKEIEEVLKEHRDINRRLLEEIKKSLEDLSREVERVLDEIRRLLKRAVEERPDVEELEEDVRRILREIEERLKDVRRRNREILERIKEESKRVSEEVKKILEEIKKRVTETQGADEEVRKIVEDLKKRLKELSEKSERIVRKVHRDNERVVREIRDIVRRLKKRLEDATR

SEQ ID NO: 9525 - protein, 179 aa, Artificial Sequence; identical to SEQ ID NO: 9524
  Synthetic

SEQ ID NO: 9526 - protein, 179 aa, Artificial Sequence
  Synthetic
SAKEKVDEVLRRIKELLDRHKKVNEEILEEIRRSLEEHREVNERLLETIDRLLKELKRSRKDLEEVEKRVRDILRRIKELSDEVAEENKEILKELRERSERVEKRVREILKEIKDRVTKDKGAREEVEEIMRRAEEELRKLSKESRELVKRLHERNEEMSRRSKKIVDEAKKELEDAER

SEQ ID NO: 9527 - protein, 179 aa, Artificial Sequence; identical to SEQ ID NO: 9526
  Synthetic

SEQ ID NO: 9528 - protein, 182 aa, Artificial Sequence
  Synthetic
SAEEELDRLEKELDKLLKEHHEENKRLLEEIDRVLKEHEETLRRLIKELREVLKEVKEKLRDKRKVDELDKRMRELEERLKAILEDSKRKVREIKERLKELNRESEKRVKEVKDTLRDLLRRNSEKVEKLREDVERVKRELEDLTRKSEELVKRLKDTLRRVSEELKRRVDEAKKEAREVER

SEQ ID NO: 9529 - protein, 182 aa, Artificial Sequence; identical to SEQ ID NO: 9528
  Synthetic

SEQ ID NO: 9530 - protein, 182 aa, Artificial Sequence
  Synthetic
SAEEELKRLLEENERVTEEHHKRNRDLLRRIDEALRRHEKTLEDLIRELDRVLRELERRLKDKEKVDRIRREVEKVKEELKRILEESRDIVRRAKETLKKLNEDSERESEKVLKRLREIVDKVSEKVDDLRRIIEESRRRHEELTKESEKLVREVEDILRRLSEELAELVKRVKDKLDEDAK

SEQ ID NO: 9531 - protein, 182 aa, Artificial Sequence; identical to SEQ ID NO: 9530
  Synthetic

SEQ ID NO: 9532 - protein, 182 aa, Artificial Sequence
  Synthetic
SAEETLKRLAERIRKLLEEHRETVKRVIDRLDKVLRDHHRENKRLLEDIDRVLRRLEESLKDEEKVKEIRRRVEEIKDTLRRLDERSRDRVRRVKKEAEDRLRRSEEEIRRILRELEEIVRRNKEKVEDLDRRVKEVERRLREMSKTIEKLVKDIERELKEASEESRELVERMKRELTEAEK

SEQ ID NO: 9533 - protein, 182 aa, Artificial Sequence; identical to SEQ ID NO: 9532
  Synthetic

SEQ ID NO: 9534 - protein, 182 aa, Artificial Sequence
  Synthetic
REIEEILKEIEKSLRDLEEEVRRILEEIKKSLEDLRESMERIVEEVDRRLRTLKEVFDRGELDEEKIKRVEDTMKKILDDVKEEIKRHHEDLRRILKEAEERIKEHHDRLRETLERLKDKTTDDRVRRIIEKLEEDLRRVNKKIKETLEEAAKRLEDADREIEKILRDLARKIRKVLEEIKK

SEQ ID NO: 9535 - protein, 182 aa, Artificial Sequence; identical to SEQ ID NO: 9534
  Synthetic

SEQ ID NO: 9536 - protein, 182 aa, Artificial Sequence
  Synthetic
SEVEEIERRIEKSLKELRERLEEAEKRHEELLERLEREIDRIEKELRKDLKRLRDMTRRGEVDEKTIDEEEERLRRKLEELKKIVEKVRKENEDLLRKWKRDIDEHHRELRETLKRAKDKTKTERVKKEIDRLEKRLEEVNEEIKKRLKELAERSRRVLERIKDRIRRAAEELKRVLDEVRT

SEQ ID NO: 9537 - protein, 182 aa, Artificial Sequence; identical to SEQ ID NO: 9536
  Synthetic

SEQ ID NO: 9538 - protein, 182 aa, Artificial Sequence
  Synthetic
SEIEEILKRLKELLKELKERNEDILRRVEKSLKDLRKKLEEIVRDLRRLLEELREMVKRGEVDEETIKKVMRDAEKILEDLRREIEEHHKKLRKILEDSKKENEDLEKRLREELKRVKDKTTDDRVREIIKTAEKELEKALRTSEDIDRRLEERLEKVNKEIREELRRAEEEIKRVLEEVKR

SEQ ID NO: 9539 - protein, 182 aa, Artificial Sequence; identical to SEQ ID NO: 9538
  Synthetic

SEQ ID NO: 9540 - protein, 185 aa, Artificial Sequence
  Synthetic
DELDRIRKEVKRISDKNRRHVERLDEEVRKLLEELRKHLEDLTREVERLLRELKEVKKEGKDEETVRRVLRELEERIRRLKKHADEANKELKDKIDELEKHIKKANEDSKKEIDELEEDLKRKTRTEEMRTKVEELRKRLEESLEEHKRAADELRKRLKKVLEEHEKRVRELEEELRRVLKEAED

SEQ ID NO: 9541 - protein, 185 aa, Artificial Sequence; identical to SEQ ID NO: 9540
  Synthetic

SEQ ID NO: 9542 - protein, 185 aa, Artificial Sequence
  Synthetic
DELEELRKLVEEISRENREHLKKLKKLVEDLSRENEKHLRDVDKRVKELLEDLERLTRRGLDEETVRRVLERVEEEIRRTKEHLDKFNEDSERKARELKRHAEKFNEESKKKIDDLEDDARRKTRTEDVERELRRLKKELDKSLKEHRTTLERLEEELRKSNKEHRDRVKELREELEKVLRDAKR

SEQ ID NO: 9543 - protein, 185 aa, Artificial Sequence; identical to SEQ ID NO: 9542
  Synthetic

SEQ ID NO: 9544 - protein, 182 aa, Artificial Sequence
  Synthetic
SMLDEARKEVKELKDRVERASEKLEDNARRNVEKLERVSEELEREVKRLLDEIEEVKRRNGDEELLERVVRRLKRELEKLKEKSDEISKDSERNLDEIRKESERIKKELEKALRDLKKRADDDLIDEETLKELERRIREVLKKHDKTLRDLERRIREVNKRHKDVSDRLAERIKKVIRELER

SEQ ID NO: 9545 - protein, 182 aa, Artificial Sequence; identical to SEQ ID NO: 9544
  Synthetic

SEQ ID NO: 9546 - protein, 182 aa, Artificial Sequence
  Synthetic
DKEKELEREVDELLKRLEEHSKRVDKTVEDVHRRNEEALRDMERKVREVVEKLKEVKERTKTEEVMRRLERDVEKIKEDLRREVERVKEENKRVLDEIRRSLEESEKRVRDIEKKLDEEVRKAGRRLEEVDRLRRELREVLKRNRESVERAEEKLKKSVKELDERVKELEEELDRALDELRK

SEQ ID NO: 9547 - protein, 182 aa, Artificial Sequence; identical to SEQ ID NO: 9546
  Synthetic

SEQ ID NO: 9548 - protein, 182 aa, Artificial Sequence
  Synthetic
SEVEKLERDVRELHKDNKRHSDELDREVKKLLEELRRALEELKEKVERLTRRLEEVKRRTRTEEVLKRLEDEAREMIEELKKSLRELEKRVEDVEKRLEESLKRSREKNEKMKEDLDRELKKAGRRLKEVEELKRRIDRSVEENEDSIRRLKEEIKRIVDEVRRVVEKLIKEIKDAVKKLRD

SEQ ID NO: 9549 - protein, 182 aa, Artificial Sequence; identical to SEQ ID NO: 9548
  Synthetic

SEQ ID NO: 9550 - protein, 182 aa, Artificial Sequence
  Synthetic
DELEELKRRVEELEERNKDHSRKMRETVERVKERLDRHSKEMEKEVRKVVEDIKDVKRKTKTEEVLKRLKEKIEKIKEDLRRSLDESRKEVEKIKEDLRDSARKSHEENKDVKRKLEDDLRKAGRELREVDELKKEIERADKENKDSIEELERELDRVLKENEKSIRELEKELDDVLDEADK

SEQ ID NO: 9551 - protein, 182 aa, Artificial Sequence; identical to SEQ ID NO: 9550
  Synthetic

SEQ ID NO: 9552 - protein, 176 aa, Artificial Sequence
  Synthetic
SEAEKLLEENRRELEKVKRDAERLNDEIRERLKEIEDKLKTLNDEIRKLVKEMEDRNDRDKTVEEELRELIETLRRRYEELKRELEELIKELKRRYEELLDRLRRLSEESKERADRDLIDEEILRTIADDNRRVLEEIKKIIKHSRDELERVKRDIDRIVKHSVKLLEDVLRRLRK

SEQ ID NO: 9553 - protein, 176 aa, Artificial Sequence; identical to SEQ ID NO: 9552
  Synthetic

SEQ ID NO: 9554 - protein, 177 aa, Artificial Sequence
  Synthetic
DEEEIVKRIEDDARRIIEEVKEVLRRIRDLNERILREAEEVLKEIREINRKVLEDLRRDGLPSDEIRKAEEESEKNLRELEEIIKTVEKRSRESVEEIKELIKRAEDLLRELIRELRETRVDERVLKRLRDELDKLREDLERILRRNKKLLDELRELLERSRRENEKLVEELKRKAK

SEQ ID NO: 9555 - protein, 177 aa, Artificial Sequence; identical to SEQ ID NO: 9554
  Synthetic

SEQ ID NO: 9556 - protein, 178 aa, Artificial Sequence
  Synthetic
SEAERIEEEVKKLLKDVKKKLEELKESSKRVVEELDKVLKELKESSDRLAKEIKKALDDNRSEEDIKRLLRENKEHLRELDERVRELKKKNKKHLDDLKREVDELRKRLEDALRRIEERVRVKDVLEKLRELVKRLIDDLRRVVEELEETNERLDRKLEDVLKKLRETNEKTLRELRK

SEQ ID NO: 9557 - protein, 178 aa, Artificial Sequence; identical to SEQ ID NO: 9556
  Synthetic

SEQ ID NO: 9558 - protein, 181 aa, Artificial Sequence
  Synthetic
SVREDLKRVVEDIRRIVKEVHERNREASKRSEDLVREVHERNERIARELKKIVDDLRRVKEEEKLKEIEKKLEEDLERAARENRRILEELKKISEDVARENKEVLDRIKERLDRLAKDVEDRNAERRVLEEVRKEVEKVLREIEKSLRDHERENKRLLEDIERSLRELEKTVEKLKRDIRR

SEQ ID NO: 9559 - protein, 181 aa, Artificial Sequence; identical to SEQ ID NO: 9558
  Synthetic

SEQ ID NO: 9560 - protein, 181 aa, Artificial Sequence
  Synthetic
SAREALKEAVKEIERIVREVHDRNRRASERSEKIVRDVHRRNKKLTDESKDLVDKARRIKEKEKLDELLKELEERSKKVAKENEDIRREIEKLSEDVSRENEKVLEKIRRDLERLRKDVRDRNVDKRVLEEVAKRVEEVLKRIKDSLEEHRRVNDKLLKDIEKSLRDHERANEKLLEDLRK

SEQ ID NO: 9561 - protein, 181 aa, Artificial Sequence; identical to SEQ ID NO: 9560
  Synthetic

SEQ ID NO: 9562 - protein, 179 aa, Artificial Sequence
  Synthetic
DELEELLKRIEDVIRRVEELLDELLERHRKVSKESNERLEELLRRHEKVSEEVKRENAGDERFKRTVDRLNDELRKKVKKLKEDDEKRNKELADDVKRLKEELRETLDRIRKEVEKLEPTEEVEKRVREVLKEIEDRAREVEKRARDSVRRNREELERLERDVRRSLKKLRDDLERMRR

SEQ ID NO: 9563 - protein, 179 aa, Artificial Sequence; identical to SEQ ID NO: 9562
  Synthetic

SEQ ID NO: 9564 - protein, 183 aa, Artificial Sequence
  Synthetic
SKVEKLLEDIKKLVKEVSDKIEELLKRLHEVVREIAKAVRDLIRENKRVVDDIVKKVRERGVPEEDLKRLEDRVEKSIRDLEEKLRDLKRRHDESTKRLKERLERAERRVKKLLDKLERRGDNGKEAEDDARRIIEEIERLLREVKKYIEEHIKRLRTVLKKLAEDSKKHLDELRELLRRLEK

SEQ ID NO: 9565 - protein, 183 aa, Artificial Sequence; identical to SEQ ID NO: 9564
  Synthetic

SEQ ID NO: 9566 - protein, 186 aa, Artificial Sequence
  Synthetic
SELETLLTDVERLLDESRRVAERVLKEVKELLDEWEKRHKELADRIRELLRRVEEEMKRANLDEEMKKRLEDELRRVDEKIKERDEDVKREKRRIEEKLERIKERSDREEKRVRKRLEDLRRRDLKDEEVRREATDLRREIKEHTDEVEKKLEELAREIEELLERSERSAEELRKEIEKLLEEIRR

SEQ ID NO: 9567 - protein, 186 aa, Artificial Sequence; identical to SEQ ID NO: 9566
  Synthetic

SEQ ID NO: 9568 - protein, 178 aa, Artificial Sequence
  Synthetic
SEIEKLLEDFKKRIEDIKRRLERYLEEVRKRVEKVKRELERALEESKRTVDEVKKEIDRAPPTEELRERLRRLKEEHRRRIRELEERLKEENRKNEERNRELEKELEDEARKVEEAEKRANASDEVRKEIRKLLDDIRRVVEKVKRDNERLNRDLNRRVREVIRESEKLNKRLEEAVR

SEQ ID NO: 9569 - protein, 178 aa, Artificial Sequence; identical to SEQ ID NO: 9568
  Synthetic

SEQ ID NO: 9570 - protein, 174 aa, Artificial Sequence
  Synthetic
SESETLEKELKELKEEADKLIEDIRRRLEEVARRVERNVTESERTLEELLRRAREKKKRRPQDREVEKELTEYRKELEKNREKSERDIRRVKEKLDEIEDRLRERLKRVKDRLDKVDVDRRVKEEVKRVLEEIERALRTVLKEVRDLLKRLEELHREVLDKNRRVLKAISDEAK

SEQ ID NO: 9571 - protein, 174 aa, Artificial Sequence; identical to SEQ ID NO: 9570
  Synthetic

SEQ ID NO: 9572 - protein, 174 aa, Artificial Sequence
  Synthetic
SEDEKVKKDLDELRDRVRKNIERIRRKLKKLLDEARDNVRRSEETLRRLARRVEKIKKDKPRDEEVREELERYEEELKRNKEESDRKLEKVREDLKKNLEESERRVRDFERRLRELDIDRSVKEELRRVLEDLKRLHEEVSKRVEDALREMKELHDRVLKRNKDVLRELKERAQ

SEQ ID NO: 9573 - protein, 174 aa, Artificial Sequence; identical to SEQ ID NO: 9572
  Synthetic

SEQ ID NO: 9574 - protein, 178 aa, Artificial Sequence
  Synthetic
SLEEIVKDILRRIKTKADEIKEKVDRSLREIEELVKEIKKEVDDSLRDIERVAEELRREGREDEKMRRKLEKDEERNKRTLDEIERKVRKLNRDNEEKNRETKEEVDELEKEVREIERKANLDERLLRDVRRILEELRDLVRRLHEDNKRLDEDLNRKVEKLKRDNEDLNKKMRDRAE

SEQ ID NO: 9575 - protein, 178 aa, Artificial Sequence; identical to SEQ ID NO: 9574
  Synthetic

SEQ ID NO: 9576 - protein, 179 aa, Artificial Sequence
  Synthetic
SEKEEADKKLKKVMDDLREILRRLLETLKRVIERSEEVLKRLDDRNREVLEEIKRAIERLDRREDEIRTVEEELRRNDERVKEDLTRHKRELEETEKEVRRTLTKVDEELKKIEDEIRRGDRDEKEAEETVRRMKELVDRIRKKAEEDVKKLREDSKRTADRSKKNVEDLKRRLDELAK

SEQ ID NO: 9577 - protein, 179 aa, Artificial Sequence; identical to SEQ ID NO: 9576
  Synthetic

SEQ ID NO: 9578 - protein, 178 aa, Artificial Sequence
  Synthetic
SEIEELVRRLERKLEEHKKMVDKYREDLKRTLDRVNELSKDYIKKLRDILEKAERLVRRGELKEEVVKKIEDELKKLNEEYEKRVRDVERELRKLNDDVRKLHEELEKDLRREEEDVERKGTSEDLRRIAERVLREAHRTAKDLHRDSERVREEIKKSVDRVHEESERVLREIRKLKK

SEQ ID NO: 9579 - protein, 178 aa, Artificial Sequence; identical to SEQ ID NO: 9578
  Synthetic

SEQ ID NO: 9580 - protein, 183 aa, Artificial Sequence
  Synthetic
SIEEEVRKIVDDIRRSSEELEKSVKRVVEEIAESSKEEKDRVKRNIEEIRKEIDKLRRDGADERVKEKLDRNLEESRRRLEEYEKKLRDELRKAKKELDDYKRDLDRRLKEAEERLRDVKDRIDKDVLEKLKRLLDKVVRDSEDVIRKLEERLKKVVDESKEVLKELEELHERVMREVEETIR

SEQ ID NO: 9581 - protein, 183 aa, Artificial Sequence; identical to SEQ ID NO: 9580
  Synthetic

SEQ ID NO: 9582 - protein, 183 aa, Artificial Sequence
  Synthetic
KIEEDIRRELTKILDKLRKLLEKAKKNVEDIERSSRDLKRRVDETIEKIKDELRKLERDGDTDEMERRLRKKLREVEEELKKYEEELRENLKRSEEELRKVKKDLEDELRELEDRLEKIRDRIDEEVLERAERELRRVMKEVEKVLREIEELHRRVAETSKRVIDELRRLLEKVFKEFEDAVR

SEQ ID NO: 9583 - protein, 183 aa, Artificial Sequence; identical to SEQ ID NO: 9582
  Synthetic

SEQ ID NO: 9584 - protein, 182 aa, Artificial Sequence
  Synthetic
SEVDEDLKRLEDRVREYEDRVREDIRRLEEDLKRLRKRIEDSIEEMRRTLEEVKEDVRREGPDDRLREELRERNERHRDELRREAERVEKKLRDMKRKLERSHEEVKKELEEVRKKAKKDNLDRDRLTKLREVLERLEKRIREIDEEIKRVLERVEKEIRDALRKIEKVNEDVEKALRDILR

SEQ ID NO: 9585 - protein, 182 aa, Artificial Sequence; identical to SEQ ID NO: 9584
  Synthetic

SEQ ID NO: 9586 - protein, 181 aa, Artificial Sequence
  Synthetic
SLEEEIEKVIRKLKEVVERINERNKRALDKLRKVVEEVKDALRRTNEELKKVVKEVERRGAVDERVREETKREEERSEDKLREEDEKLKRVEETNRRDDKRTRDELKRVRERLEEKKRRGGDKDDVRRLKREIEELIKRIDDKIRKLIRRHEELVREIREELKKHEERVKDVLRKLEKLAE

SEQ ID NO: 9587 - protein, 181 aa, Artificial Sequence; identical to SEQ ID NO: 9586
  Synthetic

SEQ ID NO: 9588 - protein, 171 aa, Artificial Sequence
  Synthetic
SEVEKLKKEADEESERNKDEVRKLEKESKENADRIRRHLEEHLKRSDENVKRVKDAKLPKERAREELERHLRRTEDNLRRIKEHLKRHLKKSEEDLRRSDKRLRELKKELEDRIKSEEMLRRLEELLRENKKRNKEVLDRDRELLRELDEEVDDVLRRDKELLEELERRLK

SEQ ID NO: 9589 - protein, 171 aa, Artificial Sequence; identical to SEQ ID NO: 9588
  Synthetic

SEQ ID NO: 9590 - protein, 182 aa, Artificial Sequence
  Synthetic
SEVDEVLERIERLADDNRRKAETVLRKIARLLEELKKHSEDVNRKIKELVKELEDEVRRAGVPRDDVERVLREIEELSKRHREEVKRNEERIRRELEKLERETRKLLEEIRRELDKLKKRNLDRELLERVLRRVEKKSEDHKRKLEEAERRVDKNREDHERRNEELLRRVEERVEDVKRRIK

SEQ ID NO: 9591 - protein, 182 aa, Artificial Sequence; identical to SEQ ID NO: 9590
  Synthetic

SEQ ID NO: 9592 - protein, 185 aa, Artificial Sequence
  Synthetic
DEVKEVLKRIKDLLDELRRHSEKVNRDVERLLEELARNSEKVNREIRRLLDDLRRLVEEKSTDEEVEDELRRAEKEVEEKNKRHKEELERNRETVKRKNEKHRDEVRKVEEDVRRTLEKIERDQLGRDDLERILREVDKKIKDLKRENERMLEEVERNAKEHKDRDREELKRVKEDLDRLRERLR

SEQ ID NO: 9593 - protein, 185 aa, Artificial Sequence; identical to SEQ ID NO: 9592
  Synthetic

SEQ ID NO: 9594 - protein, 178 aa, Artificial Sequence
  Synthetic
KDAEELEKEVERESRKNEESIRRIREEVDKLSKDNDRKLKEIEKEVEDLRRRVDERRKRPGGEEFARKLIKELRDRLKEIAERIEKTNRELKEKLERIAKEIEDLKKRNREELKRLEEEKRGDEKLLDKIRKVVKENEERMDKLLEDIERVVRENIKKNKEVLERARRVIERLEEKIK

SEQ ID NO: 9595 - protein, 178 aa, Artificial Sequence; identical to SEQ ID NO: 9594
  Synthetic

SEQ ID NO: 9596 - protein, 178 aa, Artificial Sequence
  Synthetic
DEDKKLEKDVRDKSEDNKRRLEEIKKKVEDASRENERKIEEIKRRVEEKAEEVDRARKRPGGEKRLKDLIDDLRKTLKEIEEEIEKLKRDNEERLKDIRREIEEINKKLEDDLERIRRAKKGSEELLKTATELVTRNRTENERVLREAERVVKENLRRMDELLKDIRRVIEELERRIK

SEQ ID NO: 9597 - protein, 178 aa, Artificial Sequence; identical to SEQ ID NO: 9596
  Synthetic

SEQ ID NO: 9598 - protein, 175 aa, Artificial Sequence
  Synthetic
EEVERSLKKLEDDIRRIERELEEMVRKSKREIDKLVRDLEEMLKDSRRKLEKLRKDNITSEEARRSLEKHNRELEKVLEDLERRSRRHKEEVDKLLKDLKKKLDDLRREIEELRRRGVSEEAIRELERLLEELLRKIEEVIKDLRRLNKELDEEIKRVIDEARRLNKELEDDLRR

SEQ ID NO: 9599 - protein, 175 aa, Artificial Sequence; identical to SEQ ID NO: 9598
  Synthetic

SEQ ID NO: 9600 - protein, 178 aa, Artificial Sequence
  Synthetic
SKVEKILKDIKRLLDELRKKLKEVKDRLDEINEELRETLKRSLDRNRKINEELKDKLRRRNAPEDVDEESKKHLEDVKRKIDEIRKRSEEHRKRVEDEIRELEERLKELLKRARDVVREGRVGDEVLKRVEEEIRRLEEELDRTLERSKREVEKIKREIERTNRESERAVKEIDDRER

SEQ ID NO: 9601 - protein, 178 aa, Artificial Sequence; identical to SEQ ID NO: 9600
  Synthetic

SEQ ID NO: 9602 - protein, 178 aa, Artificial Sequence
  Synthetic
SKDEEVLKTLRRILEELRDVHRRNLEDNKRITDRLREIHERNLRDNRRITKELEEVARRDGASKEEVDRLRERSEEYLRRLEEHLKRLEEKSKRYLDDLKRHLEEVDKRVRELEREIEREGAGDEKREEVKKEVDETRERNERKNRRSREDVKRVEDRNRDANRKSRKEAEDVKRRLT

SEQ ID NO: 9603 - protein, 178 aa, Artificial Sequence; identical to SEQ ID NO: 9602
  Synthetic

SEQ ID NO: 9604 - protein, 178 aa, Artificial Sequence
  Synthetic
SKVEEVLKRLREILKELEEVHKENKDDVKRILRDLEKTHKDNLDDNRRITEKLKRVVERDGLGEEVKEDLERRSREYLEDLERHLRELKRRIEEYEKELDEHLERLREEVKRIEEEIKRRGAGDEEREKVERRAKEARDRNKRKNERVKEEVKRVKDRNKKKNDESKETVRKIEEDAT

SEQ ID NO: 9605 - protein, 178 aa, Artificial Sequence; identical to SEQ ID NO: 9604
  Synthetic

SEQ ID NO: 9606 - protein, 175 aa, Artificial Sequence
  Synthetic
SDSERILKDIEDKLREIKKRSDDNRRRLEKENREVEKRVREILRRIEEENKDVEREDKRRDEVLRRLERRYDDLRREIRETLERLEKRYRDNEEELERLLEEVERRVKKILKELDEKGVEEKVKRDLEEALKTLRKVAEDNKKSLRESLETVKKLLEDLERELRKSAESVRRKMK

SEQ ID NO: 9607 - protein, 175 aa, Artificial Sequence; identical to SEQ ID NO: 9606
  Synthetic

SEQ ID NO: 9608 - protein, 175 aa, Artificial Sequence
  Synthetic
SESEELLKRAEDEVRKVEKKSRDNERRLREKLKKAKEDLDRIDEDIKRLNKELEDRNDKDSRVLKRARDEYRRIRREIEKLLEDLERDVKRNEDDLKRDLDRLEESIRKLKEDMDKAGLEERLRRELERILEELRELVRRNEEELKKIMKRVREEVEKLLRKLEKSLESVDRKVT

SEQ ID NO: 9609 - protein, 175 aa, Artificial Sequence; identical to SEQ ID NO: 9608
  Synthetic

SEQ ID NO: 9610 - protein, 180 aa, Artificial Sequence
  Synthetic
SRDEKAERMVREVEKKIKELIDRNRRVTEKVKEDIKRLIEDLERVTRDVSRAIKELARRLRDTDLRRLEEELRRIEKSSRDVLRKLEEELRRLSRTSEEYLRRLKERLDELRKEVEDIKRKKDIKEEDDKRIEEDLRKLEEDSRRYDEDLKRELERLRKEVEEYKKRMREELRRLKEEAD

SEQ ID NO: 9611 - protein, 180 aa, Artificial Sequence; identical to SEQ ID NO: 9610
  Synthetic

SEQ ID NO: 9612 - protein, 180 aa, Artificial Sequence
  Synthetic
SELERATKVVKRVADRIAELIRENARVTKRVADESRKLLEETETVTREVMRAIEELLKRLRGERAKKLKKLLEDIRRSSEEVLRKNKKDSEELKRTSDEYLERLRRKLEKLKDEVRKIKAENSIREEDLKKLEDDLKRAADESKKYDDDLRRKLDELRRRHEEYKERLKEMLKRLEDETR

SEQ ID NO: 9613 - protein, 180 aa, Artificial Sequence; identical to SEQ ID NO: 9612
  Synthetic

SEQ ID NO: 9614 - protein, 180 aa, Artificial Sequence
  Synthetic
SELEDARRVVKRVADRIKRLIEENERVTKEVKEASEKLLKDTKDATRRLAKEVKELVKRLRGKDVEELKRRLEEIKRSSDKVEEDNRRESERLRKTSEEYVDELRKELERLEREVKEIEERNNIDEKDKKRLEEELERLRESSERYDERLKRELERLEEEHRRYIRRLKEELDKLREDTD

SEQ ID NO: 9615 - protein, 180 aa, Artificial Sequence; identical to SEQ ID NO: 9614
  Synthetic

SEQ ID NO: 9616 - protein, 184 aa, Artificial Sequence
  Synthetic
SEVEELIKDIRRHNTRLEKRMREILEDLKRHLKRSEDKMRKLVKELKELLDRLRDIARDGELKEEVLRRVREELRRVEEELKRTLERNKEKLEKVREDLERELRRDRKKNEELRKEIEKVRKDIDEKLLKELEDVIRENEKRSRDIARTLEKALEELRKASKELIDTARDILRKVLEDVDRLRQ

SEQ ID NO: 9617 - protein, 184 aa, Artificial Sequence; identical to SEQ ID NO: 9616
  Synthetic

SEQ ID NO: 9618 - protein, 179 aa, Artificial Sequence
  Synthetic
SEVETSAERLKREVEKHHKEVEEYIRRLEEELKKMTRDVERALEKIKEDVDRLRKEQKSKDELDETVRDLERKIEELKRKLEKKLEDIERSSREVLDRTRRKLEELEREVKKLEDEINTDEELLKRLRDVLEEVSRRIKDNLEELKKVSERLKRRIEELIRRLEKVMRDVRRSAEEIKR

SEQ ID NO: 9619 - protein, 179 aa, Artificial Sequence; identical to SEQ ID NO: 9618
  Synthetic

SEQ ID NO: 9620 - protein, 179 aa, Artificial Sequence
  Synthetic
KEVEEDIERLKRILEKHHKDIERAIRRLEEKLKRLEDKLRKYKRDLEEEVARLKDEQRSEELLKRSVEKIKRSSEELKKEIRRLLEEIRKEIEDLKRKTKEVLDRIRREVEDLERRINSDEKVLRRLKEVLREIEERIRRNKEELDKALERVKRTIERLIRELEKLSERLKRIADEIAR

SEQ ID NO: 9621 - protein, 179 aa, Artificial Sequence; identical to SEQ ID NO: 9620
  Synthetic

SEQ ID NO: 9622 - protein, 179 aa, Artificial Sequence
  Synthetic
DEVDEIVRRLRETVDRHHKRIKEAIEKLKEEVKKHHREIEEYIRRLEEEVKRLADEQKDKDSLTEELKRIEKSSKELEDKSRDKLRKVREEIEEMKKRTEDTLKRLKEEVEDAKRRINTDRKLLEKLDRVLKKLEEDIRRNKEALDRALREAEKSLTDNIKELRDVSREIAERIKEITR

SEQ ID NO: 9623 - protein, 179 aa, Artificial Sequence; identical to SEQ ID NO: 9622
  Synthetic

SEQ ID NO: 9624 - protein, 175 aa, Artificial Sequence
  Synthetic
DEKEKVIEDIKELLKELEKKLEDIIREIEKELKRNDEENEESRRRIEDMLRRLEELKRRSDVEERVKKEVEDTLRKLKREYDERDRENRERLKRILEEMREDVKDLREKLRKLRKDLKGTEDVDRVLREAERRVREILKELEEVLRRAEERSEENLRSAEKVLREVEKRLKELTD

SEQ ID NO: 9625 - protein, 175 aa, Artificial Sequence; identical to SEQ ID NO: 9624
  Synthetic

SEQ ID NO: 9626 - protein, 175 aa, Artificial Sequence
  Synthetic
SEEERIIKRIKETLEDLKRKLDRIREEIERDIRRNNKKNEDSIRDIERMLRELRRLFEESEVKEKVVEDVRRRLKRLKEEYRKTDEENKERLKRILEEMEELVKRLRDELEDLRRKIRGTKELKEVLEEAKKTVDKILRDLEELLRRAEEESRRNLREAEEVLKKVREDLERLAT

SEQ ID NO: 9627 - protein, 175 aa, Artificial Sequence; identical to SEQ ID NO: 9626
  Synthetic

SEQ ID NO: 9628 - protein, 175 aa, Artificial Sequence
  Synthetic
SEEEEVIKEIKDALRDLRRRAEELMKELRELIRENNERNKESEREIRRLLDRLRDLKRRSEVKEEVVKTVRKELEKLKREYEKLNEDNERKLREVAEAVRKLREDLERILDRLRKELEGTEEVKRVLDDAKRAVEEILARIKELLDEVRKASKENLERAEELLRDVERELDRLTK

SEQ ID NO: 9629 - protein, 175 aa, Artificial Sequence; identical to SEQ ID NO: 9628
  Synthetic

SEQ ID NO: 9630 - protein, 178 aa, Artificial Sequence
  Synthetic
SEVERLIEDIRRANEELNRKSERKSRESKKENDRLNRESDKKSRDSERVLEELRRRNITSKDLRKKARELREDHRRYLERLKRALEELARDHERYLRELDEALRRLLTRVRETERRITDEELVRRLDELLKESETNVRDNKRRVRDNLRRTEENARRNLEKVKKNVRKIDKVIKEIET

SEQ ID NO: 9631 - protein, 178 aa, Artificial Sequence; identical to SEQ ID NO: 9630
  Synthetic

SEQ ID NO: 9632 - protein, 178 aa, Artificial Sequence
  Synthetic
SEVDETARKLDEDLKRLEEEVRRTSKESEDENRKLNETSKRESDESKRRLDELRRKNITDKDLREDLKRLEDRHRKYKEDLDRELRRLEEKHKEIIKKLRRSAEELERRMRELARRITDERVLRKLKDLVEKVKRVIEKLVKELEDNVKKTKDNARRNKREIEENARRIREEIKKLED

SEQ ID NO: 9633 - protein, 178 aa, Artificial Sequence; identical to SEQ ID NO: 9632
  Synthetic

SEQ ID NO: 9634 - protein, 178 aa, Artificial Sequence
  Synthetic
SEVEKEADEVRRTNEELNRRSEETSRRSEEDLRRLEEKVRRASKKSEDDLRRLKRENITDKELDKSLDELRKEHEKIIKELEDTARRLKEEHRKYIEELDKALKELDDRAKESERRITDEEMVKRLRDVVKRSRENIEENKRRIEDNLRRIDEVIRRLIEELRRNMRRIEEEIERIRR

SEQ ID NO: 9635 - protein, 178 aa, Artificial Sequence; identical to SEQ ID NO: 9634
  Synthetic

SEQ ID NO: 9636 - protein, 184 aa, Artificial Sequence
  Synthetic
SEVEREIERLEEDLDRLRREVDEAHKRSKKKLEELRKEVEDYEERVKEELRRLEKLVREGRVDERDLKRVRDELHESSKRVLDRLKRALEKLEEEYKKLLEKLRRSLDKIREEVERLERELKDSPEEVRERLERALRKAEKDVKRLEDELKRSLKEVRETVRELEERLREVNERVEELLDRLRK

SEQ ID NO: 9637 - protein, 184 aa, Artificial Sequence; identical to SEQ ID NO: 9636
  Synthetic

SEQ ID NO: 9638 - protein, 186 aa, Artificial Sequence
  Synthetic
RVEDRVRDLIRKHDETSREIEKRIRDSIKRLADVLDKIRKAIDDLIRKLREAVEDLLRKIGKDDEDKARELKEEVDRAIERLRRELERLKREVERIIEKNEEILRRLREESERVKRELDEARRRKLSEKEVEDLARKIEKLNEDLRRRLEKLDKENKDVIRRLEDALRRLAEEIKRLIDELRERAR

SEQ ID NO: 9639 - protein, 186 aa, Artificial Sequence; identical to SEQ ID NO: 9638
  Synthetic

SEQ ID NO: 9640 - protein, 171 aa, Artificial Sequence
  Synthetic
KDEDRLRDDIRRAIEEIEEKLKRLKDRNKEHIERLKKRNEDLNRRNRDVVRRLRERDTDEKEIEEAMRRTRKEHKKALDDNRKSLKESEDELRKAEEDLRKTLEDLDRKLRAEPRTEELEKLREDLRRVIERVEREIRRSSEENRRVVKKSVDNIRDSLRKNEDVIRKLRK

SEQ ID NO: 9641 - protein, 171 aa, Artificial Sequence; identical to SEQ ID NO: 9640
  Synthetic

SEQ ID NO: 9642 - protein, 181 aa, Artificial Sequence
  Synthetic
DVEKKIKDLARELREVIDDARRKNRKLHEDAREVSERHEKAVRDLTEELKRVIDELRKRNIDEDTLRERRKRIEEEIRKVEKDNEDILREIKEDNEEIDRKLDEELKKLEEDIKDLERRKVPEDMLREVEKRVKEEIKRIKDDLDEVRKRHEKKVRDIRKHLKELEDRIKKTEKDLREEAR

SEQ ID NO: 9643 - protein, 181 aa, Artificial Sequence; identical to SEQ ID NO: 9642
  Synthetic

SEQ ID NO: 9644 - protein, 181 aa, Artificial Sequence
  Synthetic
RVEEEIERLSRDLKRVIEKAKRDNDRLHKEVRKASEDHKRENKRLHEDVKRVIEELRKRNIDEETLRKTMEDIERKNREVDKRNEERLREIERENREIDERLKEKEERIRRRIDDARRRKVEERMLKKLEDEIEETKKDIEREIREIDKRHKDAVKELRDHIRELAREHEEEKKRLEETAR

SEQ ID NO: 9645 - protein, 181 aa, Artificial Sequence; identical to SEQ ID NO: 9644
  Synthetic

SEQ ID NO: 9646 - protein, 181 aa, Artificial Sequence
  Synthetic
RVEEEIRRLLEESERVHKELEDINRRLHEKVDRVSKKHREENKRLHEKLKRAIDRLREKNIDEDTLRRKEREIKKRNDRVDEENRRTKKEITDKNRRIDEEIKRNLDENRKRIEDVKRRNIPEEALKKLEKEVKDNERKLREEARRVEEEHEKTVRDLKKHLDELREEHDRILEELERTRK

SEQ ID NO: 9647 - protein, 181 aa, Artificial Sequence; identical to SEQ ID NO: 9646
  Synthetic

SEQ ID NO: 9648 - protein, 173 aa, Artificial Sequence
  Synthetic
SDMEKRKRDIKRKLDESNKKSEEAVREVERKLDESNKEVKKKEERVEDELRKLEEKRRRGSGEELLRRVKELEDDLRRKLKEVRDRHDRLRRELEKILEKLKEDHKRIVDELKKGPDDEKLKDIERELRENLKRNEDIVREILKKLEDNLRRVEKLAEDIRRKLEKVADDLRK

SEQ ID NO: 9649 - protein, 173 aa, Artificial Sequence; identical to SEQ ID NO: 9648
  Synthetic

SEQ ID NO: 9650 - protein, 171 aa, Artificial Sequence
  Synthetic
SELEEDKKRIEETLRRLEETAKEYHRRSREELRRLEEEAKRYHEESKETLDRLRRENITSEELRDTIRRLEDRNKKLLEKLKKDIDEHKRRNEELMRRLRKTIEDLKRELDKGPDDKKLKDIKEEVERVMKKLEDLVRRDNEESEKVLEKLKRLVERNNEDIKRALEELRK

SEQ ID NO: 9651 - protein, 171 aa, Artificial Sequence; identical to SEQ ID NO: 9650
  Synthetic

SEQ ID NO: 9652 - protein, 171 aa, Artificial Sequence
  Synthetic
SEDEERLRRIEEELRRLEEEAREYHERSREELKKLREKAKEYHERSRRELEELRRRNITSEELRKKIEEHRKRNEDLLRELKRTIEELEKRNRELLKKLREDIKRLRDELRKGPDDKRLKEITRKVEEVMKKLEKLVRDNNEEIRKVMEELKKLVEDDNEESDRALKELET

SEQ ID NO: 9653 - protein, 171 aa, Artificial Sequence; identical to SEQ ID NO: 9652
  Synthetic

SEQ ID NO: 9654 - protein, 171 aa, Artificial Sequence
  Synthetic
DEMETRLEDVRKKLDDSRRETRKVEEDIRRTLEELRREAKKYHEDSKEELDDLRRRNITSEELKETIKRLEDRNRKLLEDLERKIREIEKTLEDYLRRLEERIDKLRRELDKGPKDEKLKEIKERIEKVLRENRDVVKKIKEDVRRALKELEELVRKNNEDIKRLLDELRR

SEQ ID NO: 9655 - protein, 171 aa, Artificial Sequence; identical to SEQ ID NO: 9654
  Synthetic

SEQ ID NO: 9656 - protein, 172 aa, Artificial Sequence
  Synthetic
SRVEEVERRVRDKSRKSKEKLRKLEEDVRRESETSRDRLRKLAEEVKTKVKELKDKRVPKEEVEERVRRIERRLEETLKDLRRRYEEVERRLKKALEDLRREHEKVKDELRRGEIDSEDLKRLAKEIEDNLEELERKIREIRKELRRSLEEVEKTVEDLKRELKKVLDELRK

SEQ ID NO: 9657 - protein, 172 aa, Artificial Sequence; identical to SEQ ID NO: 9656
  Synthetic

SEQ ID NO: 9658 - protein, 179 aa, Artificial Sequence
  Synthetic
SDIEEAKERLERKLEKLLRKVEEYLKEIADEIRRLEEELEEYNRRSKERIDRVLEVKERGEADRRVIEEEIRRMKRRNEDLERKVEKKLRELEKRNEEVKRDLEEAKKKIKKEIDELRERGVDESVLKELEELLKELEDRIRKILTESTELLRRLEKRVRDSLRRNTEELDELLDRLEK

SEQ ID NO: 9659 - protein, 179 aa, Artificial Sequence; identical to SEQ ID NO: 9658
  Synthetic

SEQ ID NO: 9660 - protein, 179 aa, Artificial Sequence
  Synthetic
SEVEKSEKKLRDEIERLVRENEKYLERIKELVEELLRELEKAVRELEKEVTEIEEVKRQGNVDKRLIEDLIRRIRKKIEDLRRKVKKAVTDLKRANDEVRRKSEEDLRRIEEEIKRLEDRGVEERVLKKLRDLVKEVVDRSKRSLDESTKVLDTLEKEVRKVLEALKDILREALERLDK

SEQ ID NO: 9661 - protein, 179 aa, Artificial Sequence; identical to SEQ ID NO: 9660
  Synthetic

SEQ ID NO: 9662 - protein, 181 aa, Artificial Sequence
  Synthetic
SREEIIKKLKEEVERLLRESAKVLEELKRRLEALLRESEEILRELRELVRTLLEKLERDGLDRRDIDKIRRDIERREREWEKETEDTRREIEELERRWRRRLEETRKRLEDIEERLKKEEISEKDLKKTEDDLKREADEHRKAVEDELRKVKKRLEEHRERVRKRLEDIEKTLRDIDREVR

SEQ ID NO: 9663 - protein, 181 aa, Artificial Sequence; identical to SEQ ID NO: 9662
  Synthetic

SEQ ID NO: 9664 - protein, 181 aa, Artificial Sequence
  Synthetic
SSVEDLLRKAEEVVRRAEEKSRDSHEKTKDVLRKVKRKSEELNKHNRESIKKVEEVRRRTDDKRVLEKVLEDIERNSRDAVRKHKRVLEELREVVRRSEETNRKILKEVRRVVEEVIRRLREEGAPEEVLKTIEDLLRKLERKVRETIETDRRLLRKVEEELKRSIEDSRRLVDELKKRVT

SEQ ID NO: 9665 - protein, 181 aa, Artificial Sequence; identical to SEQ ID NO: 9664
  Synthetic

SEQ ID NO: 9666 - protein, 181 aa, Artificial Sequence
  Synthetic
SSKDRLRDEIRRVVERVREISERVNKHNRDSVKRVEEESRRINKEIRKVVEDVDRMRRRVTDERVVKELVKTLRDVVRKVVEKHKKAVKEVRDNSKEAEEIHKKALDELREVARRVIEMLRKDGVPEEVLREIEKLVRDVEREVRESIERSKRLVKELEERVKKSIDEIKKEVDDVERKLK

SEQ ID NO: 9667 - protein, 181 aa, Artificial Sequence; identical to SEQ ID NO: 9666
  Synthetic

SEQ ID NO: 9668 - protein, 181 aa, Artificial Sequence
  Synthetic
KEVEDLKEKVKRVVEEVEKISRELNKHNRDSVRRAEKTSKELNDHNKDSIRKVREVLKRTTDKRLLEKVLRDIKENSDDMVRKHEKVLDEVRRNSDDVVTKHKKALEDLKRMAEEVERELEKAGAPDKVLKDIKKLLKDVEKKVRESIKESKELVKRLKDKLEESIRRSKKDVEDLKREVD

SEQ ID NO: 9669 - protein, 181 aa, Artificial Sequence; identical to SEQ ID NO: 9668
  Synthetic

SEQ ID NO: 9670 - protein, 181 aa, Artificial Sequence
  Synthetic
SSVDKLRKEIREVLRRVERISEESHKHNEESVRKVKERSERLNKHNRDSARDVERVLREVTDERILRTILRKVTENSKRAVEDHERALEEVRRNSEDVERKNRKALKELEDVVREIEDRLRKEGAPEEVLEEIRRRLEEVEERVRRDLEESKKLVDELRKRVEKSIRESRKLVDDLRKRVT

SEQ ID NO: 9671 - protein, 181 aa, Artificial Sequence; identical to SEQ ID NO: 9670
  Synthetic

SEQ ID NO: 9672 - protein, 181 aa, Artificial Sequence
  Synthetic
SSVDKLKDEVRKVVETVKDLSRRLNETAKRVADRVRKISRETHEEVRKVVEDVKDVRRRTNDKRKLEKVLDELREVIKEAHKKNEEVLDELRRVVKRLEDEHRKALEDLERVIRRVIKELRREGADETVLEELKRLLDKVREDVRRSIEEIRELLKTVEKEVRDDSRDLERLLKRVEEETK

SEQ ID NO: 9673 - protein, 181 aa, Artificial Sequence; identical to SEQ ID NO: 9672
  Synthetic

SEQ ID NO: 9674 - protein, 181 aa, Artificial Sequence
  Synthetic
SSVDRVREEIERVARRVRKLSEDSHREVEKVLKEVEEISKRTHEEIDKVVKEVEKVIRDTTDKRELRKVVDDLRKVAEEAHKKNEDALRKLEKVVREVMTKNRKVLEELRKVVKEVIEKLEREGAPEEVLEEIRRLLETVEREVKTDIDRLREELRRVEEAVKKDSEDIRRKLKRVEDDVK

SEQ ID NO: 9675 - protein, 181 aa, Artificial Sequence; identical to SEQ ID NO: 9674
  Synthetic

SEQ ID NO: 9676 - protein, 183 aa, Artificial Sequence
  Synthetic
REAEDIVRRSHELVERAREKLRRLNKDSERLVDEVEKELREVVERVAELIKRAKDEIGTEDDKVRKAVELLERVLREVKKVVEELLRKIRKVLRDDHESVREVKERVDDADRKVKKVVDEVGSVEEVLEKVLRDSERVLKELEEKLRKSLEDVKRVIDEVKKVLEDVKRKVEEVLKRVRDKRR

SEQ ID NO: 9677 - protein, 183 aa, Artificial Sequence; identical to SEQ ID NO: 9676
  Synthetic

SEQ ID NO: 9678 - protein, 183 aa, Artificial Sequence
  Synthetic
SRAEKVERESHELVRTLKEELDRVVEKVERLVRRVEEELKRVNKESAELVKELKDRIGTEDEKAVEIVKRVEELLKEDHDTVRDLLRELREVLERVRELIDRLRRRVETVDDEVRKLVRDVGELDEVLTKLVKSSRDVIEEIREDLKRVLKEAEEVIRRVKKRLEDSLEKVKEVLRELLRAAK

SEQ ID NO: 9679 - protein, 183 aa, Artificial Sequence; identical to SEQ ID NO: 9678
  Synthetic

SEQ ID NO: 9680 - protein, 183 aa, Artificial Sequence
  Synthetic
SSAEDVVRRSHELVRRLEEELDKVNEDSERLVREVEERLKRANEESKRRVEDAKRRIGTEDEKVKRLVELLEKVLREDTDTVRRLREDLRRVLEKDTRSVEDIKRKLRTVDKEVKKFVRDVGSLEEVLEEVLRRSREVLKKLKEDLKRSLDDAERVIRRVREDLKRSLKRVREVLEEVRRRTK

SEQ ID NO: 9681 - protein, 183 aa, Artificial Sequence; identical to SEQ ID NO: 9680
  Synthetic

SEQ ID NO: 9682 - protein, 183 aa, Artificial Sequence
  Synthetic
SSVDRIVEESHTRVRKLMKDLEDVNDESRRRVERLRERLEEVVKEVEKLVEELRRRIGEERREARRIVERVERALERVRDVVKKLLEELERVLKKDTESVERLKEELDKVDKEVKDLLRRVGSLEEVLKTILERSREVLDRIRKELERSLKEVEDVLRRIEKDLKKVLDEAREIIKRLLDEAK

SEQ ID NO: 9683 - protein, 183 aa, Artificial Sequence; identical to SEQ ID NO: 9682
  Synthetic

SEQ ID NO: 9684 - protein, 184 aa, Artificial Sequence
  Synthetic
SRLETVLERAKELIDRIRKLLEDVRRKVKELIDRIRRLNEEANRESEELIRRIEEELRKGKDAEEVVREVKERLERLLRRSEEVSKKSRKDLEDLVREAEKVIRDLARLLREVVREVEEVVRRDNTEDARRILEEVRKLVKELEEELRRALKEVRDLAKEVDEDSKRALDRNEKLIRDLDRKVE

SEQ ID NO: 9685 - protein, 184 aa, Artificial Sequence; identical to SEQ ID NO: 9684
  Synthetic

SEQ ID NO: 9686 - protein, 184 aa, Artificial Sequence
  Synthetic
RELEEAKKKVEDLLRRILEENERAHEESKKLIEEIRRLLKKMNEESEELRERIRKKLEENSTSDKVVREVRKEIDRLVERSERVAKRLKEELDRLLERSKKVSDDSRRKLKELLEEVEKVIRTLNSEDVERALDDVRRLLREVERRSEELLRTDEEAIRTLKKEIDKVLKENKDKADRLKEEVN

SEQ ID NO: 9687 - protein, 184 aa, Artificial Sequence; identical to SEQ ID NO: 9686
  Synthetic

SEQ ID NO: 9688 - protein, 184 aa, Artificial Sequence
  Synthetic
DELETVERRVEKLIEDIKRELRKVHEESKKLIREIKKELEDANRESERVIEEIKRELDRDKDSERVVERLEEKLRKLVRRSEEVIKELKKKLDELVKESERVARELRRKLEELVREVERVVREVNSEDARKMLEDVKKRAKDVEDEIEEVLRRDRELIKELKRELDEALRENRRLIEDLKRKIK

SEQ ID NO: 9689 - protein, 184 aa, Artificial Sequence; identical to SEQ ID NO: 9688
  Synthetic

SEQ ID NO: 9690 - protein, 184 aa, Artificial Sequence
  Synthetic
SEAEEALKRVKKAIDDARKLLEEANRKDKKSIEEAEKLLREAHERSKKAIKEAEDALDKAKTDEKAVERAREKADRAVKESEDAARRAKEIADKSLEDSERAAREAKKLADEAVDEARDAARKANSEDAEKALRDAKRLADDLKRTADEVLKENKRTAEDLKRKADEVLERDKKLAKELKEKAT

SEQ ID NO: 9691 - protein, 184 aa, Artificial Sequence; identical to SEQ ID NO: 9690
  Synthetic

SEQ ID NO: 9692 - protein, 184 aa, Artificial Sequence
  Synthetic
SELEDVKRKVKRLIEDIERALTEANKEDEKSIEETERLNRTVHEESKELVERLKDELRKRSTDKKVVEKVKKKLDDVLRRSKEVSERSKKILKDSVRRSAKVAEELKRRIDKLVEDAEKVIRDLNTEDVDEALKEVRDRAKKLKDKIKKVLDDNRRTVEDNERKSDELLKTDKELVREVKERTE

SEQ ID NO: 9693 - protein, 184 aa, Artificial Sequence; identical to SEQ ID NO: 9692
  Synthetic

SEQ ID NO: 9694 - protein, 183 aa, Artificial Sequence
  Synthetic
RELEKVRKEVERLIKEIKDLNKRAHDETKTRIDRIREKNEKVHEESKRLIREIEELLRRKGGESEEVVREIEKILDRIRRESERASEESRKELEDIKRRSKEASDRSRKILEEIRRTIEEVLREGAVTEEVIKEVEKRLDELRKESKKLLDDDRRLIEKLKEESRRLLEEDRRLIKELKEKVK

SEQ ID NO: 9695 - protein, 183 aa, Artificial Sequence; identical to SEQ ID NO: 9694
  Synthetic

SEQ ID NO: 9696 - protein, 183 aa, Artificial Sequence
  Synthetic
SAAERAAEEVKKLIDEARKLLERAHRETKKLIDEARKLNKRALDEVRRLIEEADRLLRRDGGEADEALKRAEEIAKRALDLAKRASEESERIAREAIKLSEDAARKAREIAKRALDLARKALKDGAAREEVAERARRLAEELKKEADDVLRKDRDLARRAREESEEALKEAEKLARDLRRRAK

SEQ ID NO: 9697 - protein, 183 aa, Artificial Sequence; identical to SEQ ID NO: 9696
  Synthetic

SEQ ID NO: 9698 - protein, 178 aa, Artificial Sequence
  Synthetic
KEAEDIKRKVEKVAREITEKSRKSHEELRKVVKEARDKSEKSLRDVERVLREIEELLRRRRKEDVLREVKERIEEILRTNKKVLEEVKERVKRIVDKNRRMLEEVEKRVREILKELKRDRPDSKDLIEEIKRRLDEVRRRSEDNLKKMEEELKKVEEDSRRVVERIRTELKRVEDEAR

SEQ ID NO: 9699 - protein, 178 aa, Artificial Sequence; identical to SEQ ID NO: 9698
  Synthetic

SEQ ID NO: 9700 - protein, 178 aa, Artificial Sequence
  Synthetic
SEAEKIRKDVEKVIREVREDSKRTLERSRKVDEEIRRKSETSHRLVEEVIRRAEELLRRERREEVVEEVKRRIKEIVDRNKEALDEVRKRNEDILRENDRVLERIKRLVEKILRDLKRDRDKDEELIEEIKKALEDVKRESEKVKEESRKSLEDVERDSDRNLKDMERLLREVTERAK

SEQ ID NO: 9701 - protein, 178 aa, Artificial Sequence; identical to SEQ ID NO: 9700
  Synthetic

SEQ ID NO: 9702 - protein, 178 aa, Artificial Sequence
  Synthetic
DEVEEIRKEVERVIREVEEKSKETLRRSEKVDREAKKKSDDSRRKVEKVADEIRRLLETRRDDRVLEEVARRVEAILRENEEVAREVEKRNREILKTNADVLDEIRKRVEEILKELKRDRPDDKDVIEEIRRLLDEVRRRSEKVIRDSERSAEEVKERSERVIEELKRLLEKVAREVK

SEQ ID NO: 9703 - protein, 178 aa, Artificial Sequence; identical to SEQ ID NO: 9702
  Synthetic

SEQ ID NO: 9704 - protein, 178 aa, Artificial Sequence
  Synthetic
SSVERVERDVARVAREIRKISRDTKEESKEVDRRIDEISKRTNEDVRRVAEEIKRLKEKRRRDEMLREISRKAEEIVRENEEVLEKVKRLNEEILKKNEDVLRKVAKDVTDILRRLKRERPDDKDVIKEIEDRLREVEEESKKAIEESKTSLKRVKEKSEKNVEDMKKLLEKVREDVR

SEQ ID NO: 9705 - protein, 178 aa, Artificial Sequence; identical to SEQ ID NO: 9704
  Synthetic

SEQ ID NO: 9706 - protein, 181 aa, Artificial Sequence
  Synthetic
SEVEKVLDEIRRLLKEVEERSKENNDRNEELARRNTRRSEENIRRIEELLRRVREEARKDRVPREVLKELEDRVREVLERNKEVLERLRRLHEEISRKNEEVLREVKREVEKVLEKLRRIDDEKFLREVRREIEEIIRRIKEASEKTHKEAKEVVDRINELSRKSHETIKEIIKRVRDRAK

SEQ ID NO: 9707 - protein, 181 aa, Artificial Sequence; identical to SEQ ID NO: 9706
  Synthetic

SEQ ID NO: 9708 - protein, 181 aa, Artificial Sequence
  Synthetic
REVDEVLDEIRRLLERVREESEKNNRDNEKLMRDNEDRSRKVIETIKRLLEDVKDRATKKNVPEKVLKEIEDLVREVLEENKRVLDTLRELHKEVSDKNKKVLEEVERLVTEVLKKLRDIDDEKFLREVRREIEEIIRRIRELSERTHREAKEIVDRINELSKRTLDKAKEMLDRAEEKAK

SEQ ID NO: 9709 - protein, 181 aa, Artificial Sequence; identical to SEQ ID NO: 9708
  Synthetic

SEQ ID NO: 9710 - protein, 181 aa, Artificial Sequence
  Synthetic
DEVEKVLRDIEKKLEDVERRSKEVIDEIRKLLKEVEEESRRNVKKIREELKKVVDDVRRKNVEREVLEEVKRLVDEILKKNEDVLREVTDLVRKVLRKNEEVLRTVKELIERVLDELRKIDDEKFLRDVKRMVDEILDTARELSRRTLEEIKRIIARIRERSEKSHEEARKALRDVEEKAR

SEQ ID NO: 9711 - protein, 181 aa, Artificial Sequence; identical to SEQ ID NO: 9710
  Synthetic

SEQ ID NO: 9712 - protein, 181 aa, Artificial Sequence
  Synthetic
DSVREVLKKIEDELERVKRDNKDVNRKNEELMRRNEERSRRVVEDIKRKLKELVDDVRRNNVPDDVLRELKELVERILRKNERVLEELKKLHKEVSDKNEDVLRRIEELVREILRKLREIDDEEVLKRVDEEAEKVLRENEKLSKKSLDEAREIVREINRLSEDTRREADEILERVKEKVR

SEQ ID NO: 9713 - protein, 181 aa, Artificial Sequence; identical to SEQ ID NO: 9712
  Synthetic

SEQ ID NO: 9714 - protein, 181 aa, Artificial Sequence
  Synthetic
DEVETVLEKIERLLRKLEKDSREVIKKIKRLLDEAKKESRKNIEEIKKLLEEVKREVDRRNVDDRVLDDVRRRVTEVLEENKRVLDELEKLVKRVLEENKRVLDEARKLVKEILDKLREIDDERFLREVEKELEDMLRRVRKLSEDTERKIREILERIKRLSDDSNRKAKEILREIRKRAE

SEQ ID NO: 9715 - protein, 181 aa, Artificial Sequence; identical to SEQ ID NO: 9714
  Synthetic

SEQ ID NO: 9716 - protein, 172 aa, Artificial Sequence
  Synthetic
DELEKVKEEIRRLLRRIEEDVKRSEERNKELLRRITEEVKRSERRNEELLKEIKDKVDSEILRKVEKAVEDSLRRLREVLRKVKEVVERVLETNRRILEEIKEVVERVEKLLDERDLKKVREDLERMLRRVEEELKRSNEESERAIEEVRRELEDIDRESRKAIEDVLREEK

SEQ ID NO: 9717 - protein, 172 aa, Artificial Sequence; identical to SEQ ID NO: 9716
  Synthetic

SEQ ID NO: 9718 - protein, 185 aa, Artificial Sequence
  Synthetic
SEIDEVLTRLRKISKDLNETSDRVNERARKIIDDIKKESKRVNDEAREIVERLKREIDKTRDRDVLRRILKEIEDVARRVKEINEELLRRVEKVVREVEEINRELVKRSREAVERVKRLLDERVSDKDKVERVVREVEKLHEEDRKRLEESTRSVRKLLEELKRELEKSTRSVKKLVDELRERVR

SEQ ID NO: 9719 - protein, 185 aa, Artificial Sequence; identical to SEQ ID NO: 9718
  Synthetic

SEQ ID NO: 9720 - protein, 185 aa, Artificial Sequence
  Synthetic
DEVDEMLKRAEDRIREISDTSRKVNEDARKIVEDLKRDSERVLRELRKRIEELRREIERDRDEDVVRRVERKVEKVVREVHERNKELLDRVRKVVEDVEDINRRLAEEVRRVAEEVRRALRRDADDEKRVREVAEEVKRLVKELEERLRRSTESVKRLLEDVERAVKESSDEVEKLLRRLREELE

SEQ ID NO: 9721 - protein, 185 aa, Artificial Sequence; identical to SEQ ID NO: 9720
  Synthetic

SEQ ID NO: 9722 - protein, 185 aa, Artificial Sequence
  Synthetic
DEIEEVLRDAKRISDELNRRSEEVNRELREIIKELTKRSRKVLEELKKIVRDLEKKIKDTRDKKDLDRIREEVTDVVRKVHEINKRLLEEVRRVVEEVKRINDKLVRDSERAVEKVRRLLERDVDDREKAERVLRTVEELHKEDRDRMKESTDSVKRLLEELKRRAEKSSRTVEELLRRLEEKIR

SEQ ID NO: 9723 - protein, 185 aa, Artificial Sequence; identical to SEQ ID NO: 9722
  Synthetic

SEQ ID NO: 9724 - protein, 185 aa, Artificial Sequence
  Synthetic
SEIDELLERAKKRSKELNDTSKEVLDRARRIIEEISKTSEEVNKDLERIIRELAEEIKRTRDRRVLDRIRREVRRVVKEVKEINERLLREAERVARDVHRINEELVRRSEEVVKEVEDVLRRKVDDEKRVREVLKEVRRLHEEDRKRMKESSEDVERLLTELRKRMKESTDSVEKLLKELEDRVR

SEQ ID NO: 9725 - protein, 185 aa, Artificial Sequence; identical to SEQ ID NO: 9724
  Synthetic

SEQ ID NO: 9726 - protein, 185 aa, Artificial Sequence
  Synthetic
SSLEKLLEDVRRRSEELNRRSRKVLEDLKDIIRRLKEESKRVLDEAKKKVDDVERKIDKDRRRETVKEVLERVEKVVTDVHRINEELLRRITEVVKEVHERNKRLVEESRRVVKEAEEVLRRDVDDSDKVRKALEDVRRLHEEDKRRVDESSKEVERLLRELREDMKRSSEEVERLVKRVRDRLK

SEQ ID NO: 9727 - protein, 185 aa, Artificial Sequence; identical to SEQ ID NO: 9726
  Synthetic

SEQ ID NO: 9728 - protein, 185 aa, Artificial Sequence
  Synthetic
SEADELLKEVKRISDELNDTSRRVLEELREISRRLNEDSKRVLKELEDILEEIRERIDRTRDREVLKRLLERVAKVVKEVHDINRDLVRRSREAVKRVHDINRRLVEESRKVVKKAEEMLRERVSDEERVRELVERVKELHEEDKRRMDDSSRDVERLHKEDADSARDSSRKVRELLEELRRRVE

SEQ ID NO: 9729 - protein, 185 aa, Artificial Sequence; identical to SEQ ID NO: 9728
  Synthetic

SEQ ID NO: 9730 - protein, 182 aa, Artificial Sequence
  Synthetic
KELEDVLRELKRILEELEKLSREADERSKEIVKRLVEETTRSLKEVKEIVERLKELDDAGKDRREVEKRLRDAHRKNEDTLRRSSEKLDRVLKESERVVRDSSTKLRKVLKDAEDVVRDKVEDEKRAREVRETVRKLVEDVKKKNEESERRNRELVKEVRKRNKEVRDRSRKLVKELEDKLR

SEQ ID NO: 9731 - protein, 182 aa, Artificial Sequence; identical to SEQ ID NO: 9730
  Synthetic

SEQ ID NO: 9732 - protein, 182 aa, Artificial Sequence
  Synthetic
SSLEKVLKDLRKILEDLRREIKTVLDDLRRILEELKRETERVDKKSKEIIETLSELRKAGTDSRDVDRRVKEVLEESRRAVERSSRKVKKVLEDAREVVRRIEEAADKVLKDARRVLREKVEDKKKVDEAIREVEKLIEELRRDLDRVRKTVEKLVRDLERRNEESKRRNEKLVRKLEEELR

SEQ ID NO: 9733 - protein, 182 aa, Artificial Sequence; identical to SEQ ID NO: 9732
  Synthetic

SEQ ID NO: 9734 - protein, 182 aa, Artificial Sequence
  Synthetic
DELETVLRKLEKLVRDLKKRSTDVLRRLEEIVKELTDETKRVDDESRDILRRLKELRDRGVDSREITKRVREALKESRRVIKKSSEDVERAIDEVRKMIEKSSRDVDEVLREVREVLRDKVENKEEADRVITTVEELVKELRRRNEEVKERVEKLARELRRRNEESIKTNEKEVRELEKRLK

SEQ ID NO: 9735 - protein, 182 aa, Artificial Sequence; identical to SEQ ID NO: 9734
  Synthetic

SEQ ID NO: 9736 - protein, 182 aa, Artificial Sequence
  Synthetic
STLKKVLDENRKSIKELLDMSRRVLEKLREILRRLEEETREVDEKSERIVTTLEELIKAGTDKRRIKEELDRALKESEDMVRDSSRKLEEVLEEARRVVEDSSRKLRRSLEELKKVVRDKVEDEDKAKKVIDEVRKSVKRLEEENERVLRDVERLVREVEKKNRESEKRNRKLVEELRRKLK

SEQ ID NO: 9737 - protein, 182 aa, Artificial Sequence; identical to SEQ ID NO: 9736
  Synthetic

SEQ ID NO: 9738 - protein, 182 aa, Artificial Sequence
  Synthetic
SVLEEVLKKLEKILRELKREIEEVLKKLRRILEELVRETEKSLEKVDRIIKELEKLIEAGRDKRDVEREVRRVHRENEETLRRSSEKVDRVLKEVEDVVRRIDRRVKEALREAREVVRDKVEDEKKAREVTKTVEKLIRELRKTLEDVKREVRKLVEEVKRRNKDVERKSRELVKKLEERLR

SEQ ID NO: 9739 - protein, 182 aa, Artificial Sequence; identical to SEQ ID NO: 9738
  Synthetic

SEQ ID NO: 9740 - protein, 182 aa, Artificial Sequence
  Synthetic
STLEEVLERNKESIERLRKESEDSHRKLKEIMERLKRETERSLEEVEEIVKRLKELTDEGRDKREVRKRLEEVHRKNEKTVRESSEKVERVLKENKESVERIVEKAEESLRRLAEVLRDKVDDKEKVKRVIEKAKKSVEDLERRLREDEEAAREWVKKLRTENEKVRKRSEELVRELEERLR

SEQ ID NO: 9741 - protein, 182 aa, Artificial Sequence; identical to SEQ ID NO: 9740
  Synthetic

SEQ ID NO: 9742 - protein, 182 aa, Artificial Sequence
  Synthetic
STLEKVLRDLRKILEELLRMSKKVLEELKRLADRLKEEIKKSLDKVKKIIDELRDLTRKGKDKREVEERVKRVHDENEKTLRKVIEDVRRVLKEVRDVIKESSDRLREVLERARRVVRDKVEDEDKARKVIEEVTREVRRVEEENKKVERTVEKLVEELEETVREARERSERLVRTLEEELR

SEQ ID NO: 9743 - protein, 182 aa, Artificial Sequence; identical to SEQ ID NO: 9742
  Synthetic

SEQ ID NO: 9744 - protein, 182 aa, Artificial Sequence
  Synthetic
SDAERVEKEIREVLKRVEDLLRRVNEETKKVAKEVRELLKEVDDRSREIMKRVAEKLRRISDKKTAKEEVDRVLKEIEKTLRDLKRTVEEVLKRIEDLSKKLHEDVRRVLEEVEELLRRLLERRKDDKDVAREVEKLLRELEKKLEEVNRHDKKLLEELEERLKESEERNRRLLEELKRRLD

SEQ ID NO: 9745 - protein, 182 aa, Artificial Sequence; identical to SEQ ID NO: 9744
  Synthetic

SEQ ID NO: 9746 - protein, 182 aa, Artificial Sequence
  Synthetic
REVEEVLKRIEELIRRSEEETREVNERTKKLAEDVRRLLEEVDRRSKKIADEVRELLERIDDKDTARELVDRVVKKIERTARELRKTVEDVLREIKRLSEELHKRNRTSVEDIRRLLKDVVDKRKDSKDLVRTVEELLKRNEEDLRRVNEHDKKLLEDLTRSLERSEERNKTILEKLKEDLR

SEQ ID NO: 9747 - protein, 182 aa, Artificial Sequence; identical to SEQ ID NO: 9746
  Synthetic

SEQ ID NO: 9748 - protein, 182 aa, Artificial Sequence
  Synthetic
SDAEKVLDEIRKRIEESEKRTKEVNDRTREVLDRVRKLLEKVNKESRKVAEDVREAAERIKDKEELRKTVEEVLEEIKRISERLHERVRRVLEEIKRLSDELHKRNRESVKEIRELLRELLERRKDDEEVRKDVERLLRENERSLREVNRHDEALLRELEKRLEEVNRHDDKLVKDLRERER

SEQ ID NO: 9749 - protein, 182 aa, Artificial Sequence; identical to SEQ ID NO: 9748
  Synthetic

SEQ ID NO: 9750 - protein, 178 aa, Artificial Sequence
  Synthetic
DEVREILEDVKRINKEVEDELRKIEEEIREIVKTVRDESRKTLEELERILRKVEDDLRKDRREEILKTVKELVKKIIDDDRRIVERVLRELERLVEEIKKVVDEVKRLNKELIDRLKTRNPEVEEAVKDNERLAKETEDKVREVVKRIRKIIEEVERTARESERRLRKLLKEVEDRAR

SEQ ID NO: 9751 - protein, 178 aa, Artificial Sequence; identical to SEQ ID NO: 9750
  Synthetic

SEQ ID NO: 9752 - protein, 178 aa, Artificial Sequence
  Synthetic
EEIERILEELRRIAKKVEEDSRRTLETVRRLNEEVKRRLREILEEIRRVAEDVRRKLDEKRSDEEAVRRVLEDVKKKVEDVKRRLEEVLREVEKKNRDVTETNKKILRDLEKKVRDVIRRVKSEDVKRELERILEEVRKKSREALEKNKRLLEDTRRVVEEVKRELEKILRDVKRKVD

SEQ ID NO: 9753 - protein, 178 aa, Artificial Sequence; identical to SEQ ID NO: 9752
  Synthetic

SEQ ID NO: 9754 - protein, 182 aa, Artificial Sequence
  Synthetic
SVVEELRDELRRAEEENRKIVEDTTRRLEDMIRRDEKINEEVERRLEEVTRRVEELRKQGRDKDEIVDELRRVVEELEKILRDALKDSTRVVDELRKVNEDATRISREVVRRLRKLLKDRVDDERKAREMEKEVTEILRRLEEENKRDLDRIKKLLDELRKKNEDTLRRIRRLLEEVRERLR

SEQ ID NO: 9755 - protein, 182 aa, Artificial Sequence; identical to SEQ ID NO: 9754
  Synthetic

SEQ ID NO: 9756 - protein, 177 aa, Artificial Sequence
  Synthetic
SSLDEVLERLRKLLKEIEDKVRRINEEVKKSSEDVERELKRVVDELKRRVERLKEEVRLERLIRELERILDEIKKKLDRLAEENRKILKRVNDESKRILDELRKILRELEERLRRITDERELEKILRDAERVVREIEKRHRDLLEELKKANEDTRRALDEIRKEAERVLERVREEAK

SEQ ID NO: 9757 - protein, 177 aa, Artificial Sequence; identical to SEQ ID NO: 9756
  Synthetic

SEQ ID NO: 9758 - protein, 177 aa, Artificial Sequence
  Synthetic
DEVEEVLKRLRESSEESKRRADDVTRRAEESSRRVHKRSREVVERLKKLVEEVERRVRLRELLETLRRILERLKERLEKLNEENKRILEKVKRDIEKLKRDNEEILREVEERAKRLRDRRELEKLEREMRDVDRRTDEALERLLRTLEEVNKRTDEENKKILEDLKRVVEEVEERDR

SEQ ID NO: 9759 - protein, 177 aa, Artificial Sequence; identical to SEQ ID NO: 9758
  Synthetic

SEQ ID NO: 9760 - protein, 177 aa, Artificial Sequence
  Synthetic
SEIEKVIEELRRSSEESHKRSRKVEEDARRSSDEVHRRSREMLRKLREEVKDVERKVRLEDLLRKLREILKRVEDDARRLNEENRRILKELEERLEKLNRDNKKILEDVERRLRRITDRRDLRRLREEMRRVDERTTRENEKILRELEEVNKETIKENERLLRDLKRVVDRVREEDR

SEQ ID NO: 9761 - protein, 177 aa, Artificial Sequence; identical to SEQ ID NO: 9760
  Synthetic

SEQ ID NO: 9762 - protein, 177 aa, Artificial Sequence
  Synthetic
RRIEEVIKEARKSSRESHEESKEVMERLKRSSDDSHRKSEEVLRRLRKLVEDVERRVRLRELLEELRKILKRLEEKARRLNEENKKILERVKRLLEELNDRNERILRRVEDDLRRITDDRELKKLRDELKRVDDETRKANEEILREMEEVDKRSKEANDRLLEELAKVVKRVDDEDR

SEQ ID NO: 9763 - protein, 177 aa, Artificial Sequence; identical to SEQ ID NO: 9762
  Synthetic

SEQ ID NO: 9764 - protein, 177 aa, Artificial Sequence
  Synthetic
KDIEEVIRRLRESSKESTKRLRDVVEDLKRSSKEVHDESEDVLRRLEELVRRLKKKVRLRELVKRLEEILEELRRRAKELNRRNKEITEELVKELEELVRRNEEILRDVERKLRRITDKRLLKELEDRMRRVDERTDEELEKIRKRMKEVDDRSRDVNRKLAEDLKRAIKRVDDEEK

SEQ ID NO: 9765 - protein, 177 aa, Artificial Sequence; identical to SEQ ID NO: 9764
  Synthetic

SEQ ID NO: 9766 - protein, 182 aa, Artificial Sequence
  Synthetic
DEVREVLRRDEELHRELKERIDRILEELERLHRDLKRKIDRVLEELKRLHEDVKRELDKRGGIEELKERSDRVLTKSARIAEELKKTSDDVLRKTREIVKEIKRKLDDNLRRVREIVEKLKNVEEALRKLHEESKKSVRDVEKELEELRRENKKVIEDLEDELRRLLEENKRAADELRKRAE

SEQ ID NO: 9767 - protein, 182 aa, Artificial Sequence; identical to SEQ ID NO: 9766
  Synthetic

SEQ ID NO: 9768 - protein, 182 aa, Artificial Sequence
  Synthetic
DEVEKVKDDVRKLVEKVKRDAKRAHEDNERKHRKLKKELDDALRELKKRHEELKRRIDDRGGDKDLKKRSDDVLRKSEEIVRRIKKELDENLRRHRERVERIKRKLDELLKKIDDIVEKLKDVDEALRRLKEELDKMIEDVRKELRKLNEDSDDSIRRVKKRLKELRDENEKVIRDIRRETE

SEQ ID NO: 9769 - protein, 182 aa, Artificial Sequence; identical to SEQ ID NO: 9768
  Synthetic

SEQ ID NO: 9770 - protein, 181 aa, Artificial Sequence
  Synthetic
SELEKVRKKVEDISRESEKHLREVKKENDRIIKEIEDELRKLLTDVEREIREVEKRIREERSEKVREEIKKRLERLLEEVRKAIEDLKRKSDEVVKETEKAVRENEEKLEDLRREVAEADDRREKAKRVFEEIERIVRRNKEELRRILKELRELHEEVKEKIKKVLEDVKRLVDELLERAK

SEQ ID NO: 9771 - protein, 181 aa, Artificial Sequence; identical to SEQ ID NO: 9770
  Synthetic

SEQ ID NO: 9772 - protein, 181 aa, Artificial Sequence
  Synthetic
SELEKVLRDVREAIKRNEDLLRRVHEESRRISEESEKNLRRVHERSRRIAEDVRRVLRERRDEDVVRKLRKKLEDLLEESTRAVKENVDELRRALERSEEVVKRSEEHLRDVLRRVEEADDRREEAEKVAREAKKLVDDLKRKNDEVLDEDRKEVERNERELERVLREDKKLLEDLEREIK

SEQ ID NO: 9773 - protein, 181 aa, Artificial Sequence; identical to SEQ ID NO: 9772
  Synthetic

SEQ ID NO: 9774 - protein, 181 aa, Artificial Sequence
  Synthetic
DFAKKLEDEARRVSEESRRHLEDLLRRSKESIDALKRKLEDMLRRVREVIKRIEDELRRERSESVAKSVRDLLREVRDEVRRVRETLKKESEEDRKRVEEVLRRNEELLKRVDERLKEVLRRGEISERVIERIKELLDRNRKELEDVARDAERLNRELNERVDRVLKEVEERLKELEDRVK

SEQ ID NO: 9775 - protein, 181 aa, Artificial Sequence; identical to SEQ ID NO: 9774
  Synthetic

SEQ ID NO: 9776 - protein, 181 aa, Artificial Sequence
  Synthetic
DKAKELEEEIRKIIREIEELLRRMEETSRKSSKESEKHLRDAHEDSRRIAERIKDLLRKEKSEKVREEVERLLRDLERRTREVIKTNRKLSEDDKRRVDEVLKRATELLEELRKKIREVLERGEVSEDVIRELERLLRELKKRIEDVVRRIKELNEDNNRKVEKIREDDERLLEKVRRDVK

SEQ ID NO: 9777 - protein, 181 aa, Artificial Sequence; identical to SEQ ID NO: 9776
  Synthetic

SEQ ID NO: 9778 - protein, 181 aa, Artificial Sequence
  Synthetic
SAAEDVLRKVEKIIKEIEELLKRALEESRKSVKELEKILRDAHEKSRKIAREIEDALRKRKDEDVARKVEDLLRRLKEDTERVIREIERLSEEDKRRVEDVLRKAEELLERLRKAVREARERGEVSDEVVEEIKRLLEELRKKIEDVADEIRRLNEEVNKKLDDLVKTDTKLLEDVDRKVK

SEQ ID NO: 9779 - protein, 181 aa, Artificial Sequence; identical to SEQ ID NO: 9778
  Synthetic

SEQ ID NO: 9780 - protein, 181 aa, Artificial Sequence
  Synthetic
SAAEEVRKKNEKISRELEKLNRKALEDSRDSIRKLKKILDDAHKDSREIIKEIEDLLRKRRDEDVRKRVEELLRRLEERTRKVIKEIRERSKEDEERVKEVHEENKKISEDVKREVKEVRDRGEVSDEVVEEIKRSNDENNERSKKVLDEIKKLNKEVNDRVEELLERDKRELERVKRDVD

SEQ ID NO: 9781 - protein, 181 aa, Artificial Sequence; identical to SEQ ID NO: 9780
  Synthetic

SEQ ID NO: 9782 - protein, 181 aa, Artificial Sequence
  Synthetic
DEFRDIEERAKELAEENETINRRVLTEHKKLIDELREILERVLREHEKRLKDLKDLVRKIDSEEVKKTITDALKRLRETSKELADEVKRVEDELRKTTEELERENKKLLDEVRELLKKVKRDGVVSEEILERIRKLLEDVEEKVKKSVEDSRRLLKTIREEVERVLDTSRKLLKRLEDDVR

SEQ ID NO: 9783 - protein, 181 aa, Artificial Sequence; identical to SEQ ID NO: 9782
  Synthetic

SEQ ID NO: 9784 - protein, 184 aa, Artificial Sequence
  Synthetic
SDLEEVEKRAEEIIRRNKEELEKVLRESKDIIDKNRKLNKESLDEVKRIIERLEDLLRKDGRSERVEELVRKVDREIREVIKRNRELNERSVRELEKLNRESEKLDRESKKELDDLIRDLERRSDTEEVRKVAKKIRDEAKKSHDESKKLNDTSRDLVRKSKEEAERIDEEMKKLLKEIKDKVR

SEQ ID NO: 9785 - protein, 184 aa, Artificial Sequence; identical to SEQ ID NO: 9784
  Synthetic

SEQ ID NO: 9786 - protein, 181 aa, Artificial Sequence
  Synthetic
SEVEEILKRIEDLARTLLKLNEDSLRRNEEIIRTIKELNEKTLKENKEIIDRLRELLRRTRDKDTLEELLKKVEEELRRSNEEDKKLLETAARLVKRSNEEDKRLLEEAAKRVEELLDEARKRNLDERVLKEIEDLLREVADRSRKFNERSERLLREVEERSREVNDRSKKLMDTIAKEVK

SEQ ID NO: 9787 - protein, 181 aa, Artificial Sequence; identical to SEQ ID NO: 9786
  Synthetic

SEQ ID NO: 9788 - protein, 181 aa, Artificial Sequence
  Synthetic
SEVEKALERVKKLAEDLERLDKESLERVEKVIRDAERLDKTSREEVKKIADEADDLRRRAKDKDTLRKLLEDLKRRAEELNRKNEELLRRVAEAIRRISEDNRRLLEEVARRVEDLLREARERNVDEEVLRRIRRLLEEVRKKVEDSNRELKRRLDELEKRVRDSNKEIRELVKEVERKVN

SEQ ID NO: 9789 - protein, 181 aa, Artificial Sequence; identical to SEQ ID NO: 9788
  Synthetic

SEQ ID NO: 9790 - protein, 181 aa, Artificial Sequence
  Synthetic
SRLEEVLRRIRKLLRDNKETAKRVLEEIERLLREADKRNREALKEIEKRMREVEDKLRKARLPEDVVRELRRRITELLRRLEEITRRSRERVKEILERLKEVVERTERKIRKIERELSEIKREKDLEELRRRVKEVSDESRKLLEDLLDEARKVLEENRKLVEEILREAKKVIDEIEEKLR

SEQ ID NO: 9791 - protein, 181 aa, Artificial Sequence; identical to SEQ ID NO: 9790
  Synthetic

SEQ ID NO: 9792 - protein, 181 aa, Artificial Sequence
  Synthetic
SELEKVLREIRRLLDEARKRNEEFLRRIEELLRRNEEEVRRVLEKIERKVERVKRDLERRRVPEEVVRDAERRIDEIRRKIEEILERTKRDVERLLKELRDITRETERRVKELEDELSRVRREEKLERILRTARKVVEDNERLVREVLKKVKRVSDESRRLLEEIDREVDEVIKRLEERAK

SEQ ID NO: 9793 - protein, 181 aa, Artificial Sequence; identical to SEQ ID NO: 9792
  Synthetic

SEQ ID NO: 9794 - protein, 175 aa, Artificial Sequence
  Synthetic
SEAEEIRRRLEEISRRSVEHLRKVLEEIKRISERSKRHLDRVLEENKRRLEELRELLERGRDKRELLEDLKRVHDESRKVIEKNKEENDRALKRAKEVIDENRERNKRVLDEVRKGGLPEEVLRELEELLKESEERIKRIEEEIKKIIDKSREDIKRVLEEIERLNKKAADDLRK

SEQ ID NO: 9795 - protein, 175 aa, Artificial Sequence; identical to SEQ ID NO: 9794
  Synthetic

SEQ ID NO: 9796 - protein, 175 aa, Artificial Sequence
  Synthetic
DEVREVLEELKRISDDSIRHLEEVLRRLREIIERLKATNDDVLRELEEIIRTLLDLDRQGVDKEELKKALDDVLRRIEDIHRETKRRLDEVLKEAEEAADRNRERNERAVEKVRRGGLPKEALDTLERTVEESKKRIKEILDRVKELIDKAREDSKRSVEEVRRRIEKARRDLDR

SEQ ID NO: 9797 - protein, 175 aa, Artificial Sequence; identical to SEQ ID NO: 9796
  Synthetic

SEQ ID NO: 9798 - protein, 175 aa, Artificial Sequence
  Synthetic
SKVDELLKRLEDIIRKLDKENEKVLRELEEISKRSVDHLKRVLEENRRILEELERLLEGGTDKEELLRRLEEVHRRSRRMVEENKKRNDDVLRRVTEVHKETKDRLEKALKDVKDGGLEERVLRDLKRLVDEARRRSERSLEEVKRIADESRKEIERILREIEEENRRAKDKLRR

SEQ ID NO: 9799 - protein, 175 aa, Artificial Sequence; identical to SEQ ID NO: 9798
  Synthetic

SEQ ID NO: 9800 - protein, 175 aa, Artificial Sequence
  Synthetic
SRAEDLLRRLEKIIRDSLRHLREVLKRLERIIDELRKTNERVKEELERIIDTLRKLKDNGVDKRRLEDELRKVDERIKRIHKKTVEDLERVLKEVEDVARENKKRNDEVLKEVEDGGLPEEILRRARELVDESRRRLEKVVKEVRDVIRTLKKDSDKSLRDLEEEVRKAEEDLRK

SEQ ID NO: 9801 - protein, 175 aa, Artificial Sequence; identical to SEQ ID NO: 9800
  Synthetic

SEQ ID NO: 9802 - protein, 175 aa, Artificial Sequence
  Synthetic
DEVRELLDTLRRIIERSVKHLEDVLRDLKRIIDKLREDNRRVLEENRRRLEELDKLRKEGTDKEELKRRLDEVHKESRDIHRDTRRRLKEVLDRVKEVAKRNREENDKATDDVRKAGLPEEFLRDVERLAEESRRRLEAVEREVERLITEAEKESKKSLDEVERLNRELKERLKK

SEQ ID NO: 9803 - protein, 175 aa, Artificial Sequence; identical to SEQ ID NO: 9802
  Synthetic

SEQ ID NO: 9804 - protein, 183 aa, Artificial Sequence
  Synthetic
DVEDILRTIRDLIRRVDEKSRKTLEENRRAIEEVLRRSDETLRRNKKLIEDVEEEVRRTVKDEKLLREVKRRLEELLKENKEMADRTREKLERLLRENERVVKETKRTLKEILDRAEEAARVERREFMETVLRKIKEDIERLEERNREVHEKSREEIRKLEEENEEVHRKSRKEIDEIRKELK

SEQ ID NO: 9805 - protein, 183 aa, Artificial Sequence; identical to SEQ ID NO: 9804
  Synthetic

SEQ ID NO: 9806 - protein, 183 aa, Artificial Sequence
  Synthetic
DVEEILKEIRKRIEDVKRESEKTLKEIRDLIKKVAEDIERSVKENRELIDKVRRELERDVRDEDLLRRLKEKLDRLLKRSEEVAERLRRKLKRLAEEVERVAEDTKRKLEKLLDDAEKMSRMDDRKVLTDVLKEIERRIDELRRRNEEVVEKIKREIKKLEDESKRVNDESREIIKRIKEEVD

SEQ ID NO: 9807 - protein, 183 aa, Artificial Sequence; identical to SEQ ID NO: 9806
  Synthetic

SEQ ID NO: 9808 - protein, 183 aa, Artificial Sequence
  Synthetic
DVEEIIREIRKLIEKVLRDVRRSAEENKKLIDEVKRRVEEMLKRNRDMIKKVLDDVRREVRDERKLDEVRKELEELLKENERVAEKVDRRLRELLERSKRAIRELERKLEELLKKVEEAKKVERREFLKKVLDEIREIIERLRRESEKVNEDSKREIKDIERELREVHKKSRRIIRRIEEKLR

SEQ ID NO: 9809 - protein, 183 aa, Artificial Sequence; identical to SEQ ID NO: 9808
  Synthetic

SEQ ID NO: 9810 - protein, 183 aa, Artificial Sequence
  Synthetic
DEAREVLERLKKISEEDKRRSDKVNEETRRIIKEAEERSRKVNEETKRIIEKLEEDLRDRPKTKELLDELRDILRRAKERSDEVLKRLREILDRIRKRSEKVFKESREINEELRRRVEDVVRKGVISEEILRELREILRENTERVERSLRDNRRLLDELRKKVERSAEENERLLREAEEKLRK

SEQ ID NO: 9811 - protein, 183 aa, Artificial Sequence; identical to SEQ ID NO: 9810
  Synthetic

SEQ ID NO: 9812 - protein, 175 aa, Artificial Sequence
  Synthetic
SEVDKVLDDSRKSAEDLRREIETVLKRNKELIDENRKRLKEVLDRNAKLADDLRRERKKGTDEKMVEDVDRTSKKTIEDLKRESEKSLRDSEESIRRLRERARENIERNRKLVEDVRIEERVVRTLEKLIEEWRKAVEDVLRTLEKLTEEAKRESERILEELKRITKELRDEERR

SEQ ID NO: 9813 - protein, 175 aa, Artificial Sequence; identical to SEQ ID NO: 9812
  Synthetic

SEQ ID NO: 9814 - protein, 183 aa, Artificial Sequence
  Synthetic
SEVEDVLRRLEELLRRLEKKSRESLEELRRRLDEVRKDSERSNEDSERLIRELEEIRRKLEDEETVRRIVERVLEELERINRENHEKAKRVVEELEKIIEENHREAKRVTETLEELIKRLKERNPELKEFLDTMRRIVEELKKRLKEVNDRIKDIVRRAEEELKRSNDENKERIERAEKKVRD

SEQ ID NO: 9815 - protein, 183 aa, Artificial Sequence; identical to SEQ ID NO: 9814
  Synthetic

SEQ ID NO: 9816 - protein, 183 aa, Artificial Sequence
  Synthetic
SELEKVLEELKKLLEELERESDTSVKELRTLLERLEEESKESNERSKRLAEELERRLKDEKDEDTVDKIVRDVLTKLDKLNKDNEKRAREVLKRMDEIIKRNHKRARDVIKRLREIIDDVRRRNPEAREFLETMERIIEELEKRLREVNEDLKRIVRTVAERLKKSNRDNRELIRTLKDRVRT

SEQ ID NO: 9817 - protein, 183 aa, Artificial Sequence; identical to SEQ ID NO: 9816
  Synthetic

SEQ ID NO: 9818 - protein, 183 aa, Artificial Sequence
  Synthetic
SEVEDVLRRLEELLRRLKEKSKKSNEESKKLIKELKEESDKSRRDLERLLEKLDRDLKRLKDKETVKKIVDEAEKRLRRIIEENHRTAEEALRELKKINERNREMAEEVVKRLRELIDELRKRNPEVREVLERMRELVEKLKEDLERSNKENKDLIDKVKRDLEEVNRRLEKIVREVKERVRT

SEQ ID NO: 9819 - protein, 183 aa, Artificial Sequence; identical to SEQ ID NO: 9818
  Synthetic

SEQ ID NO: 9820 - protein, 183 aa, Artificial Sequence
  Synthetic
SEVEDVLRRLRELIEELRERSERSNEESKRLADELEKRSEESLRRLAELLRKLEEDLRRLEDKDTVDKIVEDVKRKLDKIIKDDHDTAREMEKRLEKINEENKREAERVLREAKRLIDELRKDNPEMREVLTTIAKIVTDLERELRKSNEENKKLIDELRKRLEDSNKRVKEIVKRLEEEVRR

SEQ ID NO: 9821 - protein, 183 aa, Artificial Sequence; identical to SEQ ID NO: 9820
  Synthetic

SEQ ID NO: 9822 - protein, 182 aa, Artificial Sequence
  Synthetic
KDVEEALKELERVLEELKRLSKELLDRLRELADRIRRISKELLEELKRLLKDIKETVDRIKDKDTLEEVVRRLVKELEDILRTHKRLVDDIIERLKKILEDHRRLVERAREELERLLKELEDRGVDEDVLRRLRELIEKVKRDLDRTDETLKELIKTLEDELRKSNETIEDLIRRLEEALRK

SEQ ID NO: 9823 - protein, 182 aa, Artificial Sequence; identical to SEQ ID NO: 9822
  Synthetic

SEQ ID NO: 9824 - protein, 182 aa, Artificial Sequence
  Synthetic
SDLERLLDELRKLLDDLRRKSEELLRRLDTLAKKIEREAEKITKDNKELIDRLRDRLRRIRDEDTLREVVKEAVKRLRESLRDHERLVDEIRRRLEKILEDHRDLKRRIEETAKKILDDLRRRGVEERMLRTLERLIEKLKEELKRTDKELERLIRELKKRLDDNNRRNEELIKRVEDELRK

SEQ ID NO: 9825 - protein, 182 aa, Artificial Sequence; identical to SEQ ID NO: 9824
  Synthetic

SEQ ID NO: 9826 - protein, 179 aa, Artificial Sequence
  Synthetic
SEAETVLEEMKEVSKRTEEKNKKVEDDDKRSIDELRKKLEKVLREDRRSIEDLERRLKENKGSDKVLRELKERLRRNKDRSEKVVEDLKRELDKNLEDSKKISEETKRENERALEKARRANVEEEVLRTIERLSRENKKKDEDTLRKSKEEHERVREELERVLETSRREHEKVKKRLED

SEQ ID NO: 9827 - protein, 179 aa, Artificial Sequence; identical to SEQ ID NO: 9826
  Synthetic

SEQ ID NO: 9828 - protein, 180 aa, Artificial Sequence
  Synthetic
RVEEMLERLRRLHEEVKRRIDEVLRELEEESKRNEERIRRVLERLRDEHRKLKETLDRRNADDDLRRTLEENRRKVEEIIRRLEELNERARKELKKIVDELRKKLEENLKRVEDVIREPVDEEELERLERKSRESIERLKDTLRELKERLKRISDRSDEKLREAEKRSRESIEEVKKRAK

SEQ ID NO: 9829 - protein, 180 aa, Artificial Sequence; identical to SEQ ID NO: 9828
  Synthetic

SEQ ID NO: 9830 - protein, 180 aa, Artificial Sequence
  Synthetic
EVEDVMREARKLHKELEDKIRDAARRIRETIDRVKKEDDDSLRKLRKLHEDLKRELEKRNVDRTLEEKLRRNLDEVEKASKESRRHLEELERDVERIIEALKETLRRNLKKVEDVVKKPVDRDELRKLLEDSKRSIEKVEDDLRKLEEKIKRVIDDNRRKNKELEEKSRKSIRDLEEEVR

SEQ ID NO: 9831 - protein, 180 aa, Artificial Sequence; identical to SEQ ID NO: 9830
  Synthetic

SEQ ID NO: 9832 - protein, 180 aa, Artificial Sequence
  Synthetic
EVEDVLRELRKEHDDLRKEITDVLRRLEKLHRELDEEDERSVKRIRELIEEVMRELRKRNAEERLEEELKRALEDVERVSKESKDHLRENLRRVEEIAKRLRDLLKENLKKVEEVLREPVDRKDLKALKEDSKRSIDDIRRKLEEARRRSERSIDENRKLNKRVIEKIREIIRRLEEKTK

SEQ ID NO: 9833 - protein, 180 aa, Artificial Sequence; identical to SEQ ID NO: 9832
  Synthetic

SEQ ID NO: 9834 - protein, 180 aa, Artificial Sequence
  Synthetic
EVEDVLREAERLHRTLLKEIRDALRRLRKLIEDVKRKDDESLKRLREKLERLKESLERNKVEEDLKRTLEKVREELERASERSKRHLEKVLRELEKIIKELEDRLRENLDRVRRVVDKPVDREELKKLLEDSKRSLDELRRRLKEVEDRVREAIKKNEDENRKLERRLDKIIEDLERRVK

SEQ ID NO: 9835 - protein, 180 aa, Artificial Sequence; identical to SEQ ID NO: 9834
  Synthetic

SEQ ID NO: 9836 - protein, 181 aa, Artificial Sequence
  Synthetic
SEAEKILKEIRDISDRTREELKKVKDEHKTLIDRLREILERALREHDRLAKELEDIKRKIDSEDLRREAERVLETLKRTSEELDEIVKKVERELEDTTRRMEESLRDMNRRLRELLDKLRKDGVPEEVLREISKIIKDNHDEVTEVLKESEELIRRLRKEVEDVRRTSEKLIRELEERVRE

SEQ ID NO: 9837 - protein, 181 aa, Artificial Sequence; identical to SEQ ID NO: 9836
  Synthetic

SEQ ID NO: 9838 - protein, 181 aa, Artificial Sequence
  Synthetic
SEVDDVLRRLEELIKTLEDINRKSLEDIKKLIDDLRKILEDALRKHEKLIRELREMKKRIDSREAEEIAKRVLEELKRTSDDLRKKVERVDEDLRRLLRENHERNKKILRDLERLLRDAARRGVPKEFLDRMREEIRRLEEESRKSDETIERLIRELRRRVEEVLKTSTDLIRELEEEVKK

SEQ ID NO: 9839 - protein, 181 aa, Artificial Sequence; identical to SEQ ID NO: 9838
  Synthetic

SEQ ID NO: 9840 - protein, 182 aa, Artificial Sequence
  Synthetic
SSVERVLEAVKELAKKLAEDIRRSLEHIRRLLEEVEKKHRDSKEHVRKLLKDLRDIAREKGAGEELVRDADRLAEEIKKYHDENVDRIRRAVEELAEAHKRLLEEAEKLVRTIEDRLRKVGSDDKELKKILDELRKLIRKVLEALRELNKRAKEILDRVAENVKEVNERLERLVRRIAEEIR

SEQ ID NO: 9841 - protein, 182 aa, Artificial Sequence; identical to SEQ ID NO: 9840
  Synthetic

SEQ ID NO: 9842 - protein, 182 aa, Artificial Sequence
  Synthetic
SSVERVKEEVEKLLEKLEREIRKSLKTIRELLRELKRKHEESKEHVRRLLEKAEREARRRGVDERLVRELRKLVEDIERYHDDNLRRAEEVVRKVEEDHRRLLEDARKLVEEIKRRLEEVRSDDKKLEEILRRAKELIDRVLEELKKLNEELRRIIEEIVRNVKRVNEKLEKLLRDIKRRID

SEQ ID NO: 9843 - protein, 182 aa, Artificial Sequence; identical to SEQ ID NO: 9842
  Synthetic

SEQ ID NO: 9844 - protein, 182 aa, Artificial Sequence
  Synthetic
SSVEEVLRRVKELLKTLKKKHEDSKRTVKELLDDLRKKHEDSKRHVRKLLEELEKRARERGVDKRLVDELRELMKRIEEYHDRNLKRVEDLIKEIERYHDRNLAELEKLARRIEERLKTVRSDDKELKRILEEVKELVKRVLENVERVNREVRERLKEVSRNVERVNKEAKELVDEVEERAR

SEQ ID NO: 9845 - protein, 182 aa, Artificial Sequence; identical to SEQ ID NO: 9844
  Synthetic

SEQ ID NO: 9846 - protein, 182 aa, Artificial Sequence
  Synthetic
SSVEEVRKRVRDLIKRYREEVEKIKKDVRRLLDELREEVKRSLDHVRKLMEELRRKIKRDGVDRRLVEEADELVKTIEDRHEKVKRTAEKLVEDVEREHDELKRKVEELVKEIERRLEEVRSDDKELKRILDELKERLERAKRENEDSVRKLRKLIEEILREIRRLNKEAEDLIREIEERAR

SEQ ID NO: 9847 - protein, 182 aa, Artificial Sequence; identical to SEQ ID NO: 9846
  Synthetic

SEQ ID NO: 9848 - protein, 182 aa, Artificial Sequence
  Synthetic
KDVEEVLTRVRELLRRVEEEIRRSEEHIRRLLEELRRKHEESKDSIRKLLEDLEEKVRRRGADERLLREAKRLVEEVERYHEKNLRDAEEMVRRVEEKHRRLLEEIRRLAKRIVDDLRRVRSDRKDLEEILREVEKLVEEVERRLRKLNEELKEILRTIVENVERVNRRLEELIRDIKRRVK

SEQ ID NO: 9849 - protein, 182 aa, Artificial Sequence; identical to SEQ ID NO: 9848
  Synthetic

SEQ ID NO: 9850 - protein, 175 aa, Artificial Sequence
  Synthetic
SEVEKIVEEVKKIVEEVERLHRKLLEDLRRVVEEVEDRSRRINEEAKKIVEDLKRRGNEDEDTVRKILEDAERVLDRLRKEHERLLRELEEVLRRLHEESKKIIRRLDRVLEEVRRAGVDEEVLKEIEDRLERLRRRAEEVNDTARKIVREVEESLKRSVESLKKLVDELRETLR

SEQ ID NO: 9851 - protein, 175 aa, Artificial Sequence; identical to SEQ ID NO: 9850
  Synthetic

SEQ ID NO: 9852 - protein, 175 aa, Artificial Sequence
  Synthetic
DEVERLLEEAKKIVEEMKRLHEEILREVEEIVRELDEKHDKLLRDAEEIVKELKKEGNEDKRTVEEILRRLEKVLKELREEIEKINREIKKVVEEARKKSEDIIRRADKVLEDLDRAGVREEMRRRLEKLVRDLREKSREVNERIDKLLEELHEKSERVKKTIDDLVEEVKDTLT

SEQ ID NO: 9853 - protein, 175 aa, Artificial Sequence; identical to SEQ ID NO: 9852
  Synthetic

SEQ ID NO: 9854 - protein, 175 aa, Artificial Sequence
  Synthetic
KEVEDILREVKKIVDELLRRHRELLERARRIIKRLKEEHDRLLKELEEIVRDLTRKGNEDEDTVREISKRAKEVIERLETESRKLIRTIDEVLKELHKESRKIIKELEEVVKRVREAGVSEEILRRIEELLKRLRDDAKRVNDELKRLVEELRKRSKEVNDELRRLLKELEDRLR

SEQ ID NO: 9855 - protein, 175 aa, Artificial Sequence; identical to SEQ ID NO: 9854
  Synthetic

SEQ ID NO: 9856 - protein, 175 aa, Artificial Sequence
  Synthetic
SEVEEILKEVERRVDELTRRHEELLRKADEIVKDIRRKLEEINKRLKDIADDVRRKGNEDERTVRELLEELREAVKRARELHKRLLEEVKEVLERLREESKKIIEELRRVLEKVRRAGVDEEILRRIETLLEELERRSKRVNDELEKLVRELKEELERSKRSIDEILKKVSKDLK

SEQ ID NO: 9857 - protein, 175 aa, Artificial Sequence; identical to SEQ ID NO: 9856
  Synthetic

SEQ ID NO: 9858 - protein, 175 aa, Artificial Sequence
  Synthetic
DEVERLLEDLREKVKRLVKKHEDILREVEKEVRRILRTSEEINREAEEIIRELDKRGNEDEETVRRILRTIEEVLKELEKRHRDLLKELEEVAKRVKEKSDELIKTIDRVIEKLRRDGVDEDVLRDVDRLLRELREKSKEVNKRIKELLDKLKTDLERSKEHLERLVKTLKDKLR

SEQ ID NO: 9859 - protein, 175 aa, Artificial Sequence; identical to SEQ ID NO: 9858
  Synthetic

SEQ ID NO: 9860 - protein, 175 aa, Artificial Sequence
  Synthetic
DEVEDLVRKLKKRVDDLLAEHKRLLDEAEKIVREVLKKSRESNERNKKVSKEVRERGNEDKDTVKRLTDELEKVMRDNKETHDRLARELEEAVKRLKEESEKIKRDLDRVLEKIRRDGVSEEVLKTLDRLVEELRKASEDVNRELDKLLKDLEKKLRDSIRHLEENHKDVRRALE

SEQ ID NO: 9861 - protein, 175 aa, Artificial Sequence; identical to SEQ ID NO: 9860
  Synthetic

SEQ ID NO: 9862 - protein, 178 aa, Artificial Sequence
  Synthetic
DEVEKVLKEIRKRVEDSLRHLEKVNKEAREIVEKVREELRESNERLREIVKTIRDRLEKLKGNDEMLKRLKDELDEALRRHREILDRLRRELDKVRRRLEELHRENKEDNRRVLKKAEEDGVEEDVRRTVEELVRRSEKAIEDSRRSIEDLVRRLKEDIERSLRSVEKLVEELTEAIR

SEQ ID NO: 9863 - protein, 178 aa, Artificial Sequence; identical to SEQ ID NO: 9862
  Synthetic

SEQ ID NO: 9864 - protein, 178 aa, Artificial Sequence
  Synthetic
SEVEKVLEELRRIVTKSARHLDESNERLKEIIRRLDEKNKEALKRAEDIIRDIDDKLKKLKGDKRVLDELARRIEEVLRRLRRIVEESRKELDEALKEHDRALRENERENREALRDAEEKGVDKKVKDEVKKLIDDSREKIKRSRESVKRLVEEHRRRSEEVRKTLEKLAREITERIR

SEQ ID NO: 9865 - protein, 178 aa, Artificial Sequence; identical to SEQ ID NO: 9864
  Synthetic

SEQ ID NO: 9866 - protein, 177 aa, Artificial Sequence
  Synthetic
DELEEVADEVRKIIEDLERRLREVVKTSEKLNKENRRRTEDVEKEVEKILRELEEKLRGDEKVRKIIEDLRRELKKAKDESEKSNREIRETTRRLEEEVKKIEDELRKILEEAKDIRADEDIRKVLKELREIIKEVEDMLKEVLDRNRKLIEDNLRRLKEVLDRLRKKVREIEEEAR

SEQ ID NO: 9867 - protein, 177 aa, Artificial Sequence; identical to SEQ ID NO: 9866
  Synthetic

SEQ ID NO: 9868 - protein, 177 aa, Artificial Sequence
  Synthetic
SEIEEAEERVRRLIERNKRETDRVAEEVKRINDENRRATEKVKRDVKRILDDLRRKLEGLDEVREILDRIRRRLEKLERDSKKSNEELERRLKKAIDRSRKTDEDLKEILKKAKDLEKDKLLRDVLRDLERLVRKNLEELKRVLDELKRLMEDNLRRLEKVLEELERLVREIVERAR

SEQ ID NO: 9869 - protein, 177 aa, Artificial Sequence; identical to SEQ ID NO: 9868
  Synthetic

SEQ ID NO: 9870 - protein, 177 aa, Artificial Sequence
  Synthetic
EELERVAKKVRDINRRNKEETKRVEDEVRRLIKENEDTSREVVRRNEEILKDLERKLGGLDEVRKILKELEEETRRLLKRSEDSNRRLEELLRRAKKESEDTNKRLEEILKEAERLEKRDVVREVLERLKELVKRNLDKLKRVLDEIRRLIEENLDELRRAHEEHRRIAEDIRRKAK

SEQ ID NO: 9871 - protein, 177 aa, Artificial Sequence; identical to SEQ ID NO: 9870
  Synthetic

SEQ ID NO: 9872 - protein, 177 aa, Artificial Sequence
  Synthetic
ESLERVKEEVKKILEKNRRTSEEVARRVKELIDRNREKSKDVARKNEKILEDLERKLRGDKDVKKILDELEKRTRDLLRDSERSNEELRDLLRKLLEESKRTNDEIKKILDEMDKLRSEEEVERVLRRLRELVRENEKRLKEVLDEIRRLIRENEEKLEKAHREHKKLAEEVERRKR

SEQ ID NO: 9873 - protein, 177 aa, Artificial Sequence; identical to SEQ ID NO: 9872
  Synthetic

SEQ ID NO: 9874 - protein, 181 aa, Artificial Sequence
  Synthetic
DDVERVLKEVRELVERANEEIRKVLERDRKSNEDANRKIREVLRRVEELVDRIDKIRRELSDKKTVRETVEDILRRIEELLKELKRISDETLKRNEDSARELRERSERTLRRIEDLLRELKKRKASDEVVKKIKELLDRHRKTTEEVLERIRRSLEKHRRDSEEVMKELRRLVKELEDRTR

SEQ ID NO: 9875 - protein, 181 aa, Artificial Sequence; identical to SEQ ID NO: 9874
  Synthetic

SEQ ID NO: 9876 - protein, 181 aa, Artificial Sequence
  Synthetic
DEVRELLRTIEELVRDANRKIKEVLDRDRESNDRANKTLEEILKRDKRSNEDVEEKLKKLTDKSKVKEIVDRVRKENEDSLRKLEETSRKTLEDNKESLKELKKLSEKTRREIERLIDEARKRNVDKKVEKKIRDLLKKHEEDSRKALEDIKRSLERHRERSEEVLKRIRDSLRELDKKTK

SEQ ID NO: 9877 - protein, 181 aa, Artificial Sequence; identical to SEQ ID NO: 9876
  Synthetic

SEQ ID NO: 9878 - protein, 181 aa, Artificial Sequence
  Synthetic
DSVEEILKRVKELVDKANEKIKEVEERVRRSDEELKKILEEILREIEKLVREVEEIARRLSDKETVRERVERIEKRLRELADTIRRIVERVLRENERLLRELKKLSDKTLEDIKRLLDKADKDKVSDEVKKKIKDLLEKHERDSRKVLRKLEESSKETEDRAKEVLERIEKLLEDLRRETK

SEQ ID NO: 9879 - protein, 181 aa, Artificial Sequence; identical to SEQ ID NO: 9878
  Synthetic

SEQ ID NO: 9880 - protein, 178 aa, Artificial Sequence
  Synthetic
KDAEELLKRVRDLLKRSLESLEKILRDSKELADRWRKKLEDLLRESEELVDRAEKILRRGDNDKRVLDKIAEEVRRTNDDSRRLDEELHRLSRDTLRKLEENLRRTEKEVREMDKRAAERGVDERVREELKKLLTRVEEEHRKVLETDKKLLKELHKESKEVNDRDRELLERLEESVR

SEQ ID NO: 9881 - protein, 178 aa, Artificial Sequence; identical to SEQ ID NO: 9880
  Synthetic

SEQ ID NO: 9882 - protein, 178 aa, Artificial Sequence
  Synthetic
KDAERLLRELKKLLEESLKSLKELTDRIRDEVRRVKKRLRDLLRESEELVKRAEDILRRGDNDKRVLDELRKEVERTNRKSEDILREAKELIEKVERELERNLEETEKLIKRIREEMKRRGVREEVEETAKKLLDEVRRAHEEVLKEIRELLRDLERTVREVNEEDKKLLRKLEEDVR

SEQ ID NO: 9883 - protein, 178 aa, Artificial Sequence; identical to SEQ ID NO: 9882
  Synthetic

SEQ ID NO: 9884 - protein, 174 aa, Artificial Sequence
  Synthetic
SEAEKVRKDLKDIADDLHRVSERVLREDERLLKRLHDVSRDVRERDREIVEDLRRGGISKTLLKEVERLSEESKRKLDKLNEEVRRLSEESRKRLKDLNDELREIVRRVKETVDSGDDREEVLDRARKEVDEIKKKHKKVLDESRKLVAEAERKHEEILKESEDLAREIKERER

SEQ ID NO: 9885 - protein, 174 aa, Artificial Sequence; identical to SEQ ID NO: 9884
  Synthetic

SEQ ID NO: 9886 - protein, 174 aa, Artificial Sequence
  Synthetic
SRAEKVREDLDRIEEDLRRVHREVLKEVERILKELHDTSKRVRDEVEKIVRDLRRAGIPKDLLKRAEDLIKEIKDKLDRLNERAEEIFRDIRRYIEENEERSKRLVDEVRKRVDDGDDREKVLEDARKLVRESKENIRRVLEDLKRIVKKLKEDHKRILDELKKLVDKIKEDAR

SEQ ID NO: 9887 - protein, 174 aa, Artificial Sequence; identical to SEQ ID NO: 9886
  Synthetic

SEQ ID NO: 9888 - protein, 174 aa, Artificial Sequence
  Synthetic
SRAERVREEIDKILEDLHRVSERIKRELTKLMEDLERTHERIKKAIREILADLRRRGVPKSLLKKAEDLVKRVEDYVRKNLEDSRDDIRKVREEVEELNKRAEDLVREVKKIVDSGDDREEVLKEAKKLVDDLKEKHKEVLTRVERLVEESKKNLKRVLDELRDLVRRVKEEAK

SEQ ID NO: 9889 - protein, 174 aa, Artificial Sequence; identical to SEQ ID NO: 9888
  Synthetic

SEQ ID NO: 9890 - protein, 174 aa, Artificial Sequence
  Synthetic
SEAERVREELDKIVEDLHRTSEDVKRRDEELLKDLERRHKEVKEEDEKILKDLRDSGIPKDLLREITKLSRDSKKYLEENLRRSRKLSRDSKEKLEELNRRARDVIRRVRETVDSGDDRERVLEELRKTVTEMKKRHRDILRESEELARESKENVDRVLEESRRRAEEIKRRAK

SEQ ID NO: 9891 - protein, 174 aa, Artificial Sequence; identical to SEQ ID NO: 9890
  Synthetic

SEQ ID NO: 9892 - protein, 174 aa, Artificial Sequence
  Synthetic
DERERVKEELDKLLRDLERVHDKVREDDKRLLDDLRRVHEKARRDDKRILDELKRAGIPEDLLREVEKLSRESKRYLDENLRRSEELSERSRKYLDDNLERSRRLMEDVKRKVESGDDREEVLERAKELVKRSKENVERVLRDSERLAKESKENVRRVLEESKRRVEEIEERAR

SEQ ID NO: 9893 - protein, 174 aa, Artificial Sequence; identical to SEQ ID NO: 9892
  Synthetic

SEQ ID NO: 9894 - protein, 174 aa, Artificial Sequence
  Synthetic
SEAERVREELKRILEDLERVHREVEEAIERIVEELEDVHRRARERVERILRELERRGIPKDLLERARKLIEDIKRYLDENLKESRRLAEDVKRKIRENLKRSREIVERVIRIVDSGDDREEVLKEIEKMVKESRDTVRRILEELRELVERSKRNVEKVLRDLERAVEKIERDAK

SEQ ID NO: 9895 - protein, 174 aa, Artificial Sequence; identical to SEQ ID NO: 9894
  Synthetic

SEQ ID NO: 9896 - protein, 174 aa, Artificial Sequence
  Synthetic
KEAEDARRRVDEILEELRKLHDEVRKTDKELLDDLEREHERVKREDDKILDTLRRQGIPKSLLEEIKRLSEDSKRYLEENRKESRRLSEESKRKLDENLERSERLAKEIRERIDSGDDREKVLEDLERLVETSRKTVRDILEESKELVKRSKENVRRVLERSKELVKRVSERAK

SEQ ID NO: 9897 - protein, 174 aa, Artificial Sequence; identical to SEQ ID NO: 9896
  Synthetic

SEQ ID NO: 9898 - protein, 184 aa, Artificial Sequence
  Synthetic
SDVDEARKTVKKILDESEETLERVRRELERILRDSERTLKRVEERVRRILRDLERELRKLPEDDKLKELERRVREATKDVERMLDEDRKRNDKARRELKKVLDENRRKNKKVMDDAEKILRETTDREEIDKVLKEIRERVERSKKHLEDVLDRLRKIIEESKRHVEKVLEKLEKIVKELKDELK

SEQ ID NO: 9899 - protein, 184 aa, Artificial Sequence; identical to SEQ ID NO: 9898
  Synthetic

SEQ ID NO: 9900 - protein, 184 aa, Artificial Sequence
  Synthetic
KDIEEVEKRVREILEDSRRMSKKDEESTRRILEESRRVSEEDKKSTEEILKELKDELRKLPERDKLERLRREIEKVVEENRDVNRRDNRRNEEAIRENKELNKEDNDDNEKVLEDAKRILDETTDRDTIKKMLEEIKRRVDESKRHLRESNKRIRDIAEESKKHLEDSNKKVRDRADELKKRLK

SEQ ID NO: 9901 - protein, 184 aa, Artificial Sequence; identical to SEQ ID NO: 9900
  Synthetic

SEQ ID NO: 9902 - protein, 184 aa, Artificial Sequence
  Synthetic
SDLERVKKAVEDILRDSERTLRRARERLKRLLEELRRTSEEDKKSTDEILERLKRELEKLPPDRKLERLDDLIRRLVKRNKEINDRVNEVVERMMREAEDRLRRDKERNDRVVREAEEIIRRVTDRDELRKLLEEIRRRAEESKRHIEEVLKRLEEIVKRLKEELKRSNDEIREIVRRLEEELK

SEQ ID NO: 9903 - protein, 184 aa, Artificial Sequence; identical to SEQ ID NO: 9902
  Synthetic

SEQ ID NO: 9904 - protein, 180 aa, Artificial Sequence
  Synthetic
STLEEMEKEVEKLNRDSRRTLREVAERVEELNRDNERTSKRVEDAVRELNKRLRDEVRRREVEKVIKESRDSLERLKERSKRSNEESKRTLDELKKKVEDVNKRSKESLDRLREAVKNKAPEEELRKVLKENEELARELKKELERALEENRRLHEENKEDLRRVLEENERLHRKLRKDAK

SEQ ID NO: 9905 - protein, 180 aa, Artificial Sequence; identical to SEQ ID NO: 9904
  Synthetic

SEQ ID NO: 9906 - protein, 180 aa, Artificial Sequence
  Synthetic
DTLERVAEAIRRLNEDLKRTLEKVERAVREILKRLAETLKRAEEEVRRLNRDLERKVRRDEVEEVIRRSRESLRRLKEEVKRALDRIKRLLDELKKRVREVNERSKRSLEDLKRLVENNASEEEIKKVLDDNKKLAEDLKRELKRVLEEIRKLVKELEDIVREVLKTNKELHERLKRRAD

SEQ ID NO: 9907 - protein, 180 aa, Artificial Sequence; identical to SEQ ID NO: 9906
  Synthetic

SEQ ID NO: 9908 - protein, 180 aa, Artificial Sequence
  Synthetic
DTLERAAEEVKKLNEDNKRTSKRVEDEVRRLNRENEEMSKRVKDTVKKILDDLRRKVDRDEVDEVLRRIEELLERLERESEKSNERSRETLRRLKRRSEESNKRLEELLRELDKLVKDNADEKEIERVLRELERIARENKKELEKVLRENRELHERNKKLLEKVLRDIKRLAKTLRDRTR

SEQ ID NO: 9909 - protein, 180 aa, Artificial Sequence; identical to SEQ ID NO: 9908
  Synthetic

SEQ ID NO: 9910 - protein, 180 aa, Artificial Sequence
  Synthetic
RELEEARERVKRLNEENKEFSRRVAEEVKKLNEENERTSKKVEDEVRKLNEDLRKKVDRRDVKRAIERSKELLKRLKEKSEESNKTSEKTLRDLERKSRESNKELKRLLEELEELVKNNADEETIKRVLEELTRIMDRNRKDLRRVLEENKKLHDENRKELKRVLDENRRLHEEVKKRAK

SEQ ID NO: 9911 - protein, 180 aa, Artificial Sequence; identical to SEQ ID NO: 9910
  Synthetic

SEQ ID NO: 9912 - protein, 180 aa, Artificial Sequence
  Synthetic
SELERVKTEVEKLNRRNREATERVKEEVKKLDEENKKSSKRVEDEVRKILDELRKKVDRDRVEKALREIEKLLEDLKRTSDKSNRESEELLKELEERSKRSNDTTKKLLEELEELVKNNADREELERMLKRLKEIIERNEERLKEVLDRIRELIERNKELLRRVLKRIRDLVKELKERAD

SEQ ID NO: 9913 - protein, 180 aa, Artificial Sequence; identical to SEQ ID NO: 9912
  Synthetic

SEQ ID NO: 9914 - protein, 180 aa, Artificial Sequence
  Synthetic
RELEEVERRVRELNEDNRRKTEEVKREVKRIDDDNRRASERAAREVKKLNKDLKDKVDDDEVDRVIEESRRLLRELEDKSKRSNDTSKRLLEELEKRSKDSNRRTKELLERLKELVDRNADEKTLEDMLRRLKEIIKRNKDELEKVLRDIKKLVDDNKRDLERVLRRNEELHRELLERAR

SEQ ID NO: 9915 - protein, 180 aa, Artificial Sequence; identical to SEQ ID NO: 9914
  Synthetic

SEQ ID NO: 9916 - protein, 180 aa, Artificial Sequence
  Synthetic
DELERAKEEIERLNDELKKSLEEVEKEVEKLDDDNRRTSRRVSEEVKRLNKELEDEVRRDDVERAIRESEELLRRLEESSERSNEESRRLLKELAKTVREVSKTSKKSLEELEKLVRDNADRDTIRKVLKENEDLIRKLEEILKKVLDEIRRLIEDNKRELEDMLRKNKELHDRLRERAR

SEQ ID NO: 9917 - protein, 180 aa, Artificial Sequence; identical to SEQ ID NO: 9916
  Synthetic

SEQ ID NO: 9918 - protein, 180 aa, Artificial Sequence
  Synthetic
SELEEVKKEVEKLDERNKRLSKRVEEEVRKLNEENKRATERIKREVEKILEDLRRKVRRDDVDRVLDTIRRLLKRIEEESRKSNKETRKLLEELKEDSKRSNEETKKLLEDLEKLVKDKADREELKRMLDRLRRIIEENERKLKEVLDRLRDIIRKNKEDLKRALERIKKLVEDLKRRAT

SEQ ID NO: 9919 - protein, 180 aa, Artificial Sequence; identical to SEQ ID NO: 9918
  Synthetic

SEQ ID NO: 9920 - protein, 185 aa, Artificial Sequence
  Synthetic
SDLERVLDEIRRLAKEVKDTLRRMLEKNEELSKRDEDKTREMLKEIERLVKELEEIADKLSDEKTVREIVRRIEEDIKRLLEEVKEKNERSIRKSKKTLDDAKRIVDKILEEIRRLLEELRKRVKDDDRLRKAEEEIKEIERDLKRTLDEVAKEVKRTIDRNRETSKRAAREVEKLLEKLREKTR

SEQ ID NO: 9921 - protein, 185 aa, Artificial Sequence; identical to SEQ ID NO: 9920
  Synthetic

SEQ ID NO: 9922 - protein, 185 aa, Artificial Sequence
  Synthetic
SDLERMLREIRKLVEDDKRRTREMLRDNERLSREDKKKTDDVLRRLEELVRRLEEILKKLKDKDTVRKIVKEIIEELEKILKELEDTNRKSIEDSRRTLREVREINKDSIKKLEDLLKEVAERVDDDKRLDDIRRAIEEIIRDLRRASKKASEDVERTIERNERTSEEAKRRIEELIERLRRTDK

SEQ ID NO: 9923 - protein, 185 aa, Artificial Sequence; identical to SEQ ID NO: 9922
  Synthetic

SEQ ID NO: 9924 - protein, 185 aa, Artificial Sequence
  Synthetic
SDLEEALKRVEKLVRDDKEKTKRMLERNRELVKRNKEKNKRMLDEIRRLVEELEDILRRDKDRDTVRRIVEDIKRRIKKLLDDIRETNERSIRESEETLKRVEDLNRESLRTIEELLREIKERVEDDKRLKEVEDAVREILKDLKRTSERAKEEIERTIRDNERVVRRLEEEARKILEDLERRDK

SEQ ID NO: 9925 - protein, 185 aa, Artificial Sequence; identical to SEQ ID NO: 9924
  Synthetic

SEQ ID NO: 9926 - protein, 182 aa, Artificial Sequence
  Synthetic
SRIEELLKTVEKLVDEVKKALRKLLEENKDLARKSKESLERLLDEVRDLVRRLEEILDRGDNDERVLREIEKRVKDAKDRVRDNLREVHRLDEESKRRLEDLLRRVKELAEDVKKKLKDDVDDKDKLERVMRTLDEILKDLERTVERVKRALDESNRDLRREHERIKKELDKILDRLREKAR

SEQ ID NO: 9927 - protein, 182 aa, Artificial Sequence; identical to SEQ ID NO: 9926
  Synthetic

SEQ ID NO: 9928 - protein, 178 aa, Artificial Sequence
  Synthetic
SEVERLKEELDKLHKENREVLEDSKRSLDKILDDVRKLAEDVKKRLDDILKELRDRGVPEEALKEAEKVITDLKRRIDELLDRVRKIVEELKRRHDRLLEEHKRIIDDIKDKLEKNKTDRDLLRRLLREAERVSEETKKESKKLNDEIRKVLERLRDELRKIEDEIRKVVRRIRERAN

SEQ ID NO: 9929 - protein, 178 aa, Artificial Sequence; identical to SEQ ID NO: 9928
  Synthetic

SEQ ID NO: 9930 - protein, 178 aa, Artificial Sequence
  Synthetic
DEVETLKKRLDKLHEDNKRDLERSKRSLEELLKELEEVVRRSEKTLDELLKKVEDQGAPRELLEELKRIMDELKRKHRELLKRAKEMLEEVKRRHDRLLEEHKEIVERIKREVERNKDDRKLLKELEDTIRKVSDDTRRKSEELNEELKTVAEEIKKRSRELNEEAKDVLEKVERRTT

SEQ ID NO: 9931 - protein, 178 aa, Artificial Sequence; identical to SEQ ID NO: 9930
  Synthetic

SEQ ID NO: 9932 - protein, 178 aa, Artificial Sequence
  Synthetic
DEVERAKEKLDKILEDLRDVVRRSKENLDRLHEENRETLERSKKNLDRLLEKVKKDGVPEELLKELERIIRDLKRKHRKLLEDHRKIIEELKREHDRLLKEAEEIVRRIKDELEKRKDDRRDIERILRELEKVLKKLTDESERLNREVERVSRDTKKKSKELNEELKRVLDEVKRKAD

SEQ ID NO: 9933 - protein, 178 aa, Artificial Sequence; identical to SEQ ID NO: 9932
  Synthetic

SEQ ID NO: 9934 - protein, 182 aa, Artificial Sequence
  Synthetic
DEVREVLRELKKVVDDSKRDLDRVLREAERVVKESKDDIKRLLEETERVARDVERKIRENKGNKEVVDRIRKEVKEVHERSERILKRNEEKNRTVLKKAEDMIERNLRENKKVADKIKRVVEELKIDETLDKEVKRLLKESKRAADELRERIKRLIEESKRLLDTVRREDKKILEKIERDLK

SEQ ID NO: 9935 - protein, 182 aa, Artificial Sequence; identical to SEQ ID NO: 9934
  Synthetic

SEQ ID NO: 9936 - protein, 183 aa, Artificial Sequence
  Synthetic
DEIEKILEDLRRISEDTKRKHEEILRELEEILRELEERHRRILREVEEVARRLEERLNEDKRVVEELKKEAEEAIDEVRKRSRRINEELKRVLEEVRRKSEELNKRTEKVVRDVKRKIEETVTDEEKVKEVEREIRRLLKENEDASREVERLIEELKRRLDKISEDVERVLKKILERIDRATK

SEQ ID NO: 9937 - protein, 183 aa, Artificial Sequence; identical to SEQ ID NO: 9936
  Synthetic

SEQ ID NO: 9938 - protein, 177 aa, Artificial Sequence
  Synthetic
RSVEEAEKVLEELKRRNERLNEEHRREVEKVREKNERLNKRHREDVERIKRELDKEPVPEEVKRKLEEAIKKLERIDEESEEETKRVIDRLREMDEDTRRKTEKAIRELRKFLEDTTDDETIKDVLRKIKKISDETRKTLEDTLRELREISEKTRRRLDESLKELEEILRRLKEETR

SEQ ID NO: 9939 - protein, 177 aa, Artificial Sequence; identical to SEQ ID NO: 9938
  Synthetic

SEQ ID NO: 9940 - protein, 177 aa, Artificial Sequence
  Synthetic
REAEEIRKEVEKLLRDLKRALDEHRETSRRLVEELKDILRKNREEVERLVREIREVIKRVKDREVVEEVKKRLEDLVRDIEKVLRDTERIIEKLKEDSEDVLRRLDKIAKDIERDVERREPTRELIEEITRIVEKAKKELREVSKRLREIVKKIKEDNDRSNKRLREIAKEIKDRLT

SEQ ID NO: 9941 - protein, 177 aa, Artificial Sequence; identical to SEQ ID NO: 9940
  Synthetic

SEQ ID NO: 9942 - protein, 177 aa, Artificial Sequence
  Synthetic
SEREEARERVKDLSRKLKEINERSEKHLRDLAKENRDANRRTREEVERLLDKIRKVIKDVKDREVVEKVRELVERLREEVERVNEKSERILREVEKRVRDVLDETRKIVRKMEEEVERREPTEELIRELEKIVRDAEKKNRDVNREVRKILEDSKRELEKVLRDLERKVREIEKELK

SEQ ID NO: 9943 - protein, 177 aa, Artificial Sequence; identical to SEQ ID NO: 9942
  Synthetic

SEQ ID NO: 9944 - protein, 178 aa, Artificial Sequence
  Synthetic
RELEEVLKKLKEDAERLKRILEEATRELEKILERLHRLNEKSTEELRRIVKDLKEELKRRGRDEEVDKKVKDIIRELEKKSTKNLEDSRRIAEELRKTSRETVERVRKDLEELRKRVEELTRSEEVEKTVRKLEEDLKRAIEKHEEDSRRLVKRLKESNDEHEKESRRLVRELEKEIE

SEQ ID NO: 9945 - protein, 178 aa, Artificial Sequence; identical to SEQ ID NO: 9944
  Synthetic

SEQ ID NO: 9946 - protein, 185 aa, Artificial Sequence
  Synthetic
DEVREVIKTVRKLLEDLHRTNREVIERVKRTSEETHRKNEDMLRRLRKLVEDLKETLDRLEDKDTLRRIAEEIEKRIRKLLEEAEKINREALEEHKDLLRKLEEENKRILEELKRLLDKLRKDVEDEKSLRDAEREVKKLLEELKRSLDKLREDVERLLRENKESLDRLREEVKKIERELREKTR

SEQ ID NO: 9947 - protein, 185 aa, Artificial Sequence; identical to SEQ ID NO: 9946
  Synthetic

SEQ ID NO: 9948 - protein, 185 aa, Artificial Sequence
  Synthetic
SDVDRVLEELRKLVEELHRRNRKIIEDLRRASEKTHRKNRDLLEKAKKLADELREIAERLEDREKLREIAREILERLKKLLEDVAKTNTDALREHEEALRRLKEENDDIKEKIKRLVDRVRERIKDKDELRRLEEAAKKILDDLEDSLRKLEEAVKDLKRKNKKSLDDLAEAAKDILRRLAETAR

SEQ ID NO: 9949 - protein, 185 aa, Artificial Sequence; identical to SEQ ID NO: 9948
  Synthetic

SEQ ID NO: 9950 - protein, 185 aa, Artificial Sequence
  Synthetic
DEAEEVIKTVKRLLDELHRRNEEAIKEDRRLVEELHRTNEKVLREVEELVKRLAEILRRLKDKDTVRKIVEDIKRELDRLLDELRKTNEEIRKRSDDLNRKINRENEEILRRLDDLLRDLEAKIRDKETLDRLRERAEELKRRLEKSLRDLNRDNERTKRELRESLRKLEETARRLKEEIDRRTK

SEQ ID NO: 9951 - protein, 185 aa, Artificial Sequence; identical to SEQ ID NO: 9950
  Synthetic

SEQ ID NO: 9952 - protein, 184 aa, Artificial Sequence
  Synthetic
DEADDLIRRVRELVKRVKEALEDLLRRNKDVLRKVKEELEKITRRNRDKVRRVEEELKRIKDRETLRRLVEKVKRELDESHKEVERLIEKVNEISKKTLRDVEKLVTEVKKRLDDIKDELDKRVKSRKLEELRKEVEKLKEELDRVLEEARKEVEKSNRELKEVLERHAEDNERIKRRLDEARR

SEQ ID NO: 9953 - protein, 184 aa, Artificial Sequence; identical to SEQ ID NO: 9952
  Synthetic

SEQ ID NO: 9954 - protein, 185 aa, Artificial Sequence
  Synthetic
SELERLLDEVDRIVREIEERLRDILRKNRELSEDSERKLRELLREVRDLVRRIMDELRRTKERDVIEEVVRRIRELLKRIEDRLRKIADDSHKLDEESVRRLEDIARRIKKRVDEILEEVKRSGVPREKLEEARRRIDEIRRRLEELLKRAREDSDRSNKRNKDLLREIEEELKKLKRELDEETR

SEQ ID NO: 9955 - protein, 185 aa, Artificial Sequence; identical to SEQ ID NO: 9954
  Synthetic

SEQ ID NO: 9956 - protein, 181 aa, Artificial Sequence
  Synthetic
SLKEKVKKVIEDLKRAIDDLLRKVREESKKSNDHIRKLLEDSERTLRDLARRIKKLKDDGDLDERLLKEAKELLEELKRRSEEIIKEVEKLNEESDRVIDKLLEDLARLLKRIDDRIEKITDARLIKEVIEEAERLLREIAKRIRKVIEEDRDLNRRIAKKLDELNRRAEELLKRIADRAK

SEQ ID NO: 9957 - protein, 181 aa, Artificial Sequence; identical to SEQ ID NO: 9956
  Synthetic

SEQ ID NO: 9958 - protein, 181 aa, Artificial Sequence
  Synthetic
SSKETVKDVLRKITKRIRDLVRESKKTSDESNKHIKELLERSKKTIDELERRIEDLRRRGDLDDDLLREAKELLERIERESRRVFKEAEELNKRSDDETRRIVKEAEDLIRTVEERLKRIEDEELLRRLIKELEDLMREIERKLRELNERDKRLNEEIAKKLEKLNRDARKLVEEIERRAR

SEQ ID NO: 9959 - protein, 181 aa, Artificial Sequence; identical to SEQ ID NO: 9958
  Synthetic

SEQ ID NO: 9960 - protein, 181 aa, Artificial Sequence
  Synthetic
KLREDLEEMLRRSEKHIRDLVKRSEETSRDSNRHIEKLLKDSRKTIEDLKRKIEDLARKGKLDEKLLEEVRRLLEEIRKRSEKVIEDARRLNKRSDEETKRIVREADELNKEVKDRADRIRKRELLERLIRELKRLNEEIAKKLEDLNREDRRLNEEIAKRLRDLNEELKKLVEDIERRAR

SEQ ID NO: 9961 - protein, 181 aa, Artificial Sequence; identical to SEQ ID NO: 9960
  Synthetic

SEQ ID NO: 9962 - protein, 181 aa, Artificial Sequence
  Synthetic
RSKEEVDKMLERLRERIEKLVEESRKTSKESNEHLEKLFRESEETIKELKKRIEDLRRKGLLSDELLEEVKRLLDRIREESKKVLDEARRLNEESNRKTEEIVKEVRKLLEEVKRRADEIRDEDLLEKLIRELEELIRRIEKKLRDLNREDRELNKRIADEIERLNREARRLIEEIRKRAE

SEQ ID NO: 9963 - protein, 181 aa, Artificial Sequence; identical to SEQ ID NO: 9962
  Synthetic

SEQ ID NO: 9964 - protein, 181 aa, Artificial Sequence
  Synthetic
SLEEEVRREIERSRRHIEKLVRDSERTSKESNKHIKKLLDESKRTLDEIRKRIEDLARKGKLDEDLLKEARDLIREIEKKSRDVIREAKKLNEESNKRTEDIVREARELNERVKRRVDEIREREVLKELIRELRRLNEEIRKKLEKLNDEDRRLNEEIRRKLEEINEELRRLVREIEERAR

SEQ ID NO: 9965 - protein, 181 aa, Artificial Sequence; identical to SEQ ID NO: 9964
  Synthetic

SEQ ID NO: 9966 - protein, 181 aa, Artificial Sequence
  Synthetic
SLEETVEEVLRRLRRKIEKLVTESEETIRRSKKHIEEVLEKSKRTLDKIKEDIDRLRKEGTLSDEILTELDKLIKDVEKKSKELIDEARKLLEDTKRETDRIRREVEELLRRLEKEVKRIREREVLKELIDRARELIERIARKLTELNKENRKLNEEIARRVEELNKELKRLLKEIEDRAR

SEQ ID NO: 9967 - protein, 181 aa, Artificial Sequence; identical to SEQ ID NO: 9966
  Synthetic

SEQ ID NO: 9968 - protein, 181 aa, Artificial Sequence
  Synthetic
STKETVARELERSRKHLEDSFREAERAIKESEEHIRELLERSRRTLKEIEDRIRDLRRRGDLDDRLLEEVKELIDRVRKRSEDIFRRAEELLRRTRERVKRSLDRARKLNDDVERRMREITDERLLRELIEELRRLNRKIHEDNRRLIEDNKRLNEEIKRELDKLNRELERETEEIKKRAD

SEQ ID NO: 9969 - protein, 181 aa, Artificial Sequence; identical to SEQ ID NO: 9968
  Synthetic

SEQ ID NO: 9970 - protein, 178 aa, Artificial Sequence
  Synthetic
SVRETLREVLKESKKHLDDLVRRVKEEIERSKKHIDDLIRRNKESLDDIRRTVEEKIKGREILRKIEEALKRNEDELRRIATEAEKVHRDVEKTIREIVKELRDVHREIEDAIRKKQDDSDLVRELIKRLKEINDRVAERIKDIIRKVREANKDLERKLRELNKRSRDVLEEVVRAEE

SEQ ID NO: 9971 - protein, 178 aa, Artificial Sequence; identical to SEQ ID NO: 9970
  Synthetic

SEQ ID NO: 9972 - protein, 178 aa, Artificial Sequence
  Synthetic
SAAEEAEKASKDSEKHIKDLIRRLREVSEESRRHLRRLIEENKRSLEEIEKEVRKKVKGEEIRREIEEALRRNEDKLKKIEDEMEEVNKKSEEDVRRLEKEVKDVNDRSSDTIRDNKDDTELIKRIIDRNREINRRVAEAIKKIIKDNRDINEDLERKLRKLNEESKRVLDDVVRREK

SEQ ID NO: 9973 - protein, 178 aa, Artificial Sequence; identical to SEQ ID NO: 9972
  Synthetic

SEQ ID NO: 9974 - protein, 178 aa, Artificial Sequence
  Synthetic
SVEERLKDELRKSEEHLRRLIRELEKALEDSKRHADRLIKENRDSLRRIEDKARKKIRGDEILDTIRKALKDNRDELEKILREVEEVDKESKRRLEEILRTMREVNEESKDRLRKKDKDDETVKRIIEENRRINEDLARKIKEIIRDNKRFNEEVEEKLKRLNDTSEEILRRLVRRDE

SEQ ID NO: 9975 - protein, 178 aa, Artificial Sequence; identical to SEQ ID NO: 9974
  Synthetic

SEQ ID NO: 9976 - protein, 178 aa, Artificial Sequence
  Synthetic
SVDKELEEVIRRSKDHLEKLIKEAEDALKRSEEHLRKLIEEVKRRLEEVEKRVREKVRGEEILREIEKVLKEVEESLERILKELEDVNRRSREELKRILREMERVDEETKRELDRRTDDSELIKRLIKENKEINEKLAREIEEIIKENKRINDELKKRLEELIERLERILEEVERRER

SEQ ID NO: 9977 - protein, 178 aa, Artificial Sequence; identical to SEQ ID NO: 9976
  Synthetic

SEQ ID NO: 9978 - protein, 178 aa, Artificial Sequence
  Synthetic
SVDRTLEEVIKDSRRHVKELIDRLEKVIKESEENVKRTVDDNERSLKEIADTVRREIKGREILEEIKRVLDDNRRAVEELEKEAREVHRDVREKLKRILEELKRADDETERRLRERTDDSEDIKRLIDTNRKINRDVAETIKEIIKEVRKINKEIDDKARELNKESRRVLEEVVRAER

SEQ ID NO: 9979 - protein, 178 aa, Artificial Sequence; identical to SEQ ID NO: 9978
  Synthetic

SEQ ID NO: 9980 - protein, 178 aa, Artificial Sequence
  Synthetic
SVAETLRKVLKESEENVKRTVDRAEEELKKSEEHLRRLVERLKEVLEDVRRRVEEEVKGRELLREMDEVLKRIEEEIRKILRRLEEADKRSREALDKLEKDAKRVHDEVRDRLEKRTDDDERVERIIRELREVNERLDREVERLIRENREINRRLAEEIKDLIRRLREILREVVERAK

SEQ ID NO: 9981 - protein, 178 aa, Artificial Sequence; identical to SEQ ID NO: 9980
  Synthetic

SEQ ID NO: 9982 - protein, 178 aa, Artificial Sequence
  Synthetic
SIAEKVEKVLKESKENLDETIRRAEEDLKRSRDHLRKLIEENKRSLDRIKEEVDRRIKGREILKEIEEMLKRNDDRLKEILREVEEADRRSREELKRILDEAREVHKEIRRKIDERRDDSDAIEKLITDLRKINEEADRKVKEIIKRNRDINKKVEDDLRELNKESTTVLREVVERER

SEQ ID NO: 9983 - protein, 178 aa, Artificial Sequence; identical to SEQ ID NO: 9982
  Synthetic

SEQ ID NO: 9984 - protein, 178 aa, Artificial Sequence
  Synthetic
SELEKIIEDARRVLEEDERRNREVNRKLRKILEDNERLNREVNKRLREILKRLKEELKRLKGDKKAVEEVRKKVEEALRDVERVLEESRRDIERVLREVEEMLERSRKHIEDVLRELERRDLDEEAKRALDKIREDVRKILEDTKRELEDVRRRVEEILRETREELKRVEDDVKRAED

SEQ ID NO: 9985 - protein, 178 aa, Artificial Sequence; identical to SEQ ID NO: 9984
  Synthetic

SEQ ID NO: 9986 - protein, 178 aa, Artificial Sequence
  Synthetic
SELEDIIRKLDEILKRNEEENRRVIRRLRELLEEDERRNRKAIEDLERIITKLKDDVRKLKGDEKVLRELEETVEKVIRELRKILEDSRRHIEKVLREIEKILRESERNARKVVEDLRSKPLDRDAERRIREVEEEVKRILEETEEVLRDVKRRVDEILKTTEDRIREIEEEIKRTVK

SEQ ID NO: 9987 - protein, 178 aa, Artificial Sequence; identical to SEQ ID NO: 9986
  Synthetic

SEQ ID NO: 9988 - protein, 178 aa, Artificial Sequence
  Synthetic
DELRDIIRELRDILRENKKRNEDAIRKLRKILKENEKKNRDAIRELEDILEKLRKEIEDLKGDERVLREITKRVRDALERIKRILEESEDDIRRVLEEIEEILRRSKKNIDDAVRKLRSKDLDRKVEEDIKRVEEEVKKILDKTDEELKEVERRVRKILRETEEELKRVEDEVRRAKT

SEQ ID NO: 9989 - protein, 178 aa, Artificial Sequence; identical to SEQ ID NO: 9988
  Synthetic

SEQ ID NO: 9990 - protein, 177 aa, Artificial Sequence
  Synthetic
REEEKARRVMEKLKRDVDRINTRHRDILKKIEDEVRRIDEEHKTEVKKIKDRAEEIIRRIDDEKTVREARDIVRKIEEEVRRSNKTTEEVLRRAEDRVRKSNETTRRLLEKLERELREREPDKDLIREVEKILKDIEDLVRESERELREILKDIKRMVDESLKRLEDILRELEERTR

SEQ ID NO: 9991 - protein, 177 aa, Artificial Sequence; identical to SEQ ID NO: 9990
  Synthetic

SEQ ID NO: 9992 - protein, 177 aa, Artificial Sequence
  Synthetic
REEEEMRKVVKDLEDAARELDRDHETKLRRIEEEVKKLNEEHKRELERIARRIKEIIDRIEDEKVVREIRKILEEVRKRAEDSNKETEDILRDVRRRAKESNDRSREVVREARKEVREKRPDKDLIRRLEEILRRIARELEDSLRKLEKILEEIKEIVKKSLDELRRIVDELEKRVR

SEQ ID NO: 9993 - protein, 177 aa, Artificial Sequence; identical to SEQ ID NO: 9992
  Synthetic

SEQ ID NO: 9994 - protein, 177 aa, Artificial Sequence
  Synthetic
SEEEEVRRVLKRIAEEVKRLDEDHRRILEEIRKKVEKSSRDHKRELDKIKRDADEIIRRISDEKVVREIKRIVEKIEKDAEKVNRETKRILDELARRVEESNKRSEDVLRELEKEVRDKEPSKDLIKKLEEILEEIRRLLEESLRELEDILKKVHDRNARTLERLREILKEIEDRAR

SEQ ID NO: 9995 - protein, 177 aa, Artificial Sequence; identical to SEQ ID NO: 9994
  Synthetic

SEQ ID NO: 9996 - protein, 177 aa, Artificial Sequence
  Synthetic
DEKRKVDKRLKEIEETIRRLLEEHRRELDEIRKRIEEISRRHRKELEDIEREVRKIISRIDDERTVERIREELKRVKEDADEVNRKLKEILERIEKRARESDEKVKRILDEIRKKVRDREPSEDLIRDVERVMREVKRDLERSLEELRDVVRRAEEEVRATLRKLREILKKVEDETR

SEQ ID NO: 9997 - protein, 177 aa, Artificial Sequence; identical to SEQ ID NO: 9996
  Synthetic

SEQ ID NO: 9998 - protein, 177 aa, Artificial Sequence
  Synthetic
SEEETMRKVVKEIREKVRRISERHKEELERITDALRRSSKRHEDELREIEKAVREIIRRIDDDKTVKEIKKILDDARDRVKKVNDKTDDDLKKIKKDAERVNRELERELRKAEEDARRREPSDKLIRELEEILERLEREVRKSLDRLRKILEDIHRTNKDTLDRLREILKKVEDRTR

SEQ ID NO: 9999 - protein, 177 aa, Artificial Sequence; identical to SEQ ID NO: 9998
  Synthetic

SEQ ID NO: 10000 - protein, 185 aa, Artificial Sequence
  Synthetic
SEVEEVIRRLEELVDRLHKINKRAIEENERLNRELHEKNRDIIRKLKELVERLRDIKEKLSDKETLRRILEEIKTRIEDLTRRARETNEEIKRRSDKTLKDIRKINRDIKEEIKKLVREIEERITDKETADRARDEVRRIEKELDDSLRELEKRVRDSKRHLDRSLEELEKVVDEIRKELEDLAK

SEQ ID NO: 10001 - protein, 185 aa, Artificial Sequence; identical to SEQ ID NO: 10000
  Synthetic

SEQ ID NO: 10002 - protein, 185 aa, Artificial Sequence
  Synthetic
KEVEEVIKRLRELVDRLEKENRDVNEDNKRLNEELHDRNRKMIEELRRLVTELEDIRRKLKDKDTLEEIIREILKRIEDLLKRIREINKKILEESRRTLEEAKKRNEEIRREIKRLLDELRKRITDKDLLKRVEDEARKIEEKLKRIHEETKKVADDSERHLRKSLRELEKVAREIKKRLEEERK

SEQ ID NO: 10003 - protein, 185 aa, Artificial Sequence; identical to SEQ ID NO: 10002
  Synthetic

SEQ ID NO: 10004 - protein, 185 aa, Artificial Sequence
  Synthetic
DEVREIIKDLRRLLKELEERNREINDRNKKLNDTLRKELEDIKRRLEKLLRELEKIVRELSDEDTLREIVERIKKRIRDLLEEVRKRIEEIKRRSRETLKRIKEINEEIKKRIRELLEEIARRITDEEVLRRVEEEVRDIERRLDKIHEDTRDTAEKSERHLDALLRDLERVAREIEEALDRLKD

SEQ ID NO: 10005 - protein, 185 aa, Artificial Sequence; identical to SEQ ID NO: 10004
  Synthetic

SEQ ID NO: 10006 - protein, 185 aa, Artificial Sequence
  Synthetic
SEVEEVIRRLRELLRTLEEENRKMIRENERLLEELKKRNEDIERELRKLVTELAKIADKTRDKDTLEKILREIEREIDRLLDEIHKINREIIKRSRDSLREAHKRNKEIKERIEKLLRDLEARITDEKLARELREVAERIKKRLDEIDETTRRMVTESIKRLEEIDKRTTERAREIKKELRDRAT

SEQ ID NO: 10007 - protein, 185 aa, Artificial Sequence; identical to SEQ ID NO: 10006
  Synthetic

SEQ ID NO: 10008 - protein, 185 aa, Artificial Sequence
  Synthetic
SEVEDLIRRLEELLDRIRRDNERIIKELEELLRELEETNKRLIERIRKLLEDLRDTVRKLSDKDTLRKILEEIRRTIDKLLKEIHDTNKRIKDEIERLLREIHRDNERIKDEIRRLLEDIARRITDEKLMREAKEAVDRIKKRLDEINKRTEDVARRIRKRLDEIDERTKEEAKRIKEELDKEEK

SEQ ID NO: 10009 - protein, 185 aa, Artificial Sequence; identical to SEQ ID NO: 10008
  Synthetic

SEQ ID NO: 10010 - protein, 185 aa, Artificial Sequence
  Synthetic
SEVEELIERLKELLERLEELNRRVNEENRRLNEELERRIRKAIEDLKDLLRRLDDIRRRLKDKDTLRKILEKIKRDLEDLIRKLRETLRRIKEESERTLKEIAEMNKKIKDELERLVREIEERITDEKKLRELKEVVDRLKKEIKRIDEETRKEAERSKRNLEKILRDLEREAKRLKEEIDKKAR

SEQ ID NO: 10011 - protein, 185 aa, Artificial Sequence; identical to SEQ ID NO: 10010
  Synthetic

SEQ ID NO: 10012 - protein, 182 aa, Artificial Sequence
  Synthetic
DEIRDLLRRLRELNKRIADRIRKLNEENKKLNKEVADKIRKLNREAREIIKTIAEIIKSGNRDRRVIETIEKLLRDVLKRSEDLLREAEKLDKDSLDRSKKIIKEAEDLNREILERIKKAGVPKEVLDRAKEEVDRSRKHLKELLDRSRETSDRSRRHLKDLMRRSRETIRKLDEELKRLEK

SEQ ID NO: 10013 - protein, 182 aa, Artificial Sequence; identical to SEQ ID NO: 10012
  Synthetic

SEQ ID NO: 10014 - protein, 182 aa, Artificial Sequence
  Synthetic
SEIEKLIREAERIIEEIAKEIKDLNEENERLNREVDKRLTDLNRRAKELLEEVKRIIDRGDRDKRVVDEVRKRLEDLLEESKRLIKEARDLDRETLEKSERIIDRIRELLRDVLRRVEEAGVDEEKLRDARREIERLRRELEKLLEDSRRTSEESRRNLERSLDESRKTIEELIKRLDDAER

SEQ ID NO: 10015 - protein, 182 aa, Artificial Sequence; identical to SEQ ID NO: 10014
  Synthetic

SEQ ID NO: 10016 - protein, 182 aa, Artificial Sequence
  Synthetic
SEIEKLIEDAKRILEEVARRLKKINEDNDRLVRKIADELRRLIEEAKKILDEIKKIIEDGDRDDRVIREAEELLKRILERVKKVIEDARRLDEETLRRSKKLVEEVEELLKKALDDVEKAGAPEDVLREVRKVIKKLRDELEELARRSRKTSEDSRKRLDDLLKRAREVIEELKKRLEDLRR

SEQ ID NO: 10017 - protein, 182 aa, Artificial Sequence; identical to SEQ ID NO: 10016
  Synthetic

SEQ ID NO: 10018 - protein, 182 aa, Artificial Sequence
  Synthetic
KDIEKLIKDLEKLNRDIAKRIRDLNETNKKLVRDVAEEIKRLNEELKKLLEDIRRIIERGDRDRRVTETARELLERVRKESRRLFEEIRKLDEDTLRESERIIKEAKDLNEEVRERLERRGAPEEVLKRAREMVKRSKEHLDELLKRSEDTSRESKRRLEKLLKESEDTIRRLEEELKKAEK

SEQ ID NO: 10019 - protein, 182 aa, Artificial Sequence; identical to SEQ ID NO: 10018
  Synthetic

SEQ ID NO: 10020 - protein, 182 aa, Artificial Sequence
  Synthetic
KEIEELLEEIERILREIKKDLERINKENEKLNREVKKKIEDLIREVRKIIEEIRRIIERGDRDKRVFDEIRKLLEEILKRAEDLLRRARELDKKTLDESEEVIDRVRKLLERILKTVEDAGVEERKLKEVRDTIEELKKRLEKLAKESRDTSRRSRENLERLAREFREEIKRLKKELEEART

SEQ ID NO: 10021 - protein, 182 aa, Artificial Sequence; identical to SEQ ID NO: 10020
  Synthetic

SEQ ID NO: 10022 - protein, 182 aa, Artificial Sequence
  Synthetic
SEIEKLIRDAEKILEEIAELIKRLNEENKELNERVAKRIKDLNEELRRLLKEIADIIRRGDRDERVIRTAEKLIEDVLRRSERLFEEAKKLDEDTLKKSKDIIRRAEELLRKILKELEDAGVPREELEKVRKVIDKLREELKRLERESERTSEESRRNLERLLRESRKTVEEIKKRLDELRK

SEQ ID NO: 10023 - protein, 182 aa, Artificial Sequence; identical to SEQ ID NO: 10022
  Synthetic

SEQ ID NO: 10024 - protein, 182 aa, Artificial Sequence
  Synthetic
SDIERLIAELEKLNKEIEDKIRELNRENRRLNKEIDEEIERLIEEARKIIEDIREIIRRGDRDDRVIKKIRDLLEDILDKVEKLLRELEELDKRTLDESERIIDEAKKLNKEVEDELERRGVDRKKVEEARKKIEDSKRHLEELLRDSRRTVKESNDNLRRSAEKARREIKRLEEALKELRR

SEQ ID NO: 10025 - protein, 182 aa, Artificial Sequence; identical to SEQ ID NO: 10024
  Synthetic

SEQ ID NO: 10026 - protein, 181 aa, Artificial Sequence
  Synthetic
DEVEKVVRELEEVLRRNKELLEKTKKETKEALDRNRELLEDTKRKTREILERLKKVIKEGRDRREVRETVKKAEKENEEANRRSRKHVREVKERNKRMNEESRKHVDRVVRKIAEVEKRLTDEEVVKRLRDILRRVKEAAEELHRDDERELRRVEKELEELHKDDRRVVEEVKDDVRKAEK

SEQ ID NO: 10027 - protein, 181 aa, Artificial Sequence; identical to SEQ ID NO: 10026
  Synthetic

SEQ ID NO: 10028 - protein, 181 aa, Artificial Sequence
  Synthetic
SDAERVVRELRKILKEIEDTIRKSKKETKEMLDRNRELARKVKEELKEILRRLEKMKRDGKPDEEVEKLVREAKKRVEDVIEESRKHVEEVEKRNRDINDDTRRKLETVERKLREVEKRLDDERLLRELRRIVEEVKRAVEELNRDDRRTLERVKREAKKIHEDLRRVVEKLERDVEEARR

SEQ ID NO: 10029 - protein, 181 aa, Artificial Sequence; identical to SEQ ID NO: 10028
  Synthetic

SEQ ID NO: 10030 - protein, 185 aa, Artificial Sequence
  Synthetic
DEVEKLKRELDKILEDLERLHRRLEEELRRIHEENRDLSRRTKEELDRILKRIEELLRERRDKSVVDEVRELLKRAEERVRKANEDSKRLSKEVADTVREASRRSKEILDELKKRVEKAEKDLTDDEKVLEELRRILRRVEEAVRRLNERSEEVLRDVERRDEELNEDNKRRLEEVKKRVEDLLR

SEQ ID NO: 10031 - protein, 185 aa, Artificial Sequence; identical to SEQ ID NO: 10030
  Synthetic

SEQ ID NO: 10032 - protein, 185 aa, Artificial Sequence
  Synthetic
SELDELKKSLEEIHRRDREKNRKLKEDLKRILDEIRKRLEESKKRLEEILREIERLLRERKDDSVRREIKKLLEEIKERVKKVDKETEDLLREAKKEVRRLEEDDKRSLKELTDEVRDAERRLTDDEKALKELRKILEDVARANEELNRDTRRTLERVEEEVEKLNRDHKRVLEKVERDVRRLTK

SEQ ID NO: 10033 - protein, 185 aa, Artificial Sequence; identical to SEQ ID NO: 10032
  Synthetic

SEQ ID NO: 10034 - protein, 185 aa, Artificial Sequence
  Synthetic
SEVERLKEELKRILEEIKKLVDDSKKDLERIHREDKKKNEDLKKRAEEILREIRDLLTKRRDKDVRKRIRELLEKLAREVEDMSRKDKESLDELEKRARDVNRRLKELLKRAAERIRKAEEDLTDDEKLLRDLRRVLEEVKRAVDEISKDHKRMLDAVKKANEELNDDSRRVLERVDREVKKAEK

SEQ ID NO: 10035 - protein, 185 aa, Artificial Sequence; identical to SEQ ID NO: 10034
  Synthetic

SEQ ID NO: 10036 - protein, 185 aa, Artificial Sequence
  Synthetic
SELDRVREEAKRIDDENRKRSEDSVRDSERLLREIEELHRETKERSEELLKRVEEIVRDRGNDEEVTKDLKRILDELRETHKRVLEESKRLLEEARRRHEEVIRRLEESLERLKRKVDEVKKRLKGDRLLEELEKVLRESARRNERIITENRRTMKRVSEEVEKLNRDDKRRMEELEKRAREIIT

SEQ ID NO: 10037 - protein, 185 aa, Artificial Sequence; identical to SEQ ID NO: 10036
  Synthetic

SEQ ID NO: 10038 - protein, 185 aa, Artificial Sequence
  Synthetic
SELERAVEELEKLLKELEDLHRKSKEDSKDMLRRVEELHRRTKEKSKRILEEIERRITEEGRDEDVERKIREVVERARKLHEEVLKRSKDILEEIKKLHEDVERRSKKLLDDLRKRVEDVKRRLTGDELMRKLEEILKRVAEAIKRLIDDDRRVLKRVAEEVKKLNEDDKRVADEVSERIKERLT

SEQ ID NO: 10039 - protein, 185 aa, Artificial Sequence; identical to SEQ ID NO: 10038
  Synthetic

SEQ ID NO: 10040 - protein, 185 aa, Artificial Sequence
  Synthetic
DELEEAEERLREIDKRNEDLHEESRKESKRLLDELRKLVEDVKRELEKILEEAKDIVRKRGKDKDVEKTLEDILREVETRVKEVIKDIERILKEIRETHRRVIERSKRSLEAVKDLVRRVEKDLTGKEKLEKLRDVLRESERRNRELIEEDKEVMRRVSEEVKKLIDDLRRALEKAARDVEKIRR

SEQ ID NO: 10041 - protein, 185 aa, Artificial Sequence; identical to SEQ ID NO: 10040
  Synthetic

SEQ ID NO: 10042 - protein, 185 aa, Artificial Sequence
  Synthetic
SELEDAERRAEEIDRRNKRTVERVEEELEKILREVEELHRRTEEKSKRILDEIRRKIRDRGKDEDVKREIREMVERAKKLHKDVIDESRKILEDIRRKVEKVIRDLERSLEELKKEVKEVEDRLKGKELADKLRDVLRRSAEENKKIIDRLRKILEDVARAVEELIKRDKRVMEEVKKEIDKLLT

SEQ ID NO: 10043 - protein, 185 aa, Artificial Sequence; identical to SEQ ID NO: 10042
  Synthetic

SEQ ID NO: 10044 - protein, 184 aa, Artificial Sequence
  Synthetic
SEVEEIKKRARKLLEEVREIVDRVKKLHERLLREIEKTNREAKREHKRVLDTIRDIFRRIDSEDVKRILRELEERLDKTTKDLEEINRRALEKVDETSKRVKRELERILEELDRLAKDIKAKLDEAETVADLDREIRRLKDELRRILEDLRRVSEEVKKELEKLTRDTRRVSKEVKDELKKVEK

SEQ ID NO: 10045 - protein, 184 aa, Artificial Sequence; identical to SEQ ID NO: 10044
  Synthetic

SEQ ID NO: 10046 - protein, 184 aa, Artificial Sequence
  Synthetic
REVDEIKKRLTEMLETVRKIVEEIRRELEKLLEDVREINERVKEEHERILKDIRDVARKIDSEDARKILTDALRDLDRTTRDLERKNREILKRLDDLVKEIRRRLTEILDRARKLVEDIERKLDDGETMEDLKRRVREVEKRLEEILRRLDDVVRKIKEELKKLTDDTRRVSKRVKDDLERTRT

SEQ ID NO: 10047 - protein, 184 aa, Artificial Sequence; identical to SEQ ID NO: 10046
  Synthetic

SEQ ID NO: 10048 - protein, 184 aa, Artificial Sequence
  Synthetic
SRVEEIKKELRRLLEEVRKKNEESKERDRRLNDTIRRELEEIIRRLRKLLEEIRRLRERIDSEEVRKILRDLLKRLDDLVRTITERLKRINEESNRLAEEDVRTLEKILRDLEELAERVERELDEARTVEDLRRVVEKVLRDIKRSIDDVRRENKKSNEDARRWLEELKREVKRLKDELREIEK

SEQ ID NO: 10049 - protein, 184 aa, Artificial Sequence; identical to SEQ ID NO: 10048
  Synthetic

SEQ ID NO: 10050 - protein, 181 aa, Artificial Sequence
  Synthetic
SEVERIKRELERLLKEVKDANKRVKDTLRKLLRDVEEMNRRVKRENHELLRRLDELVKAGRDEETIKKVKRESRELLRELAKVNRDVKERIEELLREVKKLNEDVKRKLRELLKELEERIRDEELLKDVRKVAKEVEEELKKLHDDTKRVADKVKEDLDRLHRDSERNARRSEEEMDKRRK

SEQ ID NO: 10051 - protein, 181 aa, Artificial Sequence; identical to SEQ ID NO: 10050
  Synthetic

SEQ ID NO: 10052 - protein, 181 aa, Artificial Sequence
  Synthetic
DRVREVKERLKKLLEEVERTNREVMERNHRLLEDVERKNRRVKEENHRLLEELKRLREDGKGDEAVKRVLEESKKLLDDLSEENKRVKEESDKLLDEIRKKNEDVKRKIRELLDRIRKEIEDERLLEDVERTAERVERELDRLHEETKRNADRSREELEKLHRDSEKNARDSAKELEKIRR

SEQ ID NO: 10053 - protein, 181 aa, Artificial Sequence; identical to SEQ ID NO: 10052
  Synthetic

SEQ ID NO: 10054 - protein, 181 aa, Artificial Sequence
  Synthetic
DEVERAEEELERLLRELKKLHEDAKERARELLKRIEDVNRKVKEELKRLLDTIRKLREAGRDESTVKEVKDRIEELLKELERLNREVKERIRRLLEEIHKLDEEVNREIERLLREVTRRIKDKDLLEKVKRVVEEVHKRSRELNEDTRRVIDKVEKDLDELHRDSRRVVETVKEELEKLRK

SEQ ID NO: 10055 - protein, 181 aa, Artificial Sequence; identical to SEQ ID NO: 10054
  Synthetic

SEQ ID NO: 10056 - protein, 181 aa, Artificial Sequence
  Synthetic
KEVEEVKRRLREVLKRLKEMHERVKRELEKLLKKVEDFNRDVKRKNHDLLRRLEELKKAGEDEKALKEVIDTSRKLLKDLAEVNEEVRKEIEELLKEAHRVDREVNEELRKLLEDITRRIRDKDLLEDVEREARRLHDESRKLNEDTKRVVDTVTEELKKLHRDSERNAKRSEEEMDKRRK

SEQ ID NO: 10057 - protein, 181 aa, Artificial Sequence; identical to SEQ ID NO: 10056
  Synthetic

SEQ ID NO: 10058 - protein, 181 aa, Artificial Sequence
  Synthetic
DEVERVKETLDKLLDDVRKLNEEVKKRLEELLEKVERDNRKVKEDNHRLLEEVKDLKRRGKDESALEEVKRRSDKLLEDVHRVNRTVEEEIKRLLDEVRKLNEDVKRKIRKLLEDIRRKIKDKDLLEDVERRAKRVEEELDKLHEDTRREADRVRRDLRRLDEDTKRNVDESRKELEKTRK

SEQ ID NO: 10059 - protein, 181 aa, Artificial Sequence; identical to SEQ ID NO: 10058
  Synthetic

SEQ ID NO: 10060 - protein, 185 aa, Artificial Sequence
  Synthetic
SEVEEVIRRIRALVEEIARKNEDILRKNRKLLEDLRELVERVIKEIKELIDRLADEVRRVKDKETVKKLIDDIRKRVEKLAEDLTRLIKEIKDRSRKTLEEAHKLNRDIIRDIRRLLEELRKRVKDDRVRKEVEEVLRDVEERIRRLDEEVRRRAEESERELERLREKVEDMIEKVKRALEELRR

SEQ ID NO: 10061 - protein, 185 aa, Artificial Sequence; identical to SEQ ID NO: 10060
  Synthetic

SEQ ID NO: 10062 - protein, 185 aa, Artificial Sequence
  Synthetic
SELEEIIKKLRKLVEDVARRNEELIKKLEETNKRLEDEVRELIEEIKKLIDELAETVKRIEDRRTLEDLIRKIKEEVEELLRRIRERVKEVDKEDKDLIKRIHDDNREILKRLEELLRRAEDKVKDEEMKKRLRDVAEKLKEDVRDLDRKVKKVAKESHERNRRILKELEEVAARVTERLEELRR

SEQ ID NO: 10063 - protein, 185 aa, Artificial Sequence; identical to SEQ ID NO: 10062
  Synthetic

SEQ ID NO: 10064 - protein, 173 aa, Artificial Sequence
  Synthetic
DEDERVDEVIKKVREDLRKLLEDSERVVKRSKEELDRWRKKVEDVMRDSDRRLEELRRDKRLEEIKRRSEKTLKEAEDLIRTIKRISEKTLEEDRELIKRAEEEVTRIEEEAKRGDNREEVIKELKKLIDKLREDSKKTIEENKKMNKDAADEIEKIIEDNRRLIKRIEEEDR

SEQ ID NO: 10065 - protein, 173 aa, Artificial Sequence; identical to SEQ ID NO: 10064
  Synthetic

SEQ ID NO: 10066 - protein, 173 aa, Artificial Sequence
  Synthetic
SEDERVEEVVKRIEDKLRRLLEESKRVVDDSKRRLDEWRKEVEKVVKKSTDDLEKLRRDKVLEEVKKISKETLDEARKLIDDARKRSDETLKRDERVIREADKKVKEITKRARDGDNREEVIKELEELIERLARISKKTIEEDRRVNKELAERIKEIIERNRRVIEEARERLR

SEQ ID NO: 10067 - protein, 173 aa, Artificial Sequence; identical to SEQ ID NO: 10066
  Synthetic

SEQ ID NO: 10068 - protein, 182 aa, Artificial Sequence
  Synthetic
KELEELIEELERLNREINERAKELIKKLRKLNEEVARRHERLIEELRRILEELKELLERGNRSDELLKRIRTMVEKVRKDNEDSLRELKELTDRVMRELTELLKEAKKLTDEIADRLRRIPLDEELRRRAKRVLEESKRNIEKVAEDVTRVLRESEESLERLRERSERVLREVEKTIRDMAR

SEQ ID NO: 10069 - protein, 182 aa, Artificial Sequence; identical to SEQ ID NO: 10068
  Synthetic

SEQ ID NO: 10070 - protein, 182 aa, Artificial Sequence
  Synthetic
SEVERLIEELDELNRRINEKHKKLRRELEELNKRVAERHEELIRRLRKLLEDLERLARRGNRSSKLLEDIKRLVDEVRERNRESLDELRRLTRTVAERNKRSLEEARELTERVRKKAEDVPLSEELRKRVEDALRRSKENIKRLEEESREVLRRSEKSIDELRRESERVLKEVKEEIERVRK

SEQ ID NO: 10071 - protein, 182 aa, Artificial Sequence; identical to SEQ ID NO: 10070
  Synthetic

SEQ ID NO: 10072 - protein, 182 aa, Artificial Sequence
  Synthetic
SELEELIKELRDLNRRINKRVDDLADELRRLNERINRRHEELIKELRRLLEDLKRKFDRGDRSSDLIREARELLKRIEERNRDSLRELEELSRRVEEDARRLLDELRRLTEEVKKRAEDVPLSEELKKRADDVLRESKENIERVERKIRRVLEESEENIEDLRRRSKEVLDEVRKRIEDIRR

SEQ ID NO: 10073 - protein, 182 aa, Artificial Sequence; identical to SEQ ID NO: 10072
  Synthetic

SEQ ID NO: 10074 - protein, 182 aa, Artificial Sequence
  Synthetic
SELEELIRRLKELNKDVNEKHKRLIEELEKLNRDINERHKELIEELERLLRRLEKLLRDGNRSSELMERIRRLIERVRDENRKSLETLKRLSDDIERKNRESLKRLKELTDEARKRLEDIPLSEDLRREAERVLRESEENIKELEDRSRDALRRSEENIRRLKKESEDVLREARREVERLER

SEQ ID NO: 10075 - protein, 182 aa, Artificial Sequence; identical to SEQ ID NO: 10074
  Synthetic

SEQ ID NO: 10076 - protein, 183 aa, Artificial Sequence
  Synthetic
SLEEELDKVLKESRDNVRRVEEELEEVMEKSERAAEKLRRDLDRVLEELEKMIRDLKRRGVPKDEVDRVLEELRRLADKLREDLDRVLKESKESIDRLRERVKEVKEESEELARRLKEKSRDIDREDIKRVIDTLRKLNERLNREVKEVIKRNEELVRRLAERVKKVVEDLRRLVKRLDDEVR

SEQ ID NO: 10077 - protein, 183 aa, Artificial Sequence; identical to SEQ ID NO: 10076
  Synthetic

SEQ ID NO: 10078 - protein, 183 aa, Artificial Sequence
  Synthetic
SLEETLKEVLRKSEENAERLKRELEKVLRKLEEDLRRLDERLDEVLKRSRDEARKLREADVPKDDVDRVVEESERSIRELKKEIKKVEDDLRKLATDLERRLEEVKERSRELVDRLRKKAKDIDREVIKRVIEDLDRLNDELNKEVEEVIRRLEDIVRELEKKIREVIKRNKELVDRLEEKVR

SEQ ID NO: 10079 - protein, 183 aa, Artificial Sequence; identical to SEQ ID NO: 10078
  Synthetic

SEQ ID NO: 10080 - protein, 183 aa, Artificial Sequence
  Synthetic
DLEKRLRDVLKESDENIEELRRELREVLKESEDNVKKLAEENKEVTDRLREEIKRLKEEDVRKDLVEEVRRRLERISEENKKTLDDVKKESKKLVDEVEKTLRDVKRESERLARDLERKKDKISKEEIERVIRELKDLNRRLNEELKRAIKRIKELNKRLNELSKRSIDELRRLVEELERRVK

SEQ ID NO: 10081 - protein, 183 aa, Artificial Sequence; identical to SEQ ID NO: 10080
  Synthetic

SEQ ID NO: 10082 - protein, 183 aa, Artificial Sequence
  Synthetic
SLKEKLEEVLRRSEENVERLRKENEDVAKKNREAIEEIKKRLDDVLRELRERIERLKKEGVPGKDVERVREELEKLVTELRERVKKVAKELEELHRRLDRELEKVKETSKRLVEDLDRKSKDIPEEVIDRAVEELKKLNDDLNRTVKKVIRESEELTETLRKDVKRVVDDLRRLVEELARRVK

SEQ ID NO: 10083 - protein, 183 aa, Artificial Sequence; identical to SEQ ID NO: 10082
  Synthetic

SEQ ID NO: 10084 - protein, 183 aa, Artificial Sequence
  Synthetic
DLEEELKEVLKESEENIERLKRENDRVVEKNKKAVDDLRERNKRVTERLREEIERLKRRGVPGKEVDDVRRRLEEISKRNKETLDDVLRKLEKLHRDLDEDLKEVKKTSRKLVEELRRKRKDIDKKDIKRVIDELRKLNEDLNRRVKEAIKTSEKITDDLRRMSEESEKELRELVRRLEERVR

SEQ ID NO: 10085 - protein, 183 aa, Artificial Sequence; identical to SEQ ID NO: 10084
  Synthetic

SEQ ID NO: 10086 - protein, 186 aa, Artificial Sequence
  Synthetic
SEVEEIIRRIDELIKRLAETVKEIVDRLRKLNKKLNDENREIIKEIRDLIRELAKEVKRIKDRDTLEKVLEDIEREVEKLMKRSRDLNEEVLRTSEKLADDARRTLKEIEDRVRELVKEAEDRIRSIEEVRERLERVLRRVEEVIKRLKEELKKVLDESRKNVEDVTRENEKVLDEVRKTIDELRR

SEQ ID NO: 10087 - protein, 186 aa, Artificial Sequence; identical to SEQ ID NO: 10086
  Synthetic

SEQ ID NO: 10088 - protein, 186 aa, Artificial Sequence
  Synthetic
SEVEELIKTIERLIKELEKLNEEIIKRLRDLNKRLNERNEEIERTLRKLITDLARMVREVKDRETVERVLDEIRKEIERLVKESKDENDRALDRSDELVRRSERKNEKIEDEVRKLAKDITDKVKDIEEVLRRLEEVLDRVKKKIKTLTDKNREVLERSRENVKKVTEDNERVLRKLKEDIERLRK

SEQ ID NO: 10089 - protein, 186 aa, Artificial Sequence; identical to SEQ ID NO: 10088
  Synthetic

SEQ ID NO: 10090 - protein, 186 aa, Artificial Sequence
  Synthetic
SELEEALKDIKRLIDKLRKDNEDIIRRLRETNDELRKLNKKIIDEIRDLIRRLEEVAKRIKDEKTLEEVLKRILDEVRKLAEESKRLNDKVREENERLVEKSRRTNKEILERVERLAREITRRIKDDKDLKKRLEDVVKRVREEIEKLTRDNERVLEESRRTLEKLTRENEKVLREVKKKIDDLRK

SEQ ID NO: 10091 - protein, 186 aa, Artificial Sequence; identical to SEQ ID NO: 10090
  Synthetic

SEQ ID NO: 10092 - protein, 186 aa, Artificial Sequence
  Synthetic
SELEDVEEKIKRLIDRLRELNKKIEDDLRKLAKELADLNKKIIREIEELIRRLAEVVKRISDKDTVRRVLREILKRVERLVRESKKKNDDVRRELEELVKRSEDANKEVLKRVRELAEEVRRRIKDVEELKRRLRKVLERVKREVEKSSERNREVVERLRKELERLTRENEEVLKRVKKEIERLEK

SEQ ID NO: 10093 - protein, 186 aa, Artificial Sequence; identical to SEQ ID NO: 10092
  Synthetic

SEQ ID NO: 10094 - protein, 186 aa, Artificial Sequence
  Synthetic
SEVDEVIKRLDELIEELRKRNDDIIREIEKLIKRLEEENKEIVDRIRELIKRLEDMVRRLKDKKTVDDVLKEIEDRVRELAKRSRERNEEVLRRVERLVRESRKTNERILRRIEELFDRIRRRMKDDKDVLDRLREVLDRLRKEIERLTRKNEEVLKDVRRRVKRSSEENEKVLKEVRERIERLKK

SEQ ID NO: 10095 - protein, 186 aa, Artificial Sequence; identical to SEQ ID NO: 10094
  Synthetic

SEQ ID NO: 10096 - protein, 186 aa, Artificial Sequence
  Synthetic
SDVDEVIKRLRELIRENHKRNKKIVDEIRELIRELKERNKKIVDEIRELIKRLKDIVRRLKDRDTVRRVLKEILDRVEKLVRKSKKDNERMLERVEKLADDSRKINRDSLRKIEKLIKELEDRIRKDEEVLRRVEEVLRELREAIKRDDEENKKVLEEARKTVEDSSRENKRVLEEVRRRLDEERR

SEQ ID NO: 10097 - protein, 186 aa, Artificial Sequence; identical to SEQ ID NO: 10096
  Synthetic

SEQ ID NO: 10098 - protein, 175 aa, Artificial Sequence
  Synthetic
SEKERAEEVFRESKKNIDDVKRKLERVLEDSKRTLDELRKEVEKVLKESEDELRKLARSEGEEVKRIVDDLRRLSEKSFEEVRELLERIERVSRKIARDLEEILKDAKRKTDELRKEGMTEELIREIRELNKRLNDTIEDVIRRMKDLNRRLAEVIKEIIERNKKLIEDAARRIK

SEQ ID NO: 10099 - protein, 175 aa, Artificial Sequence; identical to SEQ ID NO: 10098
  Synthetic

SEQ ID NO: 10100 - protein, 175 aa, Artificial Sequence
  Synthetic
REKERLKEVVEKSRRNLEKLREDSERVLEKSRRTLERLKKEVEEVLKESEERLRELARSEKEEVEKIVRELKRLSEESMDEIRRLLDTARKLSEKIFEENARILKRLDELTKELEKEGVTEELIKTIEDINRRANEESKRTEKELEDINRKLEEDIKRIIDRNRKMIEDAARKIK

SEQ ID NO: 10101 - protein, 175 aa, Artificial Sequence; identical to SEQ ID NO: 10100
  Synthetic

SEQ ID NO: 10102 - protein, 175 aa, Artificial Sequence
  Synthetic
REEERLEEVLRRAEEILKRLEDEVRKVVEDSKKNIEDVRREVEEVLKKSEDRLRKLARDSGEEVKKIVTELTERSKKSVEDVKKLLDDLRELTKELERRARELLKELRERIKRLEDEGVTEELEKRLKEILDRAAEEIRRIIRELEELNKEANDRIRKIIKENEDLIREAEERTR

SEQ ID NO: 10103 - protein, 175 aa, Artificial Sequence; identical to SEQ ID NO: 10102
  Synthetic

SEQ ID NO: 10104 - protein, 180 aa, Artificial Sequence
  Synthetic
ELEERIKKANEDSKRTLRELMERVRKANEDSKRKLEEIREKVERANRESKKILDELRKAGIDKRLEEELRKVNEETRRTLERLAEKVEAVNDKTRKILAELEKEVREVNKKIRDDLSKPVDEKVIRELIKELKDVNRALEKKAKELIDELEEVDKDLEDKVRELIRKLKEVNEDLKRKAD

SEQ ID NO: 10105 - protein, 180 aa, Artificial Sequence; identical to SEQ ID NO: 10104
  Synthetic

SEQ ID NO: 10106 - protein, 180 aa, Artificial Sequence
  Synthetic
SLKERVKKVLEESERNLEENKKDAKRVNDETRKKLKELEDRADRVNRETERALRELEDNGVSDEIKERMKEVNKKHREILERISREVKRVNEEHKEEVDRLEKEMRDVNKKVKEELSEDRDEKVVREVIEELKRVNDKLNDASRRLNERLKRVVEDVERRVRDLNKELEDVVEELKERTR

SEQ ID NO: 10107 - protein, 180 aa, Artificial Sequence; identical to SEQ ID NO: 10106
  Synthetic

SEQ ID NO: 10108 - protein, 180 aa, Artificial Sequence
  Synthetic
ELEERIKRVIDELRRRLEELRRELKRVNDKTEEDLRRLEDNARRVNDTSRKMLERLEDGGVDEKIAKEVRDVNEKHKEDVKRISDEVREVNKRHKEIADRIEEKVRRAEEEIRKKLSKPTDETVVREIIRELEKVIEELEREVRELNRELREVVERVAKKVRDLNRELEEVIRDVKRKVD

SEQ ID NO: 10109 - protein, 180 aa, Artificial Sequence; identical to SEQ ID NO: 10108
  Synthetic

SEQ ID NO: 10110 - protein, 181 aa, Artificial Sequence
  Synthetic
SLEDEARELRRKSEKTNDELRRAIEELEKKVRDMIRRSEEHVRDLVRKVKRVIEKLEEDGAPRELLEELRKLLRDVEERAKELHKTLKDLLETVKRRAEDILRKNKELLERISREVERVNSDRKDLEELIKELKKLNDESREEIERLIRELEELLKEIEDRNRKLAETLKRLLEEVEKRAR

SEQ ID NO: 10111 - protein, 181 aa, Artificial Sequence; identical to SEQ ID NO: 10110
  Synthetic

SEQ ID NO: 10112 - protein, 181 aa, Artificial Sequence
  Synthetic
SIEEEIKELKDRSKKTNEELKKEIDELKEDSERTNRESRKHVKEVLDRLREILERLRREGAPEELLRELEKLIRDIKDRAEELHKRNEELIRRVEKKAREILKENEDLVREIERRMKEVNSDRKEIKRLIDELTELNKRSKELIKRLIEELKKLNDDSRKENKRLVREVERLAEEVDRRVK

SEQ ID NO: 10113 - protein, 181 aa, Artificial Sequence; identical to SEQ ID NO: 10112
  Synthetic

SEQ ID NO: 10114 - protein, 181 aa, Artificial Sequence
  Synthetic
SLEEKAKRLKEESDKTNKKLRELIERLERESRRTNEELRKKIRELLEDARRELDRLRKEGAPEELLRELDELIKTIVRRLEKILKENADLLKEVKDRLEEILKENEDLVRRVERELRKVNSDEKKVEELRRDLERLDRESEKKIRDLIKTLDELNKESDRKIRKLEEELKRLLEEVEKRVR

SEQ ID NO: 10115 - protein, 181 aa, Artificial Sequence; identical to SEQ ID NO: 10114
  Synthetic

SEQ ID NO: 10116 - protein, 181 aa, Artificial Sequence
  Synthetic
DIEKKIEDLRRKAKKVIDDLRKRSDELKKRSKDTNDRLREELKKLEEDVRRVIEDLRRRGAPEELLDELRRLLDEVKKRAEELLRRNKKLMEEIDRRNKKSLEDLKRLLDEVEEEAKRVNSDDKDIEKLIRDLEKLLRDVEERHEDLRRKAEELDRDTKEKVDRLIKELKDLLKEVRDRVR

SEQ ID NO: 10117 - protein, 181 aa, Artificial Sequence; identical to SEQ ID NO: 10116
  Synthetic

SEQ ID NO: 10118 - protein, 181 aa, Artificial Sequence
  Synthetic
SLKEKLDDLVRKSDDTNKDLEEKARRLVEDAKRVLKELEDKSRRLVEEARKVLKRLEEEGIDKRLLEELERLIDEVRKKNKESLDRLRKLIDDVRKRLEEILERNRRLVKEVEDRARTVNSDDKKIKELIEELEDLDRRSKKAVEDLIKELKKLIDEVREIHDRLEEELRRLIKTVRDKAR

SEQ ID NO: 10119 - protein, 181 aa, Artificial Sequence; identical to SEQ ID NO: 10118
  Synthetic

SEQ ID NO: 10120 - protein, 182 aa, Artificial Sequence
  Synthetic
SLEDKVRKLEEEIKKVLKEIREEVERLLEEDRRTLEDLKRRHRESDRESKEVLDEIAKKVDSEKLKRLEEEVEKLNRENKEAVKRLEEKHRRTLEKLRKVLRELEEEARRLLEELRDMSRMRDDKVIKEVIDTLRKRLEELKRRLEDVIREVRKANEDSERESRDVIRKLKELLERLKEKVK

SEQ ID NO: 10121 - protein, 182 aa, Artificial Sequence; identical to SEQ ID NO: 10120
  Synthetic

SEQ ID NO: 10122 - protein, 178 aa, Artificial Sequence
  Synthetic
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 10123 - protein, 178 aa, Artificial Sequence; identical to SEQ ID NO: 10122
  Synthetic

SEQ ID NO: 10124 - protein, 178 aa, Artificial Sequence
  Synthetic
SEEEKLERVERRLEKVLDEIRRHTEDVKRKDEENLDRLRKKIEKLKRELEKVLRDLEEKRKDAEDELRKLRRRAEEAKRRLDEVKKRLEEISRRTKELLDDVLRRNKESVDRIRREIREKRPTDELVKKLEELLEEDKDTNRKVVKEIEDANRRVNEELDRVIEELKRILEELERRLR

SEQ ID NO: 10125 - protein, 178 aa, Artificial Sequence; identical to SEQ ID NO: 10124
  Synthetic

SEQ ID NO: 10126 - protein, 186 aa, Artificial Sequence
  Synthetic
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 10127 - protein, 186 aa, Artificial Sequence; identical to SEQ ID NO: 10126
  Synthetic

SEQ ID NO: 10128 - protein, 186 aa, Artificial Sequence
  Synthetic
SEVERVKEELKRLLEDLDRKNKRMIDEDERLNKELNEENERLIRELEELLKRLKEIRDKLTDRDTLKKIIDEIDKRLKELIERSRRRNREILEESKKLIEESKRTNREIERRAKKLIDDLRRRVREKEEVKREIDKLREEIREVIERLDKKNEDVLRKSEKNVRDLNRENEEVLRRATEAVRELER

SEQ ID NO: 10129 - protein, 186 aa, Artificial Sequence; identical to SEQ ID NO: 10128
  Synthetic

SEQ ID NO: 10130 - protein, 186 aa, Artificial Sequence
  Synthetic
DEVDKVTRTLEELLKRLEEENRKMIEDDKRLNEELNKENRRVEETLRKLLKELEDIRKDLKDKKTLDEIIKRIKERVDKLIRDSERLNDEIKKRSKKLIDDSRERNEDILRKAEELIKRLREKVREKKEVKEKIDRLEKRIRDAIRELNERNKKALDDSERNVRELNKRNERLREEVERKIRELER

SEQ ID NO: 10131 - protein, 186 aa, Artificial Sequence; identical to SEQ ID NO: 10130
  Synthetic

SEQ ID NO: 10132 - protein, 186 aa, Artificial Sequence
  Synthetic
SEVDEVAKRLRDLLRELEEKLKRAEDRDRKLNDDLNKTNKKLIKELEDLLRKLEEIARRLKDKDTLKKIIDEIERELKRLIDESRRTNKEILDESRKLVEEIEETLRRAKKEAEDLIRRLRERFKDDDEVRRKIDELEREIKEVVDRLRRRLEELLRRSKENVDRLNRENDRVLEEAKRKIRELEK

SEQ ID NO: 10133 - protein, 186 aa, Artificial Sequence; identical to SEQ ID NO: 10132
  Synthetic

SEQ ID NO: 10134 - protein, 186 aa, Artificial Sequence
  Synthetic
SEVDEVADRLEKRLKENRDKNKRVEDEDKRLNKELNDTNRRMEEELKRLLTEIDDIRRKLKDKDTLDRIIERIRREAERLIDESRKSNKRIVEESEKLIRRSRRINEETLERLKKLIKDLRARFKDDEEVRKKIDELERRLKEVIDDSKRRNDELERESRENVRELNRRNKELEDEARKEVERAKK

SEQ ID NO: 10135 - protein, 186 aa, Artificial Sequence; identical to SEQ ID NO: 10134
  Synthetic

SEQ ID NO: 10136 - protein, 186 aa, Artificial Sequence
  Synthetic
SRVDEVIERLERLLRELDKINRDMIEDDKRLNTELNKENKEVEDRLRRLLEELEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 10137 - protein, 186 aa, Artificial Sequence; identical to SEQ ID NO: 10136
  Synthetic

SEQ ID NO: 10138 - protein, 185 aa, Artificial Sequence
  Synthetic
DVEEKVKKVIRELREVLKEIEERVRRVLERNKRSLEDLKRKHKESIDRAKEVLDEIRKDRVDEEKLRRIAEKVKRVIDENERIAKEIKEEIKRVNEKSREILERIADELRKVEEEIKDILAKLRDVEEALKRLEDKLREKLRDLRRKLDELRKENEKVNRDLEDKTRRVIEKLKRVITKLKEEVK

SEQ ID NO: 10139 - protein, 185 aa, Artificial Sequence; identical to SEQ ID NO: 10138
  Synthetic

SEQ ID NO: 10140 - protein, 181 aa, Artificial Sequence
  Synthetic
SEIEEVEKRLEDVLRKVNKKTEDLMRSVKEIIKRSREHLEKVIRDLEEILKELRELRKRGKDKKELEDRARKALEDLDRALKRNKEMHDKSDDESREVNERLNRTHKEVLDRLREILKRVKDEDVKRRIEEVEERLKRDNERNNKKIEDVNRDNRRVAEELRRRVEDVKRKIEKVLRELKK

SEQ ID NO: 10141 - protein, 181 aa, Artificial Sequence; identical to SEQ ID NO: 10140
  Synthetic

SEQ ID NO: 10142 - protein, 183 aa, Artificial Sequence
  Synthetic
DVEELLDRVTKRVEKALRELRKKVRELKEENRKSVEELEETSKRLKKEVDDVERRLEAGNVDEEVLKRLRDILRDIRRKLKEVTDRNRDSARRSREELERVLEDVERIIREAKRRLEEVRRIKDREKLKKVLEEIEKILKEIEDKVRRVIEKSRRINEENKETNRRVIEDVRRLLKKAEEDLR

SEQ ID NO: 10143 - protein, 183 aa, Artificial Sequence; identical to SEQ ID NO: 10142
  Synthetic

SEQ ID NO: 10144 - protein, 183 aa, Artificial Sequence
  Synthetic
RVEERLDEVRKKIDEVLKRLRDTTKELEDENEESLRKLKKEVDEVRKKIEEVLKRLEDANAPKEVLDELRRIVEDIKRRLEEVLEELKRIIDRSKEELKKVLRENEDSARRLKERLKEVERIKDEEKLEKVDREIEEILRRNKRTNEKVAEESRKINREAEERLRRVIEELEKILKEIEDRLK

SEQ ID NO: 10145 - protein, 183 aa, Artificial Sequence; identical to SEQ ID NO: 10144
  Synthetic

SEQ ID NO: 10146 - protein, 183 aa, Artificial Sequence
  Synthetic
SVEKKLKDVEDEIRKVLRELEETSKKLDKEVDDMLKKLKDSTEEVKKEIDEMLKRLEERRLPERVLTELKKIADEARRRLEEVNRRNEESAKEIKKELEKVTKENRDSIEDIKRKLEEVARIKDDEKLDKVVKDLRKLLEDDKRTNKEVIDRVRRKLEENKETNEKVIKELRDILREIEERAR

SEQ ID NO: 10147 - protein, 183 aa, Artificial Sequence; identical to SEQ ID NO: 10146
  Synthetic

SEQ ID NO: 10148 - protein, 185 aa, Artificial Sequence
  Synthetic
SEIEDVARRIRKLLEELRRRIRKIAEDSRRLNRRLEERNTEMEKEIKDRLRKLEEELKRKEDGETVTREIKEAADRLRELLKESKDENEDVARRSEKLLRDAEETLREITERLKDLLKKLRDRTRTEEVKEKIDRLEKEIRDMLKELRERIKRLKDENEKSLEDLRRRNTELEEEVRRVIRELEK

SEQ ID NO: 10149 - protein, 185 aa, Artificial Sequence; identical to SEQ ID NO: 10148
  Synthetic

SEQ ID NO: 10150 - protein, 185 aa, Artificial Sequence
  Synthetic
SELEKVAEDIRRLLKRNEEINREMIKRSRELNEELRERNREVTERIRRLLERLKEERKRTTDGETVERRIREVARRARELLKRSEEMNKEVARRSKKLLDDSKKINDDSRRRLKRLLDELRKRRRTDELEKKLRDLEREIRKVLREAKRLNDELRKENKESLERLKRENDKLRKEVETVIREAEK

SEQ ID NO: 10151 - protein, 185 aa, Artificial Sequence; identical to SEQ ID NO: 10150
  Synthetic

SEQ ID NO: 10152 - protein, 185 aa, Artificial Sequence
  Synthetic
DEIEEVIRRIKRLLDENRKKNEEMSDRSRKLNERLRKIIKKIIDEITELLKRLEDRARTVTDGETLRREIKEIADRAKRLLDEIRKILEDIRKELEELNRRSEEMNKESKEEADRLLEELRKRSRDRKVDKKIEDLRKEIEDVLKELAERNKENKDRNKKSADELRKEIEDLERKVREVIRELTR

SEQ ID NO: 10153 - protein, 185 aa, Artificial Sequence; identical to SEQ ID NO: 10152
  Synthetic

SEQ ID NO: 10154 - protein, 180 aa, Artificial Sequence
  Synthetic
RVEDEIRRLEEEARRVLRELEDLLRRLKKKNDESNKEIRERIERVRRKAEKVLRELERRGVPDEVIRELEERLRRMEKRAEELNKRSKELSDDIVRRLRELIERLKRLIEDVLRKLDRVRDERVIERLIRELRRLLEDVKRKAEDLIRKSEDLNEKWRKELKKLEREIERLLKEVADRVK

SEQ ID NO: 10155 - protein, 180 aa, Artificial Sequence; identical to SEQ ID NO: 10154
  Synthetic

SEQ ID NO: 10156 - protein, 179 aa, Artificial Sequence
  Synthetic
EAEKELKRVEDRDKESNDRTKDILRRIEKEVRESNKRSKEILDEIRKRVRDVIEELRRKRSDLEEVIRELEKILREVEEAVDRINRDNERILEELAERAKRLNDENKKISDDVRRRMNEDEETVRRLKDELEEVNERTERAVRDLLRKARKVDDESRRRVEALLRKVEEVLREIKRRVD

SEQ ID NO: 10157 - protein, 179 aa, Artificial Sequence; identical to SEQ ID NO: 10156
  Synthetic

SEQ ID NO: 10158 - protein, 181 aa, Artificial Sequence
  Synthetic
SFKETLDEIRKRVKEVLDKLEKILRDIARRVEKVNKENEDRLREINRRNEEVLRRLKKKGVDETLLERNRRANERTNREVKKSNDETREVLKEAKKAIEKLLEELRRVLKEVEDRADKKRDDEDKLRELLERLERLLRELERRVEKIEEDLKRILDEVRKRTKELLERNERILEKLERDAD

SEQ ID NO: 10159 - protein, 181 aa, Artificial Sequence; identical to SEQ ID NO: 10158
  Synthetic

SEQ ID NO: 10160 - protein, 183 aa, Artificial Sequence
  Synthetic
SIEDIVREIRERNKDAKRKVEDIVRRNREEIDKVLKRVEKILRDNEKRIREVKEELKERVKSRDLERVEEKLERLLRESKEVFKEVEDRLRDLMRKSDEVARRAEENIKENIRRVEDVARKRLDEKDLDKVRKESEDNLREILRTLKEVHERSKETLKRIEDTLRRVHKKSEDELRRLREEVR

SEQ ID NO: 10161 - protein, 183 aa, Artificial Sequence; identical to SEQ ID NO: 10160
  Synthetic

SEQ ID NO: 10162 - protein, 183 aa, Artificial Sequence
  Synthetic
SIEEIAKTIKEEIKEVMDRVREIVERDEREIKKVKEEVDRIAKRNEDEIRKVKDELDKKVKSDRLERLRDKLRKVEEDSRESLKDVRRKLEEVRRESDEVVRDVERRLEEVLREVEDVLRKRLPEEAMKEVADRVRKKLEEIERTLEEVHRKSRKVLTEIIKKLKENHDRSKELLDRIREEVK

SEQ ID NO: 10163 - protein, 183 aa, Artificial Sequence; identical to SEQ ID NO: 10162
  Synthetic

SEQ ID NO: 10164 - protein, 182 aa, Artificial Sequence
  Synthetic
SEVEEVLKEIKDLLRRLEEIVRRVLKENRRLLEEDVRRTEEILEELERLLDELRKDIKRLDDRDKVEEIVRRAIKELEDLLRESEERNKRSREESEKLLRDLRETIERIRRRLEELLKRLKDRGAPEELLKRIEDEVRRVEDKLRKLIKRSKEESDKVAEELERLNREARKRIRDVMEELKR

SEQ ID NO: 10165 - protein, 182 aa, Artificial Sequence; identical to SEQ ID NO: 10164
  Synthetic

SEQ ID NO: 10166 - protein, 182 aa, Artificial Sequence
  Synthetic
DEAEEILRRLKKLLEDAKRISDRTVEKNREMLKKIEEDSKRSLERNRELLKRIKELAKDIRDDKTLEEMLRELKERLDRSHDENRRLVDRIRDISRRTNEENRRVIKEVEDRLRELLEEAERRGLPREIIERLKEEVDRLLKELRDSNRELKRESDEVVEKLRELNKRSKEEADKVEKDLRR

SEQ ID NO: 10167 - protein, 182 aa, Artificial Sequence; identical to SEQ ID NO: 10166
  Synthetic

SEQ ID NO: 10168 - protein, 182 aa, Artificial Sequence
  Synthetic
SEVDEVLKRLRKDLDKVRKDSKKSLEELRRVLEEVERLSDESVKRLEEVLKRLEDLIKDIKDDESLRRLVDEARKELEAINKRNEELIRRVEEELKEILKRNEEIIRRVEEKLRRILREAERRGVPREIIKKLADEVREVLERLKELNRRLEKEARDAKRRLEESNDRLRRKVEEVIKELRR

SEQ ID NO: 10169 - protein, 182 aa, Artificial Sequence; identical to SEQ ID NO: 10168
  Synthetic

SEQ ID NO: 10170 - protein, 179 aa, Artificial Sequence
  Synthetic
SEVEKLLDESRRVVEENRRANKKLAEESRKAVRRNREESKRLNEELREVVERARRKVTERDKDKDLLRRIIKELRDILERVAEDHRRLIEEHRKIADEVREKVKDLNRRHKEIMERVAREVKKEESLRRIKRTHEETEKESEKTLRDLEDEHRKTIEELERSLKELRDRIKKVLDELRK

SEQ ID NO: 10171 - protein, 179 aa, Artificial Sequence; identical to SEQ ID NO: 10170
  Synthetic

SEQ ID NO: 10172 - protein, 171 aa, Artificial Sequence
  Synthetic
DEVEEVLKKARKDIERWREETRKVKEENKRNIDRIRKKLEEVLRDLKRAIDEIRKSNLDREEVDRVLERLEEKLREMKRRLDENDKRDKERLKKKNKEMEEERRKIEKELEDAGARREVLEEIRKLLRDIKETDRKVHEELERSNEKLRREIEKILRDLEDELRKLRRERE

SEQ ID NO: 10173 - protein, 171 aa, Artificial Sequence; identical to SEQ ID NO: 10172
  Synthetic

SEQ ID NO: 10174 - protein, 171 aa, Artificial Sequence
  Synthetic
SEVEEVLRRAEKAIREWEEETRRAKEENEKNIKKVADDLRRLLEDARRTIEEIEKRRADEKTVEKVLTDLEKKVRDVAKRLKENNDEDRRRLEDINRKVEERLEKLRDELRKAGASEEVLKEIKKLIDTARRKDEKVHKELEDTNRDLDRAIEEVIREIKKLLDDLREKAR

SEQ ID NO: 10175 - protein, 171 aa, Artificial Sequence; identical to SEQ ID NO: 10174
  Synthetic

SEQ ID NO: 10176 - protein, 181 aa, Artificial Sequence
  Synthetic
SEKEDVLRRIKELLERLHEENREVLTRIEKLLKDNKERNDDVLRRITELLKEVTKRAKDRGKPRDDLERLIRELERTLKELAERVKKLDEDLKKTVDDLRREVERLNEELERMLRELTKLADRVGTEEVRKRVEDVVRKNKEVARELLDRVRKLSERNKRAIDKLLEEVKRVLEEVERALK

SEQ ID NO: 10177 - protein, 181 aa, Artificial Sequence; identical to SEQ ID NO: 10176
  Synthetic

SEQ ID NO: 10178 - protein, 171 aa, Artificial Sequence
  Synthetic
DEERDVRREIRKLLRDAEEHSKKLNEESKKTNKRNEEENRKALEDNKRLLKEVEDRIPKTKDLERIKRRNKELNERHKRTLERLKEESRRLNEKHKEDLKKLAEDVERLERAGLPVTELRERIKRLIEEIERLNREFKKKNEELSKKNKELVERSRTESKKLVDEARERAR

SEQ ID NO: 10179 - protein, 171 aa, Artificial Sequence; identical to SEQ ID NO: 10178
  Synthetic

SEQ ID NO: 10180 - protein, 178 aa, Artificial Sequence
  Synthetic
DSEEEVRKRVKDLSEENKRLVKTAEKRVRELSKENKELVERLKREVDRIKKEIEELKRRGTTEDADRELRERLEKLKRELEDLNRTLNRRATELEKEVKRLSDELRKRAEELEKKVRRENKVDEKVLREIREIVKKNKRENEEVLRRIRELVKENNDENKRVLDEIEKLLKEIEDESR

SEQ ID NO: 10181 - protein, 178 aa, Artificial Sequence; identical to SEQ ID NO: 10180
  Synthetic

SEQ ID NO: 10182 - protein, 185 aa, Artificial Sequence
  Synthetic
SEMDEVRKKLRELVERLKKEAERSRKSHREILKKVRDDLKRSEESHKELLDRLEEVLKRTVRDERKVREIRKELDEHHKRYREELKRLEEELRKHHEKYKEVLEDLKRRLDKLLRELEEVLKKKVSEDKLRRLLEEAAEVIKRLLDEVKRLNEHAKRMAEKILEDVKRLNKHAEDKVRDVEEKVK

SEQ ID NO: 10183 - protein, 185 aa, Artificial Sequence; identical to SEQ ID NO: 10182
  Synthetic

SEQ ID NO: 10184 - protein, 185 aa, Artificial Sequence
  Synthetic
RELEEVARRLERLLDELRKKLRESERSVRRLLEELKKELEKLRKRHEDLLRTVKKKLDDTVTDERKLEELTRRLEKHHREVKKRLEDLDRELEKLDEEYKRVLEKLERELEELRRRLEEVRKRNISEEELKRLLEEVEKAIRELLERVERLNRRLEEEIRRVLEDLERIIRHAEEDLRRIEEEVK

SEQ ID NO: 10185 - protein, 185 aa, Artificial Sequence; identical to SEQ ID NO: 10184
  Synthetic

SEQ ID NO: 10186 - protein, 185 aa, Artificial Sequence
  Synthetic
RELEEVKKKLEKLAKDLRDTLERSARSVEELIKRLEDELRRSEESHKELLERLEDTLRKRATDEEKVRRLKRRLEKHHEEYRRTLDRIRKELKRLRDEYERELRRIEKELEDLERRLEEVLKRNISEEELRKLLKDATEEVRRIAEEVKKLNDELRRAVEEVLKEVRETNKHVREMIETVREEVE

SEQ ID NO: 10187 - protein, 185 aa, Artificial Sequence; identical to SEQ ID NO: 10186
  Synthetic

SEQ ID NO: 10188 - protein, 185 aa, Artificial Sequence
  Synthetic
SELEEVAKRLKELVDDVRRALKESDDSHKELLKRLKEKLDEVRKRLKKLVDDLEETLKRTLRDEDKMRDIKRRLDEETERLKRKLEKIEKELRDHHKRYKETLDRLEEELERLLRELEKVLRKNISEEELERLVREVERVIRKLKEDVKRLNDHAREKVKRVEEELRREEKRVRDEVERVKEEVR

SEQ ID NO: 10189 - protein, 185 aa, Artificial Sequence; identical to SEQ ID NO: 10188
  Synthetic

SEQ ID NO: 10190 - protein, 185 aa, Artificial Sequence
  Synthetic
SELERVEDEARKLADDLRRMLEESRRSHEKILREVEEELKKSEESVRRILERVKEVLDRKLTDEETLRRLERRLAELLRRYEEELTRLREELRRHHEEYEKRLRELEERLRKLEEDLKRVLDKNISEDELRELLDRLRKAIKKLLDDVKRLNDHVKELIERIRDEVRRLNRRLEEEARDVERRVE

SEQ ID NO: 10191 - protein, 185 aa, Artificial Sequence; identical to SEQ ID NO: 10190
  Synthetic

SEQ ID NO: 10192 - protein, 185 aa, Artificial Sequence
  Synthetic
DELETVREEIERLARELEKELKKSEDSVEKLLRELKERLKEVRKRHKELLDRLRDRLRKTVKDKDKLEKLERELKKHHEDVDKLLRELEDKLRELRERYKRTLDKIREDLEKLKRDAEEVLKRNISEEELRRLVEDVKRVVDEVLERVKELNKRLEEAIRRILEELKKIEKNVKDFIEDIDRRVK

SEQ ID NO: 10193 - protein, 185 aa, Artificial Sequence; identical to SEQ ID NO: 10192
  Synthetic

SEQ ID NO: 10194 - protein, 185 aa, Artificial Sequence
  Synthetic
RELEEVKRRLEELLERLRKELERSDKSHKELAKKLRDELERVEREHERLLRELEDTLRKTLTDKKKADELRRELEKHHEEVKELLKKIEEDLRRHHKRYRERLKEIKERLEKLRRELDEVAKKNISEKELTDLLREAKRRVEEVLKEVRDLNRNVKETVDRVLKELEDILRNVEEMIKEIKDKVR

SEQ ID NO: 10195 - protein, 185 aa, Artificial Sequence; identical to SEQ ID NO: 10194
  Synthetic

SEQ ID NO: 10196 - protein, 172 aa, Artificial Sequence
  Synthetic
SDAEDILRKVEDLIRRLAEKHRDLLRRSKENAERIKREHDDHHRDIRRVIKEIEDNNLSEEEVKRLLDELKRKSEETHRRSRKNLEEDKRRVEKIHEDSRRDLERIERDVRKKIKDDRELLKTVRDLLETLREINDRVREELRKIHEDVERRNKEVLDRNKKLLEELERKRR

SEQ ID NO: 10197 - protein, 172 aa, Artificial Sequence; identical to SEQ ID NO: 10196
  Synthetic

SEQ ID NO: 10198 - protein, 181 aa, Artificial Sequence
  Synthetic
SELEDIERKLKELEDEDRELNRKLNDDTRRLDERNRRLNEELTKKLREVEEEAKELRKRDNDERTVEKIKDRLRRIADELRKELEKITKELEDMSERVKRELEKIRKRTEDVERELRREMEENRVDERVREKIERIAKKLEDDNKESEDRHRRINEENRRRNDKNREDIERILRRLDEELR

SEQ ID NO: 10199 - protein, 181 aa, Artificial Sequence; identical to SEQ ID NO: 10198
  Synthetic

SEQ ID NO: 10200 - protein, 181 aa, Artificial Sequence
  Synthetic
KELEEVDDEVRKEAEEVKRYIKESKEKLDRLRREDERLNDRVREKVEDVRRRVEERRSEDNDEETVRELLERLRREAEKLERELEEIKKKTEDMLRRLRKENREMERRLRERSRKLKEKAKKDRVDERVKRKVDKIERELEDAIRRANEEHTKIEEDLRRRNKESKDEIRRILEELEERTR

SEQ ID NO: 10201 - protein, 181 aa, Artificial Sequence; identical to SEQ ID NO: 10200
  Synthetic

SEQ ID NO: 10202 - protein, 181 aa, Artificial Sequence
  Synthetic
REIETVRREIEKILDDLRRTVKRIEDEVRKIHEDLRRSLEDSKRNIEEILKDLERAARRDNLDKKVEDDMRKLVEDLKRKHDKLRRDNERVTKELKDRLKKLEDDLRRAIEELRRRLDKGLDKKDIDKLLKELRDLVEKIKKDLKELLERYEEIVRRIKELLKDLNREAEEVVRRLKEELR

SEQ ID NO: 10203 - protein, 181 aa, Artificial Sequence; identical to SEQ ID NO: 10202
  Synthetic

SEQ ID NO: 10204 - protein, 182 aa, Artificial Sequence
  Synthetic
DEEERAEREIKKLLDDLRRTLEEVKEAIRRILEDNRRTTKRINDEDRKINDDLRRTLERRNISEDLERDVRRIHKENKELNEKLNEDNKRIMDEIEEKAKRLEDRIREIIKRIKKLLEEMRRDGLDVDKVLKEVEETIDRVKKDIRRALREVEETSKEDKKRLREVLERSKDLARRLKEKLK

SEQ ID NO: 10205 - protein, 182 aa, Artificial Sequence; identical to SEQ ID NO: 10204
  Synthetic

SEQ ID NO: 10206 - protein, 182 aa, Artificial Sequence
  Synthetic
SREEEAERRIEKLLRELEKTNRDIHEEIRKILERLRRTLKKVNDEDEKLNRDLEDTLRRRNVSEELADEARKLHEENRRVNERLNREVEEIIERIKRLVDELHKRTEEIKETIKRIVDEMRREGRPVEDVLRRVKEIIDRVKEEHKRMLEEVRKIAKDLEEKIRAVLEESKKLAEDIKRRLT

SEQ ID NO: 10207 - protein, 182 aa, Artificial Sequence; identical to SEQ ID NO: 10206
  Synthetic

SEQ ID NO: 10208 - protein, 182 aa, Artificial Sequence
  Synthetic
REEEKAEEDIRRILRDLKETNRRIHEEIKKLLDDNERTLRRINEEDKKLNEDLRRTLEESRADEELRRKVREVHERNRKKNEDLNRRNERIKEELKRKVDELHERTKEIMERIKRLIEEMKREGRPVEEVLKTVEDIVRKVKREHEELLKEIEDLSRENKKDNERMLEESRRLARKLKEELR

SEQ ID NO: 10209 - protein, 182 aa, Artificial Sequence; identical to SEQ ID NO: 10208
  Synthetic

SEQ ID NO: 10210 - protein, 182 aa, Artificial Sequence
  Synthetic
SEEEKMEEDIERLLDRLRRINKRLHDEHKKLNEDNERTVRRIDEEDKRINEDLERTLRESNVDEELKKELEEAHRRNRKLNEDLRRRNKRIHDENRKRVRELHERTKEIIERIRKLLEEARREGRDVRKVLEDVERIIRRLEEEHRRALEESRKRSEENKRENEEMLERSKELAERIKRRLK

SEQ ID NO: 10211 - protein, 182 aa, Artificial Sequence; identical to SEQ ID NO: 10210
  Synthetic

SEQ ID NO: 10212 - protein, 182 aa, Artificial Sequence
  Synthetic
SEEEKAREDIKRLLEDLRRTNKKIHEDIEDILRELKETLKRVNDDDKRINDDLDRTLKERNIDEELKKRVDEAHRRNRRKNEELDRRAKRLLEEIRRLVEELHRRTERIEREIKRLLDEMSREGRDVEEVLRTVEKIIEDVKKEHEDLLKRVKDIVKKIKEEIEKVLRESEKLAREIKEELR

SEQ ID NO: 10213 - protein, 182 aa, Artificial Sequence; identical to SEQ ID NO: 10212
  Synthetic

SEQ ID NO: 10214 - protein, 182 aa, Artificial Sequence
  Synthetic
SEEDELRKRVADILKRLREVNKRLHDEVKRLLKENRDALKEVKDKIRESNRELDEVLKRRRIDEDLERRAREINERDKKMLEELEKESRDLLKELEDILRELHKRVREIEKELEDTLRKVERDREPVEEVLERLKEIVRKAEEEHKDVLRRLKEISDRHKRRLEEAERRNEKLLRDLKEELR

SEQ ID NO: 10215 - protein, 182 aa, Artificial Sequence; identical to SEQ ID NO: 10214
  Synthetic

SEQ ID NO: 10216 - protein, 182 aa, Artificial Sequence
  Synthetic
SRLEEMLKRAEDLSRESEELLRRVLEEVKDLSRKHEEALREILKRVKDLVDTVRDLLRRGKADEKVLRRIKEELRKLKEEAKRISDELEDRLRKLKERIDEILERLERRYRKLKKEIEDELPETEEVRKLEEELKRLLEENRRLAKELRDELRRLTKRNKDVVREVERRLEEIMKEIDKEVR

SEQ ID NO: 10217 - protein, 182 aa, Artificial Sequence; identical to SEQ ID NO: 10216
  Synthetic

SEQ ID NO: 10218 - protein, 177 aa, Artificial Sequence
  Synthetic
SEDERIKKELRKVEREVDKLLKEHEKILEDLKREVDKLIETHRKILEELKRRVDELKRRGSDKRDFKRLKDENKEALDKTREDADKLRRDNERKLEETKRRARELEEKVKREKEELDREGSKERIRRELEEVLKDIRRKLKELKERNDKVNRDIEELLRELEERNTEVDKEIKKKAD

SEQ ID NO: 10219 - protein, 177 aa, Artificial Sequence; identical to SEQ ID NO: 10218
  Synthetic

SEQ ID NO: 10220 - protein, 171 aa, Artificial Sequence
  Synthetic
DEEKEAEDLIEEHRRRSEEIARRADKLSEDHKRKVDEIAKTVEKLIRTLKEIVDRKPPDDELRKILEDVRRRAEDLDREVRKTNEEMRRRLRKIEADVEREMRETERRVREKIKDNKELKDRVERVLEESRELLERLRKKLEDNSKEVEDILRKLRKEVEDVVRKIRKRAE

SEQ ID NO: 10221 - protein, 171 aa, Artificial Sequence; identical to SEQ ID NO: 10220
  Synthetic

SEQ ID NO: 10222 - protein, 171 aa, Artificial Sequence
  Synthetic
RDEDEVRKLITRHEKLSRDIAERLKRESKKHRDDVERIAKENEELNRRLREIVKKKPPDKELEDILREARERTERLKERVRKINRELKKRVKEIEDTVERLMDETREEVERKIERNKELKDDVRRVLKKSRDELKRLREELKRNSEEVERILKKLDEDNRRVLKEIRERLT

SEQ ID NO: 10223 - protein, 171 aa, Artificial Sequence; identical to SEQ ID NO: 10222
  Synthetic

SEQ ID NO: 10224 - protein, 180 aa, Artificial Sequence
  Synthetic
DKEREVRRRVEELKKDSEDVLRRNREEVEKLHDENRKVNEESDRTAKELVEEAERMLREARKKIPEELLRRVREILKKLEDEVRRVKKTNEDEDEKLKREVEKVEEEHERKLRELDEEVKRRKKTEELLKELKKELDRLREENERSNRRLRKMLEELKRKNEEVNRELRKKLREIKERLR

SEQ ID NO: 10225 - protein, 180 aa, Artificial Sequence; identical to SEQ ID NO: 10224
  Synthetic

SEQ ID NO: 10226 - protein, 178 aa, Artificial Sequence
  Synthetic
SEEERLERTVEEVEKALKKLADDLRRDMDRSRKSHEDLLDKLRKELDRVLEEIRKKTTPEEDAKRLLERVEREIRRIKEELRRHHEEYKKRLEDIEKELKDLEDEMRRRLKELRDRIRREGVTEEVEKRLRELLDEARREVERILKDLRELNEHVRRRVDEVRRRLEELLERLDRETR

SEQ ID NO: 10227 - protein, 178 aa, Artificial Sequence; identical to SEQ ID NO: 10226
  Synthetic

SEQ ID NO: 10228 - protein, 174 aa, Artificial Sequence
  Synthetic
DEKREVEKELKRVDDEIKRLLRELEEALRRDKEEVDRLDKEVKDALDEVRERIERAGLDKELLERAEKALRENEDRHREAAKKYEKALRELKKRVDDEAERLERALRKIREDLDKTDVGEKVKEDLKRLLEEVEKAVRKVVEDSKRLHDEAKEAVDRNKEHLRRLLEDAKRRAK

SEQ ID NO: 10229 - protein, 174 aa, Artificial Sequence; identical to SEQ ID NO: 10228
  Synthetic

SEQ ID NO: 10230 - protein, 175 aa, Artificial Sequence
  Synthetic
SEKERAEEEIERSKRNLERLLEEAKREIDRSRENLKRTLTKVEEVLRKIKEDLKRLNVREDLVKKIDELLKDLERKLRELKKKAEDLHEEVDRALKELVRRARELHKRVEERIEEEKKAVEKLIRELRELNKRLAEEIKRLIDELRKLNKELDDEVEKIIRRAEDLLRDLERETR

SEQ ID NO: 10231 - protein, 175 aa, Artificial Sequence; identical to SEQ ID NO: 10230
  Synthetic

SEQ ID NO: 10232 - protein, 179 aa, Artificial Sequence
  Synthetic
SEVEKVIRDLEEINKRLLEEIKRSIEENKRTNEEAERKVKEVIDRLRKLLEDLKRTNSKDDRVVEEVKRRLKRIDEELKKLLRDVERKDEENKRKLEELDRRVKEEHRKIEEDLRRANVDEDRLKRVEDVLRESVKNLKRLVDEVRKANRESNEHLKDLARKVEKVIREIEEEVDRTRT

SEQ ID NO: 10233 - protein, 179 aa, Artificial Sequence; identical to SEQ ID NO: 10232
  Synthetic

SEQ ID NO: 10234 - protein, 186 aa, Artificial Sequence
  Synthetic
SELERLVEELRRALEKHKRRLEELKKELKKALDDHRREVKRLIDELKKTLDDVRKASRIDDEEALKKIEEDLKKLLRDIKERLKESTRRMEELLRRVKKDIRESHERLRELLKKIEKELKDLKKDQDERLLEDVKRILDEVRREVEKLDTDADRRLREVKEEVERINREVEKTLRDVEEDLDRLKK

SEQ ID NO: 10235 - protein, 186 aa, Artificial Sequence; identical to SEQ ID NO: 10234
  Synthetic

SEQ ID NO: 10236 - protein, 186 aa, Artificial Sequence
  Synthetic
SEVEKLKEDLKRALDEHRKRLEELKKELEDVLRRHEEKVRRLKEKLKRILDEIRRLSRIRDEEALRKIVEDARRLLEEIERRMRESHKEVERLLKRVEDDIERSTRELRKLLEEIRDRLDKLRKDLDERLLEDLDRALDEVRKEVEKLNRDAKRTLDKVREDVKRLDDDLRRTLKRVKEEIDKLTK

SEQ ID NO: 10237 - protein, 186 aa, Artificial Sequence; identical to SEQ ID NO: 10236
  Synthetic

SEQ ID NO: 10238 - protein, 186 aa, Artificial Sequence
  Synthetic
DEIEELKKRLRKILEEHRKRVEDLKKENEDLNRRAEETLERLKRELEEMLREIAERSRIRDDKKLEELVDRARELLKRVRDELERLFKELEDRHRRIEEDLKRSTEELERLIREVEDELDKLRKDQDERILEDLKRVIERVEREVRRLNKDLKRALDESRKRIEDWLKELDDVIKRVKREVEKIRT

SEQ ID NO: 10239 - protein, 186 aa, Artificial Sequence; identical to SEQ ID NO: 10238
  Synthetic

SEQ ID NO: 10240 - protein, 186 aa, Artificial Sequence
  Synthetic
SEAEKLKKELEEVLERARRRLTELKEENKDANRRHRRRLEELKKRLEDVLKKVKDDADIRDEEMLERLREELERLLREVEEDIRESTKRLRDLHRRIREEIEKLREELEKRLKEVEEELDRLRKDLDERILRRLEEVIRRVDRDIKELIKDAREVLERSKRDVERWNREMKKVLDEVRKRVEEIRT

SEQ ID NO: 10241 - protein, 186 aa, Artificial Sequence; identical to SEQ ID NO: 10240
  Synthetic

SEQ ID NO: 10242 - protein, 174 aa, Artificial Sequence
  Synthetic
SEDEDAKRELRRVKEEVDKTLEDSKRVHDESRKRAREWLEDSKRVHREVKERLKELDVTEDLLRDIERLIKESEEKNKRIEEEYRKLLRESEKRNKENKERVEKILRELDDRLRKEGATEELKRELERVLEEHRRSLEKNKRDVERINEELKRRLDRNKEELRKILEDVERRRR

SEQ ID NO: 10243 - protein, 174 aa, Artificial Sequence; identical to SEQ ID NO: 10242
  Synthetic

SEQ ID NO: 10244 - protein, 174 aa, Artificial Sequence
  Synthetic
SEEERLRREVKRVEDENRKLLERLREIAERVHRENKRLLDESRRIADKVRRDLDRLPKTEELKKLIDDLRRSLEELERRNRKVDKEIKDRLKRVEEENRKVDKELKDRVKEFEDRKEPLEEVLEELERVLKRLEEEHRRVVKELRDLLRRIKEDHDRLVEEAEEILREIDERAK

SEQ ID NO: 10245 - protein, 174 aa, Artificial Sequence; identical to SEQ ID NO: 10244
  Synthetic

SEQ ID NO: 10246 - protein, 174 aa, Artificial Sequence
  Synthetic
SEEEEADKAIRTIAKAIEDLVRDLERALKESKRNIEELAKDLKRANDRIEEELEKANVPEETLRELRKRSEDSNREIEKALRELTKAHEDIEREIRRTLEELRRRLKELREEARKTRVDKELADRLRDLLRDAKRVVDRIKRALEELNKEAKKLVERAKKKHDDLLEDVKRDTK

SEQ ID NO: 10247 - protein, 174 aa, Artificial Sequence; identical to SEQ ID NO: 10246
  Synthetic

SEQ ID NO: 10248 - protein, 174 aa, Artificial Sequence
  Synthetic
SEEEDAKRVLDEIREELKKLNDDVRRALKESKENIDRIIEDLDRTNKRIEEELDRLNLDEEELRRLKEKSRTSNEELRRLLKELEDRHRENKRTHEEVEKELEKELRRLAREARETRVDEELKERLKRLLERVREEVKRNKEHLERLNKKVKEDVDRLKKRHKDTLDEVDERRK

SEQ ID NO: 10249 - protein, 174 aa, Artificial Sequence; identical to SEQ ID NO: 10248
  Synthetic

SEQ ID NO: 10250 - protein, 183 aa, Artificial Sequence
  Synthetic
KLDEDLEKVIKEVKERLKESLDRHKEVAKRLEEEVKRSEEEHRKVLEEAKRKLEEIKTKTRKDEEMKRVEEELDEIARRSEDILRRIREELKRIHEESERELRDVEREIDKRTEDLRRLRKDIDDRTVRKVERELRDLIRRLEKRNEELIRRVKEIVERMEKTNRDLIRRIRELIKKVEDDVR

SEQ ID NO: 10251 - protein, 183 aa, Artificial Sequence; identical to SEQ ID NO: 10250
  Synthetic

SEQ ID NO: 10252 - protein, 180 aa, Artificial Sequence
  Synthetic
SEEEKLKRVLDEFRRAVKELLEDLERANERAKDEVRRLLEDLDRAHERIRRAVEKLKERVKDKGPEKVLEELDRELKKLAEENEKSKEEVERTVRRVHEKNEKIKEDLRRTVERVEEEVRKTRPDKDLEKRIRDTLREIKKRVEDVKRDNKRVLDELRKKIEENKKRNEDVLKEMEDKTE

SEQ ID NO: 10253 - protein, 180 aa, Artificial Sequence; identical to SEQ ID NO: 10252
  Synthetic

SEQ ID NO: 10254 - protein, 185 aa, Artificial Sequence
  Synthetic
SDAERVKKESKDLLDTTKRLADRLKELLERLNKETRDRVREVIKEIERLVDEVEKEARKGLDEETKKRVIDKIRKTLEDIKRKLDKLLEEHKTENDRIKKEADELLKEHRDRLEELRRKLDERNLREDIRTDLEDVLRRNKEALEEIRKDIERVNRKDREELREIARTLEKVLRDARRRLEELRR

SEQ ID NO: 10255 - protein, 185 aa, Artificial Sequence; identical to SEQ ID NO: 10254
  Synthetic

SEQ ID NO: 10256 - protein, 181 aa, Artificial Sequence
  Synthetic
SIEDDLRRVLERSKRSLEELKRKADRVLEESKKNVRDLERELKRVLEKIKETIDKLRKDGRLDEKLKKEIEDLLREAKERVDRLKKELRDLHEEVKKALEDLERRARDTHRRLKERVDKGLDKEEVERLIRELDRVNEELAREVERLIRELEEVNRRVNEDLKRLIRELERALKELDERVR

SEQ ID NO: 10257 - protein, 181 aa, Artificial Sequence; identical to SEQ ID NO: 10256
  Synthetic

SEQ ID NO: 10258 - protein, 178 aa, Artificial Sequence
  Synthetic
DEVDELIKRLEERNEELNRKAKRIIEKLKKENDDLNRKLDEIVRKAREDIEDAERRVNDDKVIEEIKKLIEELRKRIEEELKKAKEAHERIEEEIKEALKRARELNKKLEEELRRRVRGKDLEDKLEEVLRRSKKNIEDVEKELRDVLRAAKKNLDDLRRKLEDVLRRLRDEIRRKKK

SEQ ID NO: 10259 - protein, 178 aa, Artificial Sequence; identical to SEQ ID NO: 10258
  Synthetic

SEQ ID NO: 10260 - protein, 178 aa, Artificial Sequence
  Synthetic
SDVDRIITELRDINREVNRRVKRLIEELEELNRRLNEKAKRDMDEIRRLIEEAAKKLRDDRKLEELEKRLEEIRKRLEEELEKAKRLNEELKKRLDDEARDVERKHKELEDELRRRVRGEDLKRKLEKVLKEARDNLEEVKKRLKEVLERSEENLRRLEEELRRVLEEVREMLKRKKD

SEQ ID NO: 10261 - protein, 178 aa, Artificial Sequence; identical to SEQ ID NO: 10260
  Synthetic

SEQ ID NO: 10262 - protein, 173 aa, Artificial Sequence
  Synthetic
KDEEKIKRVLDDVERVLKENEDRNRELLKRVRERLEESRDHLRRVLEDVKRVLEELKLDEKTAKELEDTIRRIADELRKILKRTEDELRKIEKKSREKLKRAREELRKLEKKSKDVDVDELVKRIKDLLKRLNEISRRIAEEIKELLRTHDELNERVVRKLRDLLRKAREKRR

SEQ ID NO: 10263 - protein, 173 aa, Artificial Sequence; identical to SEQ ID NO: 10262
  Synthetic

SEQ ID NO: 10264 - protein, 173 aa, Artificial Sequence
  Synthetic
SEEEKLKRVLEDVERDLRRNKRENEKSLEESKKVNDDNRRRNKEALDEVKKVLEDLNLPEDTLTDLEDKLRKIKRDSERENERHKEELDRSEEESRRTLKRAREKLEELRKTSKDKSDEELVDEIRKLLERLNEISERIHRRNKELDDELNEISKRIRERIEDLKRRAEERAR

SEQ ID NO: 10265 - protein, 173 aa, Artificial Sequence; identical to SEQ ID NO: 10264
  Synthetic

SEQ ID NO: 10266 - protein, 177 aa, Artificial Sequence
  Synthetic
SEEDEIRRLLKENEDSTRRVEEDNKRLNDENEKSTKRVEDDIRRILERVRRELDDLRRRGAVDEELDKEVERVEREIEETLKRLRERNEESKKRNEEKVKKMKEENKKTKDDIRDLKDRVRREEIEREVREDNKRLEELLERSEREVREDNKRLDEALKKIEKEARELVKRMREKAK

SEQ ID NO: 10267 - protein, 177 aa, Artificial Sequence; identical to SEQ ID NO: 10266
  Synthetic

SEQ ID NO: 10268 - protein, 177 aa, Artificial Sequence
  Synthetic
REEEEIRRLLKENEESTRKVEEDNKRLNDENRRSTEKVSRDLEDLNRDTRRVMEEAERRGAVDEDLKREVEEVERRNKELLKELRERNRESLERNRKKVEDLKRRNTETRERIKDLARRVRLEEIKREVEEDNERLKELLKRSEKEVREDNKRLRDVLEKSREEHERLKKRLEEAAK

SEQ ID NO: 10269 - protein, 177 aa, Artificial Sequence; identical to SEQ ID NO: 10268
  Synthetic

SEQ ID NO: 10270 - protein, 177 aa, Artificial Sequence
  Synthetic
SEEDEIRKLLEKNEKSTEDVERENERLNDENRKSTEDVKREIDRLLKELREVLDEARKKGAVDEDLDRRVKKIEEDIKRRKDELRKRNEESLERNKRKLDDLRRRNEESKRRIEDLKDRVRLDEIRKTVEEDDKRLKDALERSKREVDDDNRRLKKVLDEIRKTVRTMIEEIKKAEK

SEQ ID NO: 10271 - protein, 177 aa, Artificial Sequence; identical to SEQ ID NO: 10270
  Synthetic

SEQ ID NO: 10272 - protein, 181 aa, Artificial Sequence
  Synthetic
SEKEKADDLRRKSKESNDTLRKRLDELKKRSEKNNEELERRLRALLKRLEDVLREITKRTGRDTELDKLKDEARELLERLEKRARDLLKEHEDLKREVEEKARRLLKEHEDLERELERRVRKDGVTDELVKEVEDLNRELEEKVKRLIEEMEELNKRLNDKVKELIEEVERLIKELEDRVR

SEQ ID NO: 10273 - protein, 181 aa, Artificial Sequence; identical to SEQ ID NO: 10272
  Synthetic

SEQ ID NO: 10274 - protein, 185 aa, Artificial Sequence
  Synthetic
KDIDELIKRSEDLTRDLERKNKEVVDKIEELLREHEKTNREVVKELRRLLDEVRERVERRGRTREAKEELRRLRELLEEIVRRLEELLRRTRETLTRIKERLDELHEEYKRKLEEIKREVDRRPTSEDLERKVRKAEEDNKRAVERSKTHVDEVRKEVERVLRESKRHAEKLAEDVERMIRELER

SEQ ID NO: 10275 - protein, 185 aa, Artificial Sequence; identical to SEQ ID NO: 10274
  Synthetic

SEQ ID NO: 10276 - protein, 175 aa, Artificial Sequence
  Synthetic
STLEKLKKDLDDIDRDLERILDELRRRVERIDEELRKIVERLHRRNKEIIERLRKAKLPREELRKVAEKSRKELEEVKRELEDMHRRSREELERVRKRLEEVHKESKERIDEAIRRDGETREIREAEKKHKKVLDDLRRKLEEVEKRHREVEKELRDRLEESRREHEKVIREETE

SEQ ID NO: 10277 - protein, 175 aa, Artificial Sequence; identical to SEQ ID NO: 10276
  Synthetic

SEQ ID NO: 10278 - protein, 178 aa, Artificial Sequence
  Synthetic
RELEELEKEVRKRLKEAEERVRDLAKKSRDLNRELKDRLRRIVEENRDVNRKVKEKKDVDKEKLARELEDINRRTEDRFRRLDEELRRVNKDLKRRIRELVEELKEILKRLRDKVRRDKAGRDEDLRRVEEEIRRVIERLKRLLERVEEENRKSRKELRETLERLHRENEKSLREKET

SEQ ID NO: 10279 - protein, 178 aa, Artificial Sequence; identical to SEQ ID NO: 10278
  Synthetic

SEQ ID NO: 10280 - protein, 184 aa, Artificial Sequence
  Synthetic
SLKERLDRVEEKIRKVLEELDRSTSRVEKKVEEVLRELKRSNDEVRKEIKKVLDELRKRGLDEEMKRRLEEIAKELEKILRENEERIKRIADELKELLKRARDRHRRIAEELKKELRKIEKRNIDEKVVDEVAKRMTEELKKLDKENKEIEKEVDDILKRLKDEDKKTVDTLRKILKELDDDAR

SEQ ID NO: 10281 - protein, 184 aa, Artificial Sequence; identical to SEQ ID NO: 10280
  Synthetic

SEQ ID NO: 10282 - protein, 183 aa, Artificial Sequence
  Synthetic
SEIEEVEKEMDKLAEESNKLNEEALRRVRKLLRDSNELVRELERRVRELIKRAKDLKREGDKDEEKILEDLERSIKRLMDEARKLLEEYKRRLDELKKELDKLHEEYEREVERIIRKLEREPNSEEVRRKIKEIKDRSEENIKRSRDSVREIKKESDENIKRLKRELERIKKRLEEVLRDLKR

SEQ ID NO: 10283 - protein, 183 aa, Artificial Sequence; identical to SEQ ID NO: 10282
  Synthetic

SEQ ID NO: 10284 - protein, 179 aa, Artificial Sequence
  Synthetic
KDEEDLAREVKRVIDELEKLNEELNRAAEELIKRAEEINERVNRKVEKVERDLDKLKKRGELDDELLKEIKKRLEEEEKKAEDAHRKLREELKRALDTAREKNKEIEKRLEEVLKDAKDKTGESETLRKLRDDLRKALKKSEDNIEDVRRRLEEVLERARRNLERVRRRLEEVLRKLKE

SEQ ID NO: 10285 - protein, 179 aa, Artificial Sequence; identical to SEQ ID NO: 10284
  Synthetic

SEQ ID NO: 10286 - protein, 179 aa, Artificial Sequence
  Synthetic
SAAERLEKAVRDLIEELKRLNEELNKAVKEIIRRLRELNKKLNEDAERLIRKADELKRRGSSEEVLERLRREAERLAREADKLDRKVKRELEKLEEDIRKLNEEVRKKLRKLEEDARRENKVDKEILDKLREELKRALEESEENLRRLRRELTEVLRESRENLERLKEEVERVLKRLAD

SEQ ID NO: 10287 - protein, 179 aa, Artificial Sequence; identical to SEQ ID NO: 10286
  Synthetic

SEQ ID NO: 10288 - protein, 180 aa, Artificial Sequence
  Synthetic
SVVEDLEEKVKRLIERIERENRRLNKDADRLVRELDELNERLNRAIRRLIRKAEEARKRDLDEKDKRKTLKEIRDEIEELKRRAEEDHKRLEEAIKRLVEEARRANEDLRRKLKELEERAQGVEERELERLKRELEKVLRESEKNLEDLERKLKEVLDRSRENAKRLEDELREVLERLRK

SEQ ID NO: 10289 - protein, 180 aa, Artificial Sequence; identical to SEQ ID NO: 10288
  Synthetic

SEQ ID NO: 10290 - protein, 180 aa, Artificial Sequence
  Synthetic
SVVEDLAKKVEELIRRLEELNKELNKRVRDLIEKLRDINRKLKREVERLIEEAEEVRRRDLDEKDKRRVLRRLEEVLKDLVRRAKKVNRDVAEEMKKLVEDVKRSNEEVKKTLEKLKEDAKGVDKDELKKLEERAREVLRKSEENLKRVEDELREVLRESEETLKRLEEELRRVLDELRK

SEQ ID NO: 10291 - protein, 180 aa, Artificial Sequence; identical to SEQ ID NO: 10290
  Synthetic

SEQ ID NO: 10292 - protein, 178 aa, Artificial Sequence
  Synthetic
DEEKKAEDDIRRIHRRNEDLLRRHREITEEIEKRIRELLREHREITKRLERRLRELKKEGSDERVLDKIRKEMEKRLEDSERKLEKIEREARKTLEDTKRELKKSEEEAKKTIDDVRRKTGDTEELKRIKKRLDESLREVEEDLKRSEKRLRELLKRVKEDLDRSRKRLKEILDELRR

SEQ ID NO: 10293 - protein, 178 aa, Artificial Sequence; identical to SEQ ID NO: 10292
  Synthetic

SEQ ID NO: 10294 - protein, 178 aa, Artificial Sequence
  Synthetic
DEVRKLEEDVERLRREVEEENRRLEEEVERLRKEVKERNRELNERVKTLIETAKRLKEAGSSEDVLKKLEETVRKLNEDHKKLTKELEDRARALLEDHRRKLEELKERMDRLREDVRAKRLPEEMLRELEKRLKRLADETRRSNKELKERLERLKDESRDNNRELKERADRLLEKLKE

SEQ ID NO: 10295 - protein, 178 aa, Artificial Sequence; identical to SEQ ID NO: 10294
  Synthetic

SEQ ID NO: 10296 - protein, 175 aa, Artificial Sequence
  Synthetic
SEEEELRKLERRLEELMKEYKEALDKLREEHEKTLREYEKRVEDLEREHKKVLKKLVDDRGREDDKVRRYKEEVDRLKDHSRKAKETYEKKVRDLVRHSKEFLDELRRKVKELKDRLTDLDDLRRKVDKLRKEVEDHVRELEKKSRKLVEELKDHLRKLEEESRRLNRELEERSR

SEQ ID NO: 10297 - protein, 175 aa, Artificial Sequence; identical to SEQ ID NO: 10296
  Synthetic

SEQ ID NO: 10298 - protein, 175 aa, Artificial Sequence
  Synthetic
SKEDLRRELDRVNEESKKHLDKLRKEAEEVLERLDRANKKIIEDAEEILRRIEKKVRTREDERRKTEEDARRAKEDNDDANRRRKEDAKRRRDKEREDEKRDEDDKRRSDKESKDDTQTRERIKREIEENRKRNEEIARKIKEDIERARRDLERLRKKHEEELEKLKKRVEDADR

SEQ ID NO: 10299 - protein, 175 aa, Artificial Sequence; identical to SEQ ID NO: 10298
  Synthetic

SEQ ID NO: 10300 - protein, 178 aa, Artificial Sequence
  Synthetic
DEDRIRKELEKAHKETREESEKLNRDVERVLREVRKASKDLNDKFEEELRKLREKVERDLPPDDEERRDEEEAKKTRDEARREHEKTEEEARRLREEAERRHRRYTEKEKRIRDKIRKDGVDRDKVEEDLRRSRKELEDYARDLEDAIRRIEDRLRRYARKLEEDIKRLARKLEERER

SEQ ID NO: 10301 - protein, 178 aa, Artificial Sequence; identical to SEQ ID NO: 10300
  Synthetic

SEQ ID NO: 10302 - protein, 183 aa, Artificial Sequence
  Synthetic
SRTERVKEELKRLVEEYKKRSDDSRRRNEKLTRDYREDSRRVEEELKRIKEDVERELRRRDVERKEELKETEKRMKELEERLREEKKKSKEREDRLRKRNEEEDRRSEKETREIEKETRDRGLRDEEAKKDLKRVRDALDRLTKRNEEKDKENEDRLRKMLRENRERLKEVRERAKRIKEELK

SEQ ID NO: 10303 - protein, 183 aa, Artificial Sequence; identical to SEQ ID NO: 10302
  Synthetic

SEQ ID NO: 10304 - protein, 181 aa, Artificial Sequence
  Synthetic
KEKEEIRKALKELLDDLERTLERLKREYDKLRKDLEDTDERIAREHKKIADDLDRTLKEARKKLDERELDKLRKEVEEHNKRVKRRRDEIRKETEKNTKRNEDEERKKREELERKKRDLERKDSESERVLEEVKREVDRIKEELRRTLEENRRRIEEIKKRLEDILRESRERARELKEKLR

SEQ ID NO: 10305 - protein, 181 aa, Artificial Sequence; identical to SEQ ID NO: 10304
  Synthetic

SEQ ID NO: 10306 - protein, 172 aa, Artificial Sequence
  Synthetic
SEAETILRRVRRRVEEILDRIRRKLEESKREVEKHRRDVKKVLDDVRRTVKRIKERGRTEERVEKEVEKMMREIKKELDDRHRETKKRSEEFERDLKRTEERVREEEDDTRKKVPNREEVDTRLKEISKELEETLRRVTEEHKRLNRELEEVDRRAEKEVRKILKELRDTTK

SEQ ID NO: 10307 - protein, 172 aa, Artificial Sequence; identical to SEQ ID NO: 10306
  Synthetic

SEQ ID NO: 10308 - protein, 187 aa, Artificial Sequence
  Synthetic
SKEEELREVLRRIERELERVNEELREENKRIDKELEEVNRELEERNKRINDTVEDLVRERGDNSKEVEDEARDERRRNDEKNKKYKEEDDRNRKRNDDENKRYEEEVKENKRRLDEEEKEVEARGDVKREELRKIAEKLKKNLEEHKKRVREYLKRLEENLKRHRERVEKYARDLKRDLDRLRERLR

SEQ ID NO: 10309 - protein, 187 aa, Artificial Sequence; identical to SEQ ID NO: 10308
  Synthetic

SEQ ID NO: 10310 - protein, 187 aa, Artificial Sequence
  Synthetic
SEEEKLEKKAREIEEALRRVNEELKRRNKEIDERLEEVNRRLEKDLKKIEEDARKLVKDKGDTSEEDKRRLEEIRRELRKREKDYRDDAKRNRDENEEANRRYEKEAEDNDRELKKEEEETRRKGEVDEDELREIIERLERNLERHKRRVDKYLRDLEKNMRDHKRKVDEVVKTLEETLRRLEEEVR

SEQ ID NO: 10311 - protein, 187 aa, Artificial Sequence; identical to SEQ ID NO: 10310
  Synthetic

SEQ ID NO: 10312 - protein, 179 aa, Artificial Sequence
  Synthetic
SEEERLREKVKRVEDDLRRLNEEYKEKHKRSEERNKKLLKDLKEVHDRVKKAVEDILRDTPLEEEKLRTIREDLKRVHEENKEAEERIRKRHEELNEESRRDHKRHKEKLDRLKEEEEKSDRPEEEVEERIRRALKESREEIDRLERRNEEEDKKSEETVRRMMERNDRVLKEVEERAR

SEQ ID NO: 10313 - protein, 179 aa, Artificial Sequence; identical to SEQ ID NO: 10312
  Synthetic

SEQ ID NO: 10314 - protein, 179 aa, Artificial Sequence
  Synthetic
REEEELRRLVKTVEDEVEKLLRRYRDESEKVKRTLEELNKDLERKHKEVLDRIRDILRKVPLDEEKLRRLDKKLKDLHERNRDEHRKHEKETRDLDEDSKRAERETRKKLKEVRDKRRDSDRPREDVERELEETLRDVARKIERLLEKNKRDLDRSKKRVEEMVRRNEKALKDVEDEIR

SEQ ID NO: 10315 - protein, 179 aa, Artificial Sequence; identical to SEQ ID NO: 10314
  Synthetic

SEQ ID NO: 10316 - protein, 179 aa, Artificial Sequence
  Synthetic
SEREDLKRTVDEVKKRLEELIDDYRKTSEEVERRLEELLRRLREDHKRVAETIDDILRRVPLDEKKLTRLREELEELHERNKRKEEKIKKEIDDLREKSERDEKRIRDEIKKLEEEEKRSDRPTEEVKERIRRDLERVKRKIEELKKKNEEDLRRADKKVKDMLEENRRTLEKAKRKAD

SEQ ID NO: 10317 - protein, 179 aa, Artificial Sequence; identical to SEQ ID NO: 10316
  Synthetic

SEQ ID NO: 10318 - protein, 178 aa, Artificial Sequence
  Synthetic
SKEDEARKEIKRIEDEIERLRKELEDAHRKLREDLKRLRDENKKVLEDIKRRLKELEKDTDVREEDLRRLRKEVRELDEKSKEEEKRTEKRARDLHETNKRDDKRAEDETRKLKKEADDEPVDDRVRKKLEDELRRLKRTVDELKKRNEKALRDVKRDSERHKEELRRALRKAEEDAR

SEQ ID NO: 10319 - protein, 178 aa, Artificial Sequence; identical to SEQ ID NO: 10318
  Synthetic

SEQ ID NO: 10320 - protein, 186 aa, Artificial Sequence
  Synthetic
SLKEELDKAIRELKERHKRINEDLERVVRESRKNHEDINRRLKKLLEELEKRVEEIVRREQTDRDRTEEIKREEDKTRKSDKDKEKKSRDEKREYDRREEEDRRKSERDEERVDEEARDFERKNREEDRVIREIKKRLEDLLRRTEERAKEVKDENRKRNEDTREEVRRVEEELKELLRRIEERER

SEQ ID NO: 10321 - protein, 186 aa, Artificial Sequence; identical to SEQ ID NO: 10320
  Synthetic

SEQ ID NO: 10322 - protein, 181 aa, Artificial Sequence
  Synthetic
DEVREIIRELKERIDKIAKEIDDENREHRERLKEIAREVKELIKENRKELKRIADERKDRDRSELKKRVDELRDKNRRDNERTKERAKKIKDDNRERNERTDERVKRIRDETKKRKDDIDLEEEIRKRLDEATKRAEDELRKLKEKNKEVLKELDDRLRKLEDEHRRVREEVDKRLDELRK

SEQ ID NO: 10323 - protein, 181 aa, Artificial Sequence; identical to SEQ ID NO: 10322
  Synthetic

SEQ ID NO: 10324 - protein, 182 aa, Artificial Sequence
  Synthetic
DEREKIEKRIRELLKEDKEHTRRNEEKIRRLLDTNRRLLEEIAKKIEEIARELKERKKENRTRETKDRKRRETRKKIEDLREEIERLSRKAEKDTERLERENKDASRRNEERLRELEKRIRDKGLNLEEIRKLVEDYRREHEKLKRRNDELLERYRRAHEEIKKRIDELVERLEEILRKLAE

SEQ ID NO: 10325 - protein, 182 aa, Artificial Sequence; identical to SEQ ID NO: 10324
  Synthetic

SEQ ID NO: 10326 - protein, 182 aa, Artificial Sequence
  Synthetic
SEKETIEKRIRDKLKDDEDHTKRNEERIRRALKEDEDRLRKIEEEIRRTLEELEREKRSNRTREEKEERRRRREDRDRRRRERIKRESDKNKRREDERKKKNEEKSRRNDKERREERKDIKRRGLDAEDIERLEERYRREHERLKRRNEDLSREYEERHERLKREIDKLEEDLKRETERAAR

SEQ ID NO: 10327 - protein, 182 aa, Artificial Sequence; identical to SEQ ID NO: 10326
  Synthetic

SEQ ID NO: 10328 - protein, 182 aa, Artificial Sequence
  Synthetic
SEKEKIKKEIEDARREDEKHTEKNKRDIERDERRDEETLKEIEERIRRTLRELEKDRESNRTREEKKKKREETERRRRKLREDIERKKEENKKKEREREERNKEFNRENKRRAEERKRDIERRGLNAEDIERLEREYEKDHKRLKDENDDLTEKYRRRHREIDERIKDLERELDRRIKEIDR

SEQ ID NO: 10329 - protein, 182 aa, Artificial Sequence; identical to SEQ ID NO: 10328
  Synthetic

SEQ ID NO: 10330 - protein, 187 aa, Artificial Sequence
  Synthetic
DVRDRVRELRRRLEEETKKVDDENRKIHEELKRVADESRKNNERLNRELRKEIRRVEKDLGEVREEKRRRVKKTTDDTEKEDEDRNREYDREEKEVEERDRKKNKERKDRKEEVDRRTEEEERRRKPDEEALRRLEETLKEVKDELKTELDDSRREVEEVKRSNKEKNERSERRLKEVRDRLREERK

SEQ ID NO: 10331 - protein, 187 aa, Artificial Sequence; identical to SEQ ID NO: 10330
  Synthetic

SEQ ID NO: 10332 - protein, 183 aa, Artificial Sequence
  Synthetic
SLEDSAREIEKRLRDLHRRYREDHERIREDLERLKTEYEKAHRDIKRELDRLREELERANRVREKEKEDTKREEEERHREVEEDKKRKDEELRRAHEEVKKKEDENKERDDRFKEETKRSDRPEKEMLDRLEEHVDRNEKDIKKALDENRKRLDDIRRKIKKALDENREELKRIERRIRELKK

SEQ ID NO: 10333 - protein, 183 aa, Artificial Sequence; identical to SEQ ID NO: 10332
  Synthetic

SEQ ID NO: 10334 - protein, 180 aa, Artificial Sequence
  Synthetic
SAEETTEDLKRRLKELDEKVKEVLKRNEDRVRELEEDVRRNLKKNEDDAREVEERLKTSGGGDEEELRKRSEEYKKRMEEVKKRLEDESKKYKDEVRDVKRRLEEERKEVEDRTRTTDVKGEELLKEVEDRVREIIKRIEEKLKRLNDRTREFIERIRRELRKVNEETKKMIKELKEEED

SEQ ID NO: 10335 - protein, 180 aa, Artificial Sequence; identical to SEQ ID NO: 10334
  Synthetic

SEQ ID NO: 10336 - protein, 175 aa, Artificial Sequence
  Synthetic
SKAEKVLEKAREVVETIKRLVEEVLRHSEDVVRRITDLVRRLLEENERVVREIKRLADEGSRGESEVKKLSDDMRKRNRDVEREVRELSERDREELRKVKEEIKERLDRIREELERSEVDERVIKKIEDLLKKVDDEAKKMLEEVERLNKEVNDRLKRVLEEAERLHEEVNRRVK

SEQ ID NO: 10337 - protein, 175 aa, Artificial Sequence; identical to SEQ ID NO: 10336
  Synthetic

SEQ ID NO: 10338 - protein, 174 aa, Artificial Sequence
  Synthetic
KELEDVIEEVKKLLKTVNEESRRVAEEVRKLIREVSEELTEVIRRVERLVEEVATRVDRKEDLDRVRKRIEELVRRVEEVNRRSKRRIEELEDELRKVDEESRETIERLIDLLRRGLDLDTVLRRAEDIVRKNRKLAEEVLRRVKKIVEENRKIAKEVLDDVRKLVEDVLRRAT

SEQ ID NO: 10339 - protein, 174 aa, Artificial Sequence; identical to SEQ ID NO: 10338
  Synthetic

SEQ ID NO: 10340 - protein, 174 aa, Artificial Sequence
  Synthetic
EELERVIEEVRKLVEEAEKKSREVIKTVKELMDDVNRKSKKVLDDVRRLIEKVRREVTNEEELRKLTETIRKLIEDLKRMDEKSEDEIRRLVEELRRLNEKSKRDIERLIELLKRGLDADDALRRVKEIVERNEEVVKELLKRAEDIVRTNEKLVKDVLDTVRKLVKKVKDDED

SEQ ID NO: 10341 - protein, 174 aa, Artificial Sequence; identical to SEQ ID NO: 10340
  Synthetic

SEQ ID NO: 10342 - protein, 177 aa, Artificial Sequence
  Synthetic
SEAEDALRKAKRLADEDRKAAKRALEEAKKSAEEVKKAAKRALEEAKRIAEDVKRAADEGRDEEDARRILEEARRAIEELAKRLKKILDDNERETKRLAEELRKINEDTKREIERLEKDARGEEAAREAKKLAKDAADVSRKAAKDAKDLSKEAADVARKAAEDARRLAEEAARKAK

SEQ ID NO: 10343 - protein, 177 aa, Artificial Sequence; identical to SEQ ID NO: 10342
  Synthetic

SEQ ID NO: 10344 - protein, 182 aa, Artificial Sequence
  Synthetic
SDAEDVVRKVKRLVDELRRHSKELLKEVEDLVRDLVRHSEEVVKRVEDLVRRLEELVRRGDAREEVLRKVEEDVKRLNKEDKDRVEELRRRVKKLSEDNEKLLEEARERVTRLIEDLRRRSDTEEVRRVLREIREVLKKVAEDSRKVNEDIRRVLEEAKKTSDKVNTDSEEVLRTVARRFED

SEQ ID NO: 10345 - protein, 182 aa, Artificial Sequence; identical to SEQ ID NO: 10344
  Synthetic

SEQ ID NO: 10346 - protein, 182 aa, Artificial Sequence
  Synthetic
SRAERLLEDVRRLLEESLRNSERVLEEVRKLIEENLRHSRKVVDEVRRLLEEVLRVVERGDIRREDVKRAEKEVEDLNDENRRHSDDVRKTVEKLDEDNKKLLKEVKERVEKLIKDLKDEVDREDVRRVLEAIKEDLKRVEDANREINRRSEELLREAEKRSRDIDKESRDLVRKVKKDLEK

SEQ ID NO: 10347 - protein, 182 aa, Artificial Sequence; identical to SEQ ID NO: 10346
  Synthetic

SEQ ID NO: 10348 - protein, 182 aa, Artificial Sequence
  Synthetic
SRAEEVLKDVKRLVDENRRHSERVVEEVRKLVTENKRHSERVVEEVRRLVEELERARRRGDIREEDLERVKREVEKLNRDNKDHSRKLKRRVDELNKRDKEHSDDLKRRVERLLDELRKESDDKDVRKVLKDIREVLERVEEDSERVNRESKKVLDDVKKESDEADDESRRVLEEVDRKARK

SEQ ID NO: 10349 - protein, 182 aa, Artificial Sequence; identical to SEQ ID NO: 10348
  Synthetic

SEQ ID NO: 10350 - protein, 182 aa, Artificial Sequence
  Synthetic
DRVEELLKTVEKLVRDNEKHSRDVVKEVRRLAEENERHSERVVREVRRLVKELEDMKRRGDIREEELKDAERKVKELNKRNKEHSDDLRRRVEELNRDNRRHSEELEETVRRLLEELRKESDRREVREVLKRIEEILKDVKRKSEEVNRESERVLREVEKRSEDADRESKKVLDDVKEKARR

SEQ ID NO: 10351 - protein, 182 aa, Artificial Sequence; identical to SEQ ID NO: 10350
  Synthetic

SEQ ID NO: 10352 - protein, 177 aa, Artificial Sequence
  Synthetic
SEEEVLKEIDEVSRDLERKNKTINEEIKKVSDRVAEEVRRVLEDIKRTSKDAVDDVRTRGLDETDIERHRRTSKRLLDELRRLLEEHKRKSERISREDKKILDEHRKFSEEVRKLIKDGADLEKVVREVEESVKESEERSRRLLEEVRRSVKKLEEDVTRLLEENKKSVDDIKERAR

SEQ ID NO: 10353 - protein, 177 aa, Artificial Sequence; identical to SEQ ID NO: 10352
  Synthetic

SEQ ID NO: 10354 - protein, 177 aa, Artificial Sequence
  Synthetic
REEEVLEEIRRVVEEVRRENERINKEIRERSEDLRRKVKRILEKAKKVLDDVDERAKREGLDEKVIRDLRRRVEELLDRLRKRVEEHEKFSREISKRDRDIIEELKKTVERIEKLLKDGMDVDEVLKEVEDLVRESVRLSEDLLREVRESVERLVDEARKLVREIERLVKEAVDTVR

SEQ ID NO: 10355 - protein, 177 aa, Artificial Sequence; identical to SEQ ID NO: 10354
  Synthetic

SEQ ID NO: 10356 - protein, 177 aa, Artificial Sequence
  Synthetic
KEEEVLKEAEEVSRRAEEKNRRINDEVRRVVRRVEETVTRVLEDVERTSKEAKERVERAGLDRKDIRRHEELSKKLMEDLKELLRDARRKVTRLSEEDKEIIDRHRDKSRKIRKMIKDGSDLDTVVEEIKDSVRKSVERSRELLERVERIVTELEKRVDELVRENEDSVRRIDERVR

SEQ ID NO: 10357 - protein, 177 aa, Artificial Sequence; identical to SEQ ID NO: 10356
  Synthetic

SEQ ID NO: 10358 - protein, 178 aa, Artificial Sequence
  Synthetic
SEAEKIVEEAKRLADKARELAERSVRHSEKLARDSEKAAREAVKEAKDLADKARDLAAKRRDEDLLRKIKEDLERAARKIKRLLEELKKRHERDNRESKKLLDKIREDLERALEKAERRAKAKEALDTARKILRDAEEAAKEAHKEANRLNKEAEEAAKRAADEARKILKKAEEDARR

SEQ ID NO: 10359 - protein, 178 aa, Artificial Sequence; identical to SEQ ID NO: 10358
  Synthetic

SEQ ID NO: 10360 - protein, 184 aa, Artificial Sequence
  Synthetic
DDLEEIVKRVRRIVEEIRRLVEELVRRDKRIVDEIKRLLEEDKRKVDEIVKEIEEVVRRGGDDKDKLKRRVEELLKDVERHTEELRKEVERLLDESRKLNKEVRDTVEKLLEDVRREIETISREEEEVRRVLKEVKDILKTVRDEVEEANEDAKRLNEEVREEAERVLRDTKRILDEVRKEADK

SEQ ID NO: 10361 - protein, 184 aa, Artificial Sequence; identical to SEQ ID NO: 10360
  Synthetic

SEQ ID NO: 10362 - protein, 178 aa, Artificial Sequence
  Synthetic
REKEVLEEVRDIVRRASERSKEALDESREILKTVDDEVRRVLEDSRRLLEEVRKRVEDNNVDEDIRRRVKEVEDRIRESLERTKRTVDKVKEEIRKSLEDTKRANEEIVRRIEELIKRREGDAREIVERVRRLVDTSRRLVEEDVRRVREVVKELRKLLREDVKRVRDVVEELAKEAT

SEQ ID NO: 10363 - protein, 178 aa, Artificial Sequence; identical to SEQ ID NO: 10362
  Synthetic

SEQ ID NO: 10364 - protein, 176 aa, Artificial Sequence
  Synthetic
SEMEDAKRKIEDLVRRVKDSLRDAERRIREVVERVERSLKEVEDRSRELLEDVKREGDTEEVKKLVRESERLIDELRRRNEDIKRRIKELIDELRKRNDDIVRRIEKLIEDLKRSTDDESVRDAVREVEDLIRRLTEDNKRLVEEVKRLVDRASEENKKLNDTSKKVVDEIREREK

SEQ ID NO: 10365 - protein, 176 aa, Artificial Sequence; identical to SEQ ID NO: 10364
  Synthetic

SEQ ID NO: 10366 - protein, 176 aa, Artificial Sequence
  Synthetic
EELERVKEEIDKLVKEVRRSLKDVERRSAELLKEVEKSLEEVERESKKVLDEVRKAGQTEEVKKLVDRSKKLIDDLRDKNRKIVDTSRKLIEDLKRRNEEIEKEIRDRIRKLSRTTDDKAVKTLLEDVRRLVREATEDNKRVNDESRELVERASRDNRRVNKESRDIVRRLEERTK

SEQ ID NO: 10367 - protein, 176 aa, Artificial Sequence; identical to SEQ ID NO: 10366
  Synthetic

SEQ ID NO: 10368 - protein, 176 aa, Artificial Sequence
  Synthetic
SELEEVERRVEKVVKEVRDSLKKVKEDIEKVLRESHKRLRDVEREVRRVLEKVRRRGDTEEVRKLEKEIRELLDELRKKNEEIRKEIEELIKTVKRINEEIEKEIRKLLEDLKDSTDDKTVRDVLRRVRKLVEDATRANEKALDDVRKLVEKSRKLVEDVLERVRRLVKELEERTT

SEQ ID NO: 10369 - protein, 176 aa, Artificial Sequence; identical to SEQ ID NO: 10368
  Synthetic

SEQ ID NO: 10370 - protein, 186 aa, Artificial Sequence
  Synthetic
DEVEDVVRKVRDLVRRVREAVRRLLEENRDLVRKLIEDSERLVREVEKLIKEVEDTVKDRKDDEELTRILEELKRRVDKLVEDDKKINKEIDDESKRLVEELEELLREVRREVEELVEDLRRKGGEEREELERVIKEIKDVVREVTKVVEKVIREAEKLNEDVNRRSEEVNKRIKKLVEDVARRVE

SEQ ID NO: 10371 - protein, 186 aa, Artificial Sequence; identical to SEQ ID NO: 10370
  Synthetic

SEQ ID NO: 10372 - protein, 174 aa, Artificial Sequence
  Synthetic
DEAEEVKKLIDKVLREVEEVVRRVNKRDKDLLREVEKVVRDVNREDKRVLEEVERSGVSEEVVKELRKLSKETHDESRRLLKELKELSEKTHKESRDLLRTAEEIVRRLKKVLDDGGPVEEIVREIEKVAEDIMRRNEELVKESEDVVRKIVRDNERLAEDSKRVVEEAVRREK

SEQ ID NO: 10373 - protein, 174 aa, Artificial Sequence; identical to SEQ ID NO: 10372
  Synthetic

SEQ ID NO: 10374 - protein, 182 aa, Artificial Sequence
  Synthetic
SAIDRVRKTLEKLVERLERVLEESSKAVEDVKEKVERLLRELRERTKRIVDEVEDMVRKANKPDDEVRDRIRRVEKENEDLVREVEDIIRKLEEKNRRLNEEIRRLIEEIRRELKELADRGVDEEELDRLVKKVEDLVRRLEELARKSLKDIKKLLKDIEDRLRKSVEKSRRLAEEIKERLR

SEQ ID NO: 10375 - protein, 182 aa, Artificial Sequence; identical to SEQ ID NO: 10374
  Synthetic

SEQ ID NO: 10376 - protein, 179 aa, Artificial Sequence
  Synthetic
DKADEAVKRVKDLIDDLKRRIDEVVKRSREVVRDIEKHAEDVVKESRRVVDEIKKLVTRGDIREEDVRRLVKRLEELNRRHEERSRRLVEELKRLNDKLNEEVRRIKRRIEDLVRRLREEGVIREEVEERVREVLRRVEKRVKEVNEESERTIRELERVSRRVNEESRRSIEEAKRAAD

SEQ ID NO: 10377 - protein, 179 aa, Artificial Sequence; identical to SEQ ID NO: 10376
  Synthetic

SEQ ID NO: 10378 - protein, 181 aa, Artificial Sequence
  Synthetic
DAVERAKEESKRVLEDAERVVRRVEEEVRKMERKAEESLKDVRRKSEEVIRKVEEVVRRKGAPREDIKEVEDRNRKLIEDNERHLREVVRELRELLKRLRDELERMKRRNKKLLDELDRVESDKEVREVVEDSRRSVRRVEELVEKVVRDVKKLIEDHERRNRESVRESERSIKELEEKVR

SEQ ID NO: 10379 - protein, 181 aa, Artificial Sequence; identical to SEQ ID NO: 10378
  Synthetic

SEQ ID NO: 10380 - protein, 185 aa, Artificial Sequence
  Synthetic
DDLERVLREVKRLVEENEKKVRRIVEESRELVERNKELLRRVVEEVRRLVKEVRDILRNVRGDDELERVLRRVEEEIRRLLTDLRRSNKRVAEELKRLNEELERSNREVERRIRELEERLREKVRDEDKLREVRERIKRLLDRSHEAVRRASEKSKRSLEESHRAVREVEKRLKELLEDVREDVR

SEQ ID NO: 10381 - protein, 185 aa, Artificial Sequence; identical to SEQ ID NO: 10380
  Synthetic

SEQ ID NO: 10382 - protein, 185 aa, Artificial Sequence
  Synthetic
DRLEEVVERVERLVRENVKRLEKVAEENRELVERNKRRLEEIVRRVRELIERAKRIVRDNTGDEELREVLRRVADEIRRLLEELDRSNKEVAKRSKESIEDLRRSNKKVEEDIRRLLEKLRRDVRDEDKLRDVERRAKELLEESHRVIRTVEERSKTVLADSHRVIEDVRRRLEELLREVAEEVR

SEQ ID NO: 10383 - protein, 185 aa, Artificial Sequence; identical to SEQ ID NO: 10382
  Synthetic

SEQ ID NO: 10384 - protein, 181 aa, Artificial Sequence
  Synthetic
DEADEVVKEVEDRVRKLVRRLEESAKKSKELVERILKRVEDSVRRSEELVERIKREVERRRDEELKKRVKELLKKSTEDNDRLRKDVERLLRESNKENRDLVRDIERELEEIKRTLEDLRRRGKVTEKVEEMLRRVLEEVRRAVRKSSEDNKRSVEEVKRVLEKAEEDNRRVVEEVDRELK

SEQ ID NO: 10385 - protein, 181 aa, Artificial Sequence; identical to SEQ ID NO: 10384
  Synthetic

SEQ ID NO: 10386 - protein, 183 aa, Artificial Sequence
  Synthetic
SKLEEVEKMVRKVIEDSRRVNEEVNRRSEEVVRELEKVHREVNDASRRVVEKARRVLKEGEDERLRREVERIIEEIRELNERDRKRVEEIRKEIEDLNRDLNRRSKESEDRLRKLLEDATRNNVTKEADEVVERAERISEENKRRVEDVARKSKELVEDVRRHSEEVVRRVEELVKEVEERVR

SEQ ID NO: 10387 - protein, 183 aa, Artificial Sequence; identical to SEQ ID NO: 10386
  Synthetic

SEQ ID NO: 10388 - protein, 183 aa, Artificial Sequence
  Synthetic
SLLEDVKRTVREVVRESRRVHKEVNDDSRRVLKRSDEAHERVNRDSRRVIERIREVLSRGEEERLKKKVEDVEREIKKLNDEDRKTVEDSKRRIEELNKRDKEKVEDSERKLRRLLEEIERRNVTEEVRELAEDARRISEDNRRNSKRVVDRVREISKENEDNSRRVVDRVRKLAEEVEREVR

SEQ ID NO: 10389 - protein, 183 aa, Artificial Sequence; identical to SEQ ID NO: 10388
  Synthetic

SEQ ID NO: 10390 - protein, 183 aa, Artificial Sequence
  Synthetic
DDLERVKETVKKVIKRSRDSTKKVADTLREVVRESERVHREVNETSRRVEEEAKRVASRGDDERLKEDLKRVVDRIRKLNKEDKDRVDKSRRDIEKLLKDLEDKNRELEREMRKLLEEIERRNVTEEVDKLADRARRLVAKSEEDNKRVMKEVTDISKENEDNSRRVVDEVRKLVEEVRRRLE

SEQ ID NO: 10391 - protein, 183 aa, Artificial Sequence; identical to SEQ ID NO: 10390
  Synthetic

SEQ ID NO: 10392 - protein, 177 aa, Artificial Sequence
  Synthetic
DKVERVVEEIRDLMRRVEELIKKAADDNRKLVKEVEDLIRDAVRDSERLVAEVEKLLTKERSEDLVRTIRELLKRNHDRLRKLEEEIKEMLKRLNEETRTLVEKIERDLKRVEEKVERTGVSDEVRKEVKRVIKAVEKVIEDVERTSEEARRRVEKVIKEVEEKNREVIKRVEDRIR

SEQ ID NO: 10393 - protein, 177 aa, Artificial Sequence; identical to SEQ ID NO: 10392
  Synthetic

SEQ ID NO: 10394 - protein, 178 aa, Artificial Sequence
  Synthetic
SEADKLVEEVKDVVREDKRRVKEIVETVRELVRRSRETVRRIVETVEEVVRRLLELLRKGEPKEELEREARELLEELRERLERLHKRSKEVLKRLRDRLRKSLRETEELLRRIKEELEKRNLEEKVEEVLRRVKRESEKVIEDVERELKRVEDDDRRVIEEVKKRLKRVLERVRTESK

SEQ ID NO: 10395 - protein, 178 aa, Artificial Sequence; identical to SEQ ID NO: 10394
  Synthetic

SEQ ID NO: 10396 - protein, 178 aa, Artificial Sequence
  Synthetic
READELVDRVKKVVEEDKRLSKELVDEIERVVDELEKVSRELVERVRDLVRRLLEVAAKGEPREELLDRAKKVLDKNREDDKRLNDEARKVLDDNRKKDKKSNDDTKRTLDKIRKDLEDRNAEDKVEKVLKRVEEESREASERNERVIERVERRVDEASKRNEDEIDKVRKEVERVAT

SEQ ID NO: 10397 - protein, 178 aa, Artificial Sequence; identical to SEQ ID NO: 10396
  Synthetic

SEQ ID NO: 10398 - protein, 178 aa, Artificial Sequence
  Synthetic
EEVKELVERVRRVVDDLRKKLEKIVEEVRDVVRKDEERSRKLVEDVKDLVRKILEVLRKGEPREELKERVDRELKKNREDDKRSNEDTERLLREIKERLDRLLEDARRLLKEIEDEARKDNLDDDLRRVLKEVDEEVRKVIEDVARVLEEVKRRSDRASRENEEVIKRVTEEVKRVVK

SEQ ID NO: 10399 - protein, 178 aa, Artificial Sequence; identical to SEQ ID NO: 10398
  Synthetic

SEQ ID NO: 10400 - protein, 184 aa, Artificial Sequence
  Synthetic
DRVEKLVEEVKRHVTEVLKTVEDLARRIRDHVRKVEDTSRELVKEIKRLVEEILDRVRKKKDKRELLKELLDRLKKAVKKIRDTNRELNKSNEKLVRDIRDTLRKLTDSNRRLLEDIDKKLEEAPEDVVRELRRVLRESNEKLKEVVDRLRKVLEESTKRVEDASRRVERVLEKVEEDVKREAT

SEQ ID NO: 10401 - protein, 184 aa, Artificial Sequence; identical to SEQ ID NO: 10400
  Synthetic

SEQ ID NO: 10402 - protein, 184 aa, Artificial Sequence
  Synthetic
SEVEELKERIREIVERIEETVRRLAKRVEDHVREVEKDSKRLADEIRDFVRRITDEVRKKKDDKDRLDKLKKDLDRLLEEIRRRNEELNKSNEDLLREIKERLDKLREELKETVKEIEKKLKDVEKRLVDKLRKVLEEVREEVERVVRELEEVLRRSTKRVEDASRELERVLKEVKETLEREVR

SEQ ID NO: 10403 - protein, 184 aa, Artificial Sequence; identical to SEQ ID NO: 10402
  Synthetic

SEQ ID NO: 10404 - protein, 184 aa, Artificial Sequence
  Synthetic
DRVEALVDEVKRHVTELLKTAERLADEVREHVDDVRKKSKELVDEIRRVVEKILDEVRKKKDDKDRLKKLKEDLKRLVEEIRRTNKELNESNKKLLDRIRETAKKMEESNRRLLEEIEKKLKDAPEEVVRELRRVLRESNEELKKVVTELEERLKDSNEEVKKASAEVRKVLEEVRADVDREVK

SEQ ID NO: 10405 - protein, 184 aa, Artificial Sequence; identical to SEQ ID NO: 10404
  Synthetic

SEQ ID NO: 10406 - protein, 178 aa, Artificial Sequence
  Synthetic
SLVEKLRRVLEEVRRTSEKVIRDVKEVNKRSEDKTREIVRRLEEVNKESKERLDRAGVPEKLKKDLTDLIRKSEKLLRENEKRNRDLIRESERLIEKNKRDNDRLIKEVEDVIERKKDKKELAEKLAREVKRLVDESKKNMDKSVEDSRRLVRESEENVRKSVEDSRRLVKRAVEETK

SEQ ID NO: 10407 - protein, 178 aa, Artificial Sequence; identical to SEQ ID NO: 10406
  Synthetic

SEQ ID NO: 10408 - protein, 183 aa, Artificial Sequence
  Synthetic
RVDEDLRRVLKEVKERNEEVVRRSKEETDRVEEDIERVIRDSERVSEEVKRRVDKAKKDVDEEEARKLEKEMKDIIDEDKELLDRLREALERLKKEDEDLIEESERKTKELEREVKKLEDEGISEELAKEVVKRVRELVDRSRRLMTESVRKVRELVEDIRRRVRESVEKLRRLVEEIERRIR

SEQ ID NO: 10409 - protein, 183 aa, Artificial Sequence; identical to SEQ ID NO: 10408
  Synthetic

SEQ ID NO: 10410 - protein, 184 aa, Artificial Sequence
  Synthetic
KEVEKLVKDVERMVEESLKENERLVKKSDELVKESEKRNKELAERSRRLVKEITDRLAEERTEEVEKRIRELLKRSHEEVRRLVETDEKLLRDSHKEARDLVRTDERLAKRVREEVDKLAKKISDEDVLRDLRRVVEEVTEKIKEVNRRSEEANKRSKDRIEEVNRRSEKVNEDVEREIERALR

SEQ ID NO: 10411 - protein, 184 aa, Artificial Sequence; identical to SEQ ID NO: 10410
  Synthetic

SEQ ID NO: 10412 - protein, 184 aa, Artificial Sequence
  Synthetic
DELEKAVERVKDIVRKSLELLKRLADRVRDIVREILDEVRRNVEEVRRIVKEIVEEVRRRKDEEVRRKVEEVLKRVRESNEELERRVREKLRKVEEEVKRIKERSDKLLRDVERELEDVRRRLDDEEALKRLERVVREVAEESDRANKELDRVVEEVKERVERVLRESNKVVKEVEDRVREETR

SEQ ID NO: 10413 - protein, 184 aa, Artificial Sequence; identical to SEQ ID NO: 10412
  Synthetic

SEQ ID NO: 10414 - protein, 177 aa, Artificial Sequence
  Synthetic
SVKETVEEEVRRVSDEDRRINRDVERVSEESNRRLDKVHKELEEVVKEVLKELDDTGLQRDLVERVKEILKRLLDEDREKVKKVKREDEELLKRLREFSKRVNDTLKELLDRLRRSTDEETARRVVEEARRIVAESKELVKEVVRRSDELVRDVEKHSRDVAKTVRKIVTDVARRTR

SEQ ID NO: 10415 - protein, 177 aa, Artificial Sequence; identical to SEQ ID NO: 10414
  Synthetic

SEQ ID NO: 10416 - protein, 181 aa, Artificial Sequence
  Synthetic
SAEETLEKVIRDVEEEDKKAHEDSRRVIETVKEEIDRVHKDSKRKIDEVKERIRREVRDEETMKKVEEELEKLLKEDRDIIKEIKERLDELLKDDKRISDESRKRLKELLDRLREVSRRENLEERVRRIVKEVREIVKRSKERSDEIVKEVKRIVKEALDLSREIVERVERIVREVVERAR

SEQ ID NO: 10417 - protein, 181 aa, Artificial Sequence; identical to SEQ ID NO: 10416
  Synthetic

SEQ ID NO: 10418 - protein, 181 aa, Artificial Sequence
  Synthetic
EADERLRKRLKEVNERDKKAHEDSKRAIDRVREEDKRVLDTVREEIKRVKDEIRRALRDEEMVKKVEEELDRLLRELERLSEKSDKDLRELLETDRRISEESHRRSRELIRRVEEVSREPELERLVREVVRENEELVTRSEELSRRIVEEVKRIVDESRKRAKEIVDEVRKRVKELVDTDK

SEQ ID NO: 10419 - protein, 181 aa, Artificial Sequence; identical to SEQ ID NO: 10418
  Synthetic

SEQ ID NO: 10420 - protein, 181 aa, Artificial Sequence
  Synthetic
DVREKLEKVLREVERRVEKASRESKETLDRVRKRLKDVSDESKRELERVKKRVDDADKRREELRRIVEEAEKKLRELLKRDKDSNDELEKRLRDLLEKDKESLKELEKRLRDLKRRADEIDDKKVIEELVEEVRRLVTEHERLSRELVDRVEKLVARHEELSKKLVTDAERIVKEVEERAK

SEQ ID NO: 10421 - protein, 181 aa, Artificial Sequence; identical to SEQ ID NO: 10420
  Synthetic

SEQ ID NO: 10422 - protein, 181 aa, Artificial Sequence
  Synthetic
SALERLREVLERVLRRVKKVTDDARRVNERVNRKVDRVSEDSERELRRVLKRVREASKDREELRKIVKKVEEDLKRLLEEDRRSNKELRERSKKTLDDLRRSDKKLEDDLKRLKEEAERVDDEEVLRELVERAKKLVDDHLELVERLVRESEKLVEDHLRRSKKIVEDVKRIVEDVERRVK

SEQ ID NO: 10423 - protein, 181 aa, Artificial Sequence; identical to SEQ ID NO: 10422
  Synthetic

SEQ ID NO: 10424 - protein, 181 aa, Artificial Sequence
  Synthetic
DEVDKARKEVDRVVKESRKLVEKNVREVEEVVKTVEKLVEDVIRRVEDVVREVKELVTRGDGREERLTRIKEELRDLLRRLKETIDKLKEELERSNEELKRRLDDLNRKLKELLEDLSKRVDEELLDRVRKVVEDVSRKSKKALDESHEVVKRVKDRADEVLDKVRRAVEEVERRIETEAR

SEQ ID NO: 10425 - protein, 181 aa, Artificial Sequence; identical to SEQ ID NO: 10424
  Synthetic

SEQ ID NO: 10426 - protein, 181 aa, Artificial Sequence
  Synthetic
DEVEKAVKEVERVVREVKELVDRNIDEVRKVVEDSKRLIDELVEDAKRVVKRVKELRDRGDGREEELRDIIRRLRKKLKELAERLEKLNRDLEKSNRELKKRIDELKRRLDELLKDLAKRVEEELLDRVRRVVEEVKKEADRLLEESHRVVREVSERSKRALEEVKRVVDEVTERIKKDKD

SEQ ID NO: 10427 - protein, 181 aa, Artificial Sequence; identical to SEQ ID NO: 10426
  Synthetic

SEQ ID NO: 10428 - protein, 175 aa, Artificial Sequence
  Synthetic
STKEKLDDVLRRVEEKAREVVEDNRRADRDVHRKARKVVEELRRVDEEVHETVKRVDAKEELRRELKKLLEDSNRLTKEVEDRIEKLLRDSNRSTKENEKRIRELEKEMRDLAREGGRRVDEVVDRLRRLVEEVLRHSKKNSRESDEMVRRVTEEVREVVKESKERVDDVLKRVE

SEQ ID NO: 10429 - protein, 175 aa, Artificial Sequence; identical to SEQ ID NO: 10428
  Synthetic

SEQ ID NO: 10430 - protein, 181 aa, Artificial Sequence
  Synthetic
KKVEEIMERLRRVAKEIKERVDRLVEKNRKSAKDLLDTIEDIVRKNRDLAEKIKDLARRRRDEKLKREVEEILKELHDRNRKLLEDVRKKLRENEEETEELKKRIEDILRRVADEIRKIEEDGVDKEKLRRVLREVEEVVRRVKKKLDDSVRELREIIRRAERELREVDEEVRKVVEDVKR

SEQ ID NO: 10431 - protein, 181 aa, Artificial Sequence; identical to SEQ ID NO: 10430
  Synthetic

SEQ ID NO: 10432 - protein, 180 aa, Artificial Sequence
  Synthetic
RVREELKKVEEEVREVVRRAKEKTRRVLEEMRKVVKDVDDESKRVVDEVKKVLEEVRARGLDTEELKEIEERIKRKLEEINERNRDLLRRVERLVREDERRIDEILTEIKRTVDEIRDLTEEEVVKKVVDDIRKLAKDMDDHSKEVVDRIREVARRIEELNRELVRDLKDEVRRVKEKAK

SEQ ID NO: 10433 - protein, 180 aa, Artificial Sequence; identical to SEQ ID NO: 10432
  Synthetic

SEQ ID NO: 10434 - protein, 180 aa, Artificial Sequence
  Synthetic
SVRETLKTVEEEVKRVIDRARKRDERVVREVERVLRDAMRKDEDVNRDVERVLRDVVRRGLDTEKLKRIKEEIDKLSTENRKRIEDLLREIRKLSEESDRRLKEVEKEIRERVEEIRRRTDKDVFKRVVEELRRLVKRVEELVTRTVEEIDRIAKEVTRHSEETVRRLKKLVKTVTDEAN

SEQ ID NO: 10435 - protein, 180 aa, Artificial Sequence; identical to SEQ ID NO: 10434
  Synthetic

SEQ ID NO: 10436 - protein, 185 aa, Artificial Sequence
  Synthetic
SSVREVVKEARDIAKENLERVKKTVKENRDLARKVAEDVKKSVEELRKLAEDVEEIARKATGDEDLERVLREVEERIEDLHRRSEEIAREVRKRSRESHERTKEITTDSRRRIEELLKKVKDEGVEEELEKELRTVVREVEEVLRRSEEDDRRVHKEAEDVIKKVEEDDKEVVDRVKKVIRDVRT

SEQ ID NO: 10437 - protein, 185 aa, Artificial Sequence; identical to SEQ ID NO: 10436
  Synthetic

SEQ ID NO: 10438 - protein, 185 aa, Artificial Sequence
  Synthetic
SEVEKIVKEAEDLVREVKRRVEDTVRKNRELADRVRKEVDKSVRELRELVKRVLDIAKDLTGDEELERVLRTVRERIKELHERSKKIIEDVRRKSEDSHRKTKKIADDVRRKLDKLRRDIERRGVSEELRRELERVIKKVEEVIRKAEEDDRTVHRELNKIIKDVEDKDRTVVEEVERVIEEAER

SEQ ID NO: 10439 - protein, 185 aa, Artificial Sequence; identical to SEQ ID NO: 10438
  Synthetic

SEQ ID NO: 10440 - protein, 185 aa, Artificial Sequence
  Synthetic
SEVDEVVERARRIAKENLDRVKKIVRENRELVEKVRKDVEDSVRTLKKLVDDVTEIARKLTGDEELKRVLDEARERIKRLHDESKKIAEEVRKRSRDSHETLRKITDDSRREIERLLRKVEEDGVSDDMRRKLETVVKEVEDILRRSREEIRTVNEEVEKVIEEAEREDERVVREVEEVIKRVEK

SEQ ID NO: 10441 - protein, 185 aa, Artificial Sequence; identical to SEQ ID NO: 10440
  Synthetic

SEQ ID NO: 10442 - protein, 185 aa, Artificial Sequence
  Synthetic
SSVEDVVRKMRKIVEDNKREVEKIVRENRKMAKDNEDLVKESVKDLKRLAKELEDLAKDDTGDETLERIAREVRKRVEELHRRSKEITDRTEERSRRSKRRLDEITKESRREIERLREEVEREGVSEDLERTLRTVVKEVKEVLDRSRDLVRRVNEEVKRVLDRSREEDERVVREVEEVIRRVET

SEQ ID NO: 10443 - protein, 185 aa, Artificial Sequence; identical to SEQ ID NO: 10442
  Synthetic

SEQ ID NO: 10444 - protein, 185 aa, Artificial Sequence
  Synthetic
REVDEIVDRLRRIAKENKDRVRELVERNRKLAEEVRRRVEESVKRLRDLVRTIEELARRETGDKRLEDIVRDLREKLRRLHETSKRILEELEERSRRSNDELREITERSKKRVDDLLEDLKRKGVEEDLERKIREVVREAEEVLRESKREMDTVNKEVREVIEDVRKRDEDVIREVEKVIREVEQ

SEQ ID NO: 10445 - protein, 185 aa, Artificial Sequence; identical to SEQ ID NO: 10444
  Synthetic

SEQ ID NO: 10446 - protein, 185 aa, Artificial Sequence
  Synthetic
SEVDEIVKEIREIARKNKEDVRRTVEDLRRLVKEVEKRVEDSVRTMRDLVRRLEETARRVTGDEELTKVIEDVRRKIEELHRRSKKILDEVREKIEELHRRTKKITEESRERLKKLEKDIRDRGVSEELERKLKTVIDEAEKVLRESEEDDRRVVEEVERVIKKVEEEDRKAVREVEKVLEDVRK

SEQ ID NO: 10447 - protein, 185 aa, Artificial Sequence; identical to SEQ ID NO: 10446
  Synthetic

SEQ ID NO: 10448 - protein, 181 aa, Artificial Sequence
  Synthetic
REVDELLKRIKEVADDIKRLSDENVKEIEKLAREVEKLVRDVVRENEEVAKEIEDLARRRKDEDVERRAEELLERVHRANEEIKKRIEELLRRVNERSKEIVRRIEDLLRRVAEEIKRAEEAGVDKKKLRDVLRELEKVVRDVAKEDEDANRRLKEVAERVKREIDEVDKKLKKVLDDVRK

SEQ ID NO: 10449 - protein, 181 aa, Artificial Sequence; identical to SEQ ID NO: 10448
  Synthetic

SEQ ID NO: 10450 - protein, 179 aa, Artificial Sequence
  Synthetic
REEEKLRKVLEDAKKVSKEVNEEDDRVNKEVEDVLREVKKEIDEVLKRATETVERVKRENKDSEELKKTIDDIRRKIKKEIDDVKREIDELLKDARRHSKEVKDEDKRINDEIREILRRRELPVDEIVKRIKELVDRSRKLSEENVRRLKKIVKRVKERVKELLDRIKEMAKEIEDRVR

SEQ ID NO: 10451 - protein, 179 aa, Artificial Sequence; identical to SEQ ID NO: 10450
  Synthetic

SEQ ID NO: 10452 - protein, 179 aa, Artificial Sequence
  Synthetic
DEEKKLKEVLDRATKVVKDVAEELDRVLEDVERVSRDVNRRDEKVNRDADRVLREVKDENKDSEKLKREIDEIKKDVERHSREVSEEDRRINKEIREKLRTVKEILEDLRRKIEETLRRKELPVEEIVRRIEEVAKTLREIVRRVLEELKEVVKESERLSRENVRRIEKLAEEIRRRVK

SEQ ID NO: 10453 - protein, 179 aa, Artificial Sequence; identical to SEQ ID NO: 10452
  Synthetic

SEQ ID NO: 10454 - protein, 179 aa, Artificial Sequence
  Synthetic
DEDEKLRKVLEELRRVVEEVKRRSDKALEDAERVLRRVKKEDRDANKKAEDELRRVIDENKESEELIREIERLLKEVREHSKEVEDRIDELLKRIEEHSRKVKKDIERLLEEIDREVKRKERPVDEILKRIEELMKEIRKLVKEDVDRIRDLVRRIDEESKENVKEIERVADEIRERIR

SEQ ID NO: 10455 - protein, 179 aa, Artificial Sequence; identical to SEQ ID NO: 10454
  Synthetic

SEQ ID NO: 10456 - protein, 180 aa, Artificial Sequence
  Synthetic
KEVEDVLREVEKVVEKIKRDVEKIVKDSKELAKRVEELVKESEDRSKEIVDRVEKLRREGTKDVERIIDRLLEDDKRLSDKTKEDLDRIAREDEKLLDELRRRIDEILKRLEELVKELRRAGAEEEKVEKVLRKVRDVVRRVKEKVEEVHRRSREMLKRVEDRDREAHERSRKVAEDVKR

SEQ ID NO: 10457 - protein, 180 aa, Artificial Sequence; identical to SEQ ID NO: 10456
  Synthetic

SEQ ID NO: 10458 - protein, 180 aa, Artificial Sequence
  Synthetic
SEVDEVLETIERIVREVKKLVKRSVEESERLVDEVEKLVEKSVREIKEIVDRIRDMKTKGGKDLEKLLDTMLEKVERLSRKTETEIEKIERDDRELSERTKRELEKLRETVKRLVDELRRAGAEREKVERVLEEARRVIEEVEREDDDAHRKSKEVLKRVLEKDRKALEDAKKVVEEVKR

SEQ ID NO: 10459 - protein, 180 aa, Artificial Sequence; identical to SEQ ID NO: 10458
  Synthetic

SEQ ID NO: 10460 - protein, 183 aa, Artificial Sequence
  Synthetic
KEVEDLERRNKELVERVDKLSRENVERNKKLAKELKEISEENVRRNRKLAEELKEVADRGDSRLEELIRRIEEESKDSDRKSEELLRRIKKESEESDRESKDTLEKILRTSEELLRDMERKGLDEDLRRRVKKSHDEVERELRRVDREDETSHEELRRVLEKVKREDRKSHEEVKRRLDEVRR

SEQ ID NO: 10461 - protein, 183 aa, Artificial Sequence; identical to SEQ ID NO: 10460
  Synthetic

SEQ ID NO: 10462 - protein, 183 aa, Artificial Sequence
  Synthetic
SEVDEIVKRNDDLAKEVKRLSTENVKRNKELADRVKRLSTENVKTNEKLAKDLERVVRRGVSRLKDLIRKIETDSRKSDEESERRLREIEKESRRSDEESRKRLKEILDRSKKLLEELERRNLDERLRRKVEKSHRDLREVLERVRREDERSHEEANKVLEDVKREDEKSHRDVKKRLDDVRR

SEQ ID NO: 10463 - protein, 183 aa, Artificial Sequence; identical to SEQ ID NO: 10462
  Synthetic

SEQ ID NO: 10464 - protein, 183 aa, Artificial Sequence
  Synthetic
SEVDRLLEKLEELVRKVRRDVEENVKKNDELAKEVERLSKRNVERNEELAKEIEDLARRGDSRLEDLIKEIEKESRDSDRRSKEELRRIKEESKRSDDESEKKLKEIEDEVRKLLKDADDRGLSEELKEKVKRVMEKVKRVLDRVREEDEKSHRKADRVLREVEKRDRDSHERLRKVLDDVRR

SEQ ID NO: 10465 - protein, 183 aa, Artificial Sequence; identical to SEQ ID NO: 10464
  Synthetic

SEQ ID NO: 10466 - protein, 183 aa, Artificial Sequence
  Synthetic
DEVREIVERNERLAREDKKIAEENVRRNEDLVRRLRELSRKNVEDNRRLAKELEEVAARGDSRLDELIEEIERRSEESDRESRKRLDEIREESERSDRRSKEESDKINEDSKKLLEEADRRGLSEELKKRVKDSHDKLREVSKRSEELDRKSHEDLKEVLKEVRERDDRSHEELRRVLEEVKR

SEQ ID NO: 10467 - protein, 183 aa, Artificial Sequence; identical to SEQ ID NO: 10466
  Synthetic

SEQ ID NO: 10468 - protein, 183 aa, Artificial Sequence
  Synthetic
DEVERILERIDELVKRVKELSRRNVERNKELVERVDRLVKDNVDRNRRLAEEVDRLKKEGDSRLKDLIREIERESRESDKRSEELLKRIEDESRESDRDSERKLKEIDDEVEELLKRARERGLEEELTKKVEKVVKDAKKTLEEVKREDEDSHKKANDVLRRVRELDKRSHDELKRVLDEVER

SEQ ID NO: 10469 - protein, 183 aa, Artificial Sequence; identical to SEQ ID NO: 10468
  Synthetic

SEQ ID NO: 10470 - protein, 183 aa, Artificial Sequence
  Synthetic
SEVEDVLKKLDDIAKEVTERVKRVLDRNEEIVDEVEKLVEEVVRRNKEIVKEVKRLKDEGLSRLDEALDRVKKESKKSHDTAKDVLDKVRRKDEESRREVEKRLRELEKKLKDLLDEVRKRGINGDLEREVRRVIREVEKVIDDVRREVERSIRKSEKDIREVEKRVEDVNREVEEAIRRVRT

SEQ ID NO: 10471 - protein, 183 aa, Artificial Sequence; identical to SEQ ID NO: 10470
  Synthetic

SEQ ID NO: 10472 - protein, 184 aa, Artificial Sequence
  Synthetic
REVEELVKKLKELAERSLTAVERIVEENERLLKRLEDESKRNVDDIERLARELLRRVEEEKTKEVKDTARELVERLKRHSERLIKEIRRLLEELNRKNRKLVEDSNRKTDEVRKEVEDLRQKIDDERVERILTKVIEDLERVDKAAHDILREVNERLREVMERVEKTNRTVNRRLEEVLKEIER

SEQ ID NO: 10473 - protein, 184 aa, Artificial Sequence; identical to SEQ ID NO: 10472
  Synthetic

SEQ ID NO: 10474 - protein, 185 aa, Artificial Sequence
  Synthetic
DEVEEIAREMREIVDRVLKLSEKTVRENRESVERLLRLSEETVRRIRDLVRRLEELARDDTGDKDLKKVLDEIRKRVEELLERSKRVSDENRERSERSLRESERIIKELKERVDELVERLERRGTSEEMKEKVERAVEEVKRVLDRVRETDKRVNEEVRKVNEEAERIDEKVVREAREVLKRVRD

SEQ ID NO: 10475 - protein, 185 aa, Artificial Sequence; identical to SEQ ID NO: 10474
  Synthetic

SEQ ID NO: 10476 - protein, 185 aa, Artificial Sequence
  Synthetic
RVAERLEDVLRELDRTLKDVARKLEEANRDNKRVLEEVAEILKRVLDDLRRVLDEVAKRLKDEEKLRELKKRAEELERDIERLLREAEKSSREDSKRSKKLLDELERRVRELKKKIKKLLDDKKNVEKVVDDIVKEVRELAERIKEVVTESVKHSKKNVDEMRKLVDDVVKKVKKLVEDVRREIK

SEQ ID NO: 10477 - protein, 185 aa, Artificial Sequence; identical to SEQ ID NO: 10476
  Synthetic

SEQ ID NO: 10478 - protein, 185 aa, Artificial Sequence
  Synthetic
SVAEKLRKVLEELRDVLRRVKEISRRSLERLKKVLKELADRLKELNDKLRKTLEELRKDVDDKDLLADITRKAKELSDRSRKLLEDAEKEVRDAAEKNRRLDTELEKAARDLEKKVRELLKDKKDVEELVEEIVKEIKKLAKEVAETVDKVAKENEKLAKEAKEKVEESERDVERLLEELKREAD

SEQ ID NO: 10479 - protein, 185 aa, Artificial Sequence; identical to SEQ ID NO: 10478
  Synthetic

SEQ ID NO: 10480 - protein, 175 aa, Artificial Sequence
  Synthetic
DEEKILEDVLRELKKVLDEVRKTNEDANKRLKDVDDKSHEILKRVEERLREVVKRVNVDSEKFKRIKKLVEDAKRELKEIVDDSNRKTKKVNEESRRDIRRLEELVRTVEEELRRRDVRVEDVVRRVRKVAEDVRRSSEETVKRIEDVVRRSEETVRELVKRVEDLVREMEEEAK

SEQ ID NO: 10481 - protein, 175 aa, Artificial Sequence; identical to SEQ ID NO: 10480
  Synthetic

SEQ ID NO: 10482 - protein, 175 aa, Artificial Sequence
  Synthetic
SDEEKLRKVERELEEADKESHEINRTVNEDLRRVDRESKEILDRVRKELEEVKDKINVDSDKMRKVEELVRRLEKELERIREESNRLTKKVNEESRRDLEESNKLTDEVREELKRREVRVEDLVRRVRKVAEDSRRSSEDTVRRVERVVRESKRLVDDLVRRARRVVEEIKRTAK

SEQ ID NO: 10483 - protein, 175 aa, Artificial Sequence; identical to SEQ ID NO: 10482
  Synthetic

SEQ ID NO: 10484 - protein, 175 aa, Artificial Sequence
  Synthetic
KEDEILKTVVDELRDALREVEERNRTVNEELRRADKESEDRLRKVVRELTEVMKRVNVDSRKMEEIKKLVKEVRERLKKILEESNKLTEDVNRESREDIERLRKLARDVEDELRRRTVPVEELVRRVREVVKRVRDSSRETVERVKRVVERSRRLVERLVRKVEEVVREVEERAR

SEQ ID NO: 10485 - protein, 175 aa, Artificial Sequence; identical to SEQ ID NO: 10484
  Synthetic

SEQ ID NO: 10486 - protein, 183 aa, Artificial Sequence
  Synthetic
SDVDRFLREVERLVERARKLSERDERETRKVVKEVRDSSRKSVEDSKRVVEKLEEEARRGGDDKETLKRRVETLLKEVEDMHRRDKEEIDRLLEEVKRNHERSKKEIEDLLDDVRRKLEEIRKKGVEKEKLDKVLEDLRRVVEEVKRRNDEVLKRLKEVVDEVTKRNRKALEDAKERLKKVTE

SEQ ID NO: 10487 - protein, 183 aa, Artificial Sequence; identical to SEQ ID NO: 10486
  Synthetic

SEQ ID NO: 10488 - protein, 183 aa, Artificial Sequence
  Synthetic
SEVDEVAKRVREIVERLRDLVRKVVEDNERIAREVKRSSDETLKEIRDIVRKAKEVADRGGDDEDRLREELERLLREVHKKSEDDRRRLEKLLRDVHEKNKEVKKELKRLLDEVRKEVERIKERGVDERKIDKVLKELEEVITDVRRTLDDVDRKLREVVKKVEEINRRANEELERVIREVRR

SEQ ID NO: 10489 - protein, 183 aa, Artificial Sequence; identical to SEQ ID NO: 10488
  Synthetic

SEQ ID NO: 10490 - protein, 183 aa, Artificial Sequence
  Synthetic
DDVERLLKKVEDIVRELRESSRKSVEEIKRIVKEVKRLVDEVVKENERIVEEAEDVMRRGGDDKDKLRRRLERLLEEVHRRNKDVKDRIRELLKEVHDRSKRDKEEIRKLLEELERDIREIKKKGVEREKLDEVLKRARDVLREVEKENDKANKELEEVAERVKKTLDDVDKKLEDVMRKVTK

SEQ ID NO: 10491 - protein, 183 aa, Artificial Sequence; identical to SEQ ID NO: 10490
  Synthetic

SEQ ID NO: 10492 - protein, 181 aa, Artificial Sequence
  Synthetic
KEEEIVERVREKIKRVLDEVREIDKRAHDELRRVLKEVEDIVRKVHEDLKRVLEEVRREVKGDKRIDDELREIEERSRRSVEDAKRLLKEIEKRSRDSEKRSEDVLREIEERITRLEDLLRRGLDVKTVVETVDKIAKEVRDLSRRSVEENRKLAREVREVVRKVVEDNRRLAREVRERVR

SEQ ID NO: 10493 - protein, 181 aa, Artificial Sequence; identical to SEQ ID NO: 10492
  Synthetic

SEQ ID NO: 10494 - protein, 181 aa, Artificial Sequence
  Synthetic
DEDEKVEKVTREVEKALDEVRKIDEEAHRRLKRVLDEVRRIDETVHRDLKRVLDEVRERVRGVRELEERLKRIEEESRESLRRSEELLKEIEDRSRESLERSKKLLRDVERTIDRLRELLKRGLDVETVVERLRRLVEDIRRKSRESVERNRELVKEAKDVSRKSVEENKKLVRDITREAT

SEQ ID NO: 10495 - protein, 181 aa, Artificial Sequence; identical to SEQ ID NO: 10494
  Synthetic

SEQ ID NO: 10496 - protein, 184 aa, Artificial Sequence
  Synthetic
SVDEIVERVERELKRVLDEVREIHDRARDELRRMHERSERIIRKVEEELERALKEVRDRGVPREVLKRIEEIVKRVKDKLRELLKRSKELVERIERENREVLRKIEETARKVEEELERLRREGVDDKVVREAVREVERVVTELLEESRRSVEKTERLVRRSEELIRKIVKEVKKVAREIREEVR

SEQ ID NO: 10497 - protein, 184 aa, Artificial Sequence; identical to SEQ ID NO: 10496
  Synthetic

SEQ ID NO: 10498 - protein, 184 aa, Artificial Sequence
  Synthetic
SVDEILRKVKEELDRVLEEVTEIHRKAKEELDRAHDTSERIHREVKRELDRVREEVERQGVPEEVLRRIEEIVRKLKEENDKVLDDSRKKVEKLKRENDRVLEEIKEIVDEVKKRLDELRERGIDEKVVKEVVDEVRKVVEEIRKKSKDSVDKTKRVVEESIRTSDEVVKKTEKLVREIEKEVR

SEQ ID NO: 10499 - protein, 184 aa, Artificial Sequence; identical to SEQ ID NO: 10498
  Synthetic

SEQ ID NO: 10500 - protein, 184 aa, Artificial Sequence
  Synthetic
SVEEIVRKVTKELRDAHRRTEKILRDVDKELKEVLDRVRKIHRDVKERLEKVLDDVRKRGVPKEVLDEIRKLVEDVKRENDKLLKEIKKIVEDLHRKNRDLKRKSEELVRRVEEELRELRRRGVDEEVVTRAVERVKRAVKKSEDDVRRIVDENRKLVKEIEDRSRESVKKTEELIERIRKRVE

SEQ ID NO: 10501 - protein, 184 aa, Artificial Sequence; identical to SEQ ID NO: 10500
  Synthetic

SEQ ID NO: 10502 - protein, 183 aa, Artificial Sequence
  Synthetic
NVEDILRKAEEEVRRMLAENERIVEEAKERAKRMLDESRKRLEEVLRRAREVLEEVDKRKKDERLKETIKEVEDRVEKLLREVEKHSKDVKREVEELLRRNKKKLDELRDEVRKLLEEVKRSTSEDVVRAVVEELRRLLEESIRHVRKVVREIEKLLREDIELVKEVVRRIERLLRELDKEVR

SEQ ID NO: 10503 - protein, 183 aa, Artificial Sequence; identical to SEQ ID NO: 10502
  Synthetic

SEQ ID NO: 10504 - protein, 181 aa, Artificial Sequence
  Synthetic
RKVDELRKEVRRVVKESRDKAKRVVEEVKRLVEKSRRDVKRVVDENRRVVEEMRRKVKDRRTEDVKREIRETLEDLERKNRKLLEDSEREARDLKRRIDELLERSREEVKRLKDEIKELRDRGLGDKEVKDAEDELDKAHEDTKKILDEVKKELDDAHDETRRILEEVNKESETVLEEVER

SEQ ID NO: 10505 - protein, 181 aa, Artificial Sequence; identical to SEQ ID NO: 10504
  Synthetic

SEQ ID NO: 10506 - protein, 181 aa, Artificial Sequence
  Synthetic
SLARRVEEEVKRVVDESEEKVRRVVKVNKEMVDDVRRLVKEVVDENEEVVKEVRDTVTKRKTEEVKERIERLIREVRKKNEEILRRIERLVEDVERKNREILRDSERTVRELEKRIKELEDNGLGREDVRRVEEELKKAHDDTKKILDDVDERSREALDEVRKELDRVNKRSDKALKDVRK

SEQ ID NO: 10507 - protein, 181 aa, Artificial Sequence; identical to SEQ ID NO: 10506
  Synthetic

SEQ ID NO: 10508 - protein, 181 aa, Artificial Sequence
  Synthetic
SKAEELVKRVKEVVDKVRKLVEEIEEKVKRVVEKSRRDVTEVVKKNREVVKRVKDTVRRRKTEEVKTRIKKEVDDVRKENEDLLRESKKRLDEVKDEIRRVEEEVEELVRRLEKRIDELRKNGLGEEIVRRAREELERVLDEAKRILEKVTRELDEAHKETEKILRDVNRESDKALEEVER

SEQ ID NO: 10509 - protein, 181 aa, Artificial Sequence; identical to SEQ ID NO: 10508
  Synthetic

SEQ ID NO: 10510 - protein, 178 aa, Artificial Sequence
  Synthetic
SEDEKLDKVRKRLERAHEESKKISDKSEKDTRDAHRKTEEILDRVRKEMEEVLKRVRDRGISEELLDRADKVVEDVRRTLKKVLDDSRELLKKLEKLNRDVEDRSRRLLERVKEKLDRKEEPAEEIVKDVERVVKESEDLVRRIVEINERIVRESERLVKEVKDRVRDMVRRLAEEAR

SEQ ID NO: 10511 - protein, 178 aa, Artificial Sequence; identical to SEQ ID NO: 10510
  Synthetic

SEQ ID NO: 10512 - protein, 182 aa, Artificial Sequence
  Synthetic
SVEDIIRKVEKEVEEVVEKVERILDTVRRRSEKVLRENKEILEEVKRRADKVLRDVERNSKDKDLERVLEEVKRRVEELLDRNRKVLEEIEKRNRDLLREVEESIRRLKKEVDDLSEEVRNKPEEVAKRLEDRVREIVRTLEDLVREIVRRSEESVRRSRESAKRVVDTVKRIVDELEKRVR

SEQ ID NO: 10513 - protein, 182 aa, Artificial Sequence; identical to SEQ ID NO: 10512
  Synthetic

SEQ ID NO: 10514 - protein, 182 aa, Artificial Sequence
  Synthetic
DVEEIIRRVSDKARKVLDRNRKILEDVKRRSEEVLEENKRIVDEVDEIIDEVLKRVKKRSKDERLEKLLEDIRREVRRLKEENRKVLEEIKRTNEKLLEENDRKLKRIEEEVRELEERVRDKPREVVDRAVKRVEELVKRSERSADEVRKRSTESVKESKRSAKKVVEDVRRLVEELERRVR

SEQ ID NO: 10515 - protein, 182 aa, Artificial Sequence; identical to SEQ ID NO: 10514
  Synthetic

SEQ ID NO: 10516 - protein, 180 aa, Artificial Sequence
  Synthetic
SEEDIIREAERIAREALKRARKIAEDARRISEKALEDARRIAKEAHDISKKALEDAARKRRREDVERALEDVERKDRKLLRELEEALKRVARESEESLKELKRLLEKVEEDIRRLADAARRGLDAKRAAEEAKRLAEEAEEAAKRVADRNRKLAKEAADLAREVAKRSEELAREAAKKAQ

SEQ ID NO: 10517 - protein, 180 aa, Artificial Sequence; identical to SEQ ID NO: 10516
  Synthetic

SEQ ID NO: 10518 - protein, 180 aa, Artificial Sequence
  Synthetic
REDEKIEEVKRRAEEVLKESKKIIEDVLKKSEEVIKEVREILEKAHRISAKVLDEVRKTRDDKSVEDILREVEKRDKDLERELERVIEEVKRRSDTSVERVKRENDRSKREIEKLDDLVKRGLDVDEVVERVERIVTKNLRLAERVVEENEKLVEDLRRLVADVVRTSKKLVDDVRERVR

SEQ ID NO: 10519 - protein, 180 aa, Artificial Sequence; identical to SEQ ID NO: 10518
  Synthetic

SEQ ID NO: 10520 - protein, 180 aa, Artificial Sequence
  Synthetic
SEDEKVDEATKEAERVLREVRKIIKRAHDRSRDAEREVKRTLDEVRRETKRVLEDVDRTRRDETIRKLLEEVERRSRKSAEDLKRVLERLRREDEKLVKDLEDALRELKERIDRLRDLLKRGLDVDEVVRRVKEIVRRLEELAKEIERRSDEIVEEIRRLVKKVVDENRKIVKKAEEDAR

SEQ ID NO: 10521 - protein, 180 aa, Artificial Sequence; identical to SEQ ID NO: 10520
  Synthetic

SEQ ID NO: 10522 - protein, 180 aa, Artificial Sequence
  Synthetic
DEDEIIDEAKKRADEVLKRSEDILRRAREEVEKVLEEVRKIIEDVHRRSRKVLEDVRRKAKREDVEKAIEDVEREDKRLVEELKKVLEEIRRTIERLAEELKRVNDESRDRIRKLEELVKRGLDVETVVRRVDEIVKRNEELARRLVEEAKKIVDDLRRLAEEIVKRSEDLVEKLKEDAR

SEQ ID NO: 10523 - protein, 180 aa, Artificial Sequence; identical to SEQ ID NO: 10522
  Synthetic

SEQ ID NO: 10524 - protein, 177 aa, Artificial Sequence
  Synthetic
SIEDVLRDVARKLRTVVDEARKILDEVDKATEKVLREAERVIREVAKRDKKVVDEVRKGGLPEDVVRRIEKLSEDNAERLTRLLKRVEELVREINKRNRDIAREIEELVRKVEEELERKKVAEDLLKLVEDVVRRIRKLAEDVKRENDKLVERIREVAEDVLRHSEETVEEARKAAE

SEQ ID NO: 10525 - protein, 177 aa, Artificial Sequence; identical to SEQ ID NO: 10524
  Synthetic

SEQ ID NO: 10526 - protein, 177 aa, Artificial Sequence
  Synthetic
SSEEALKEVERRLEDVRREVKRVAEEIKKKDDKVNDDAREKLERVNRETKRVLEELAREGLPEEVVKELKELVDKINTDNRRIEKRIKELSDENKRDIDRLEKRAEELLARIKEELEKRDVVEELKDKVRRLLEELKRLLEELDKHSARTIKEIRDLIETLRRINEKVIEDMKRRRD

SEQ ID NO: 10527 - protein, 177 aa, Artificial Sequence; identical to SEQ ID NO: 10526
  Synthetic

SEQ ID NO: 10528 - protein, 184 aa, Artificial Sequence
  Synthetic
SELDEAKRLVDEVVRRLEELLREDKKLVAEVEREVRELLERNARLLKEVADRIRRLKEEGGDNREELTRRLEKLVRDVEEHSKEVKKRIERLIREVEKHTDEVLERVKKLVEDVKRELEKLRNEDEKVVREIERLLRELEKALEDVERELRRSKDRLRKLAEEVKKVLDDSRRELERLREELRT

SEQ ID NO: 10529 - protein, 184 aa, Artificial Sequence; identical to SEQ ID NO: 10528
  Synthetic

SEQ ID NO: 10530 - protein, 179 aa, Artificial Sequence
  Synthetic
KDIEDAVRDVRRKVKELIENSERVVRTVEKLVRELIDHSRKVVREVEKLAKELIELKRRGDIREEDLKRVKKRVRDLNERNKEEVEKLKRTVKKLNDDDKRKVETLKEDVDREKKRLRERGVDEEVLKEVDRVLREAEKRSKEINEESKRVLDKAERDSRRIDRKSEEVVKRAEEEVRT

SEQ ID NO: 10531 - protein, 179 aa, Artificial Sequence; identical to SEQ ID NO: 10530
  Synthetic

SEQ ID NO: 10532 - protein, 179 aa, Artificial Sequence
  Synthetic
EEIERVLRRVTERLKELERHSEEVLREVERLVKEDEDLAREVVKRVEELIRTLRELKKRGDAREKVLKEVKETVKKLLDELEEHTRRVKEKVERLNRDNERVVRELRKEVEELLDELRKRGVDRRVLEEVREVVDRAEKKIKELDDRSREVLKEVEKRSRDIIREIEEKLKDVEERVKD

SEQ ID NO: 10533 - protein, 179 aa, Artificial Sequence; identical to SEQ ID NO: 10532
  Synthetic

SEQ ID NO: 10534 - protein, 179 aa, Artificial Sequence
  Synthetic
SKAEEVAKRVEDLAREDIKLAERAAREVERLARENIKLAREVAKRVEELARRLIEAARRGDAREEVAKRAADTVRKLLEELRRENKKSAERAKELAERARKHTEEALREVKKLLEDARREGADEKALKDAEDAARKAAEDSERAIERAERAAKDALKKSEDAAEEAKRAADKALEDAAR

SEQ ID NO: 10535 - protein, 179 aa, Artificial Sequence; identical to SEQ ID NO: 10534
  Synthetic

SEQ ID NO: 10536 - protein, 182 aa, Artificial Sequence
  Synthetic
DEVRDLVRRVRELSEELIRRVRTLLREVEELSRRLIEESERLLREVRKIVEELIRRVERREPEEVLRELIDRARRKLEKLAEDVKELNKRHEDRLRELEKRIKDLNKKHKDALDEIKKRVREAGVEERVVKEAEEVVERANRESEKLLEDVKRVVEEANKTSEDILRAVEEIVRRVLEELKK

SEQ ID NO: 10537 - protein, 182 aa, Artificial Sequence; identical to SEQ ID NO: 10536
  Synthetic

SEQ ID NO: 10538 - protein, 182 aa, Artificial Sequence
  Synthetic
SSKEVLERVAEKLKEVNERLKDVLRRVAEKLKRANEENKKVLERVRDILREVLRRLREKVTDKDKIRELETRIKKLLDDLERSSKDDSRRSKDLLRKLEELVRDLSKRSKELLKELEDLVRRGDGSVEEAERVVEKSVEEARRLAERVKEEVDRSVKHSEDNVREMRRLVEEIVKRVEEAAK

SEQ ID NO: 10539 - protein, 182 aa, Artificial Sequence; identical to SEQ ID NO: 10538
  Synthetic

SEQ ID NO: 10540 - protein, 182 aa, Artificial Sequence
  Synthetic
REKEVLDRVEEILRDANRRNEKVLREVAEIIRTVIEDNKRVLKEVADELRRVLEELRDKVKDKDRIKKLEEEIRKLLDELRRSSDKVTKESEELLRRLEESSRRDSEKSKRLLDRLEELVRRGDGRVEEMEDVVRRSLDHSRRNVEEAKKAVTKVVEDNKDNVRRIKEVVARVVEKAREEAR

SEQ ID NO: 10541 - protein, 182 aa, Artificial Sequence; identical to SEQ ID NO: 10540
  Synthetic

SEQ ID NO: 10542 - protein, 181 aa, Artificial Sequence
  Synthetic
SEVEEVLRRSRESAKKSKEHSRELLEKVKRIIDDVKRLVREVLKRSRDSIKRVEDLTRRGDIDEDTVRDVVRRNKRLLDELRRAVEDAVRKIDEELKRNERDVERVVRENEELLKDLLRRRDTEKVKEAVKESRDLLRKVEETNRRVNDEVRKLLEDIRRDVERAVEESERLLEDIVRKVK

SEQ ID NO: 10543 - protein, 181 aa, Artificial Sequence; identical to SEQ ID NO: 10542
  Synthetic

SEQ ID NO: 10544 - protein, 175 aa, Artificial Sequence
  Synthetic
SDVERVLTEIRKLVEDIKRDVERVVDESRKLVEEAERDVERVITEVEKLVERIKREVRDDDLRRLAEEVAERVKRIVDKNRENVRKSAEDNKELIKENRRHAKEVEDRVREALERGGERARELLKRVRELIKEHNRLNRESLKTSRKNIEDHHEDNKRSLEEARRIIEEVREAAR

SEQ ID NO: 10545 - protein, 175 aa, Artificial Sequence; identical to SEQ ID NO: 10544
  Synthetic

SEQ ID NO: 10546 - protein, 180 aa, Artificial Sequence
  Synthetic
KELEDVEKEVEEVAKRVEDSIRRNREVVEKVKDEVRRLLDRNDELVDRVAKEITEAIKKGKDDREVEKRVTEVKKHSEDLLRDVERLVEEVKRHSREVTKRNRDLVTDVRRKLEEVVRRRDEEKVKKVLEDVRRRLEELIKRSEDSAREVEKRLEDLRREVEESLERVERTLEDLVRRVK

SEQ ID NO: 10547 - protein, 180 aa, Artificial Sequence; identical to SEQ ID NO: 10546
  Synthetic

SEQ ID NO: 10548 - protein, 186 aa, Artificial Sequence
  Synthetic
SELERLEERVRRIEEEVKRLLEEHREVSDRVAKENRRSNEESKREVRRIEEEVKDLSRKGGDDRRRILEEVKRLVRELEKLLEEDITKSRKSVEDVRKHAEELLRTVRKLVRDLEKLLKEVLDRMGNSEEVKKVVEDVKRRLDDLIRKAEKVVRDSERELKKLVDHSKEVVDRVRERLKELIEEAR

SEQ ID NO: 10549 - protein, 186 aa, Artificial Sequence; identical to SEQ ID NO: 10548
  Synthetic

SEQ ID NO: 10550 - protein, 186 aa, Artificial Sequence
  Synthetic
SEVEDLERRVKRILEESDELVKRHEEKSRKIVKDLEDLLRRNEDTVEKILRELEKRIRDGGDDKETLLRTVRERVKDLERHSKEVRDRVRELLERLDRDAKRVEEEDDRLVDELEKDLRRVLEEMGNSERVTRVVEKVRRLLEESKRRSKEVVKRSKDLLKEAEDRADESVRELRRKLKELEEKAE

SEQ ID NO: 10551 - protein, 186 aa, Artificial Sequence; identical to SEQ ID NO: 10550
  Synthetic

SEQ ID NO: 10552 - protein, 180 aa, Artificial Sequence
  Synthetic
SELEDIRRLLEKLDREVKELLKRSRDLAKEMEERVRKLVKESEDELRKLAEKVDRIKKNGGSEEMVEKLIREAEKLVEDSRKKSKDLIDELRELVRKSRRDSERLIKRARDLVREIAKRVTEDEAREVLKDVRRKVEELRKELTKVDKEIEEIVRELEKRLREVNERVRTIVDELAKRLK

SEQ ID NO: 10553 - protein, 180 aa, Artificial Sequence; identical to SEQ ID NO: 10552
  Synthetic

SEQ ID NO: 10554 - protein, 176 aa, Artificial Sequence
  Synthetic
SMLEELDKEARELLKEVRRLVEDNDRLLEELLRRARELLERNDRISEKVADEVRKIDDEKRVRELADESRKISREILEEVRRLVKELKDDSKRILDEVRKRVTDLDERVRRLLAERPTERMREVAKKVKDILKRAEEEVRESLERVRRELERVIRELEDSLRRNDKTLRDLIEERR

SEQ ID NO: 10555 - protein, 176 aa, Artificial Sequence; identical to SEQ ID NO: 10554
  Synthetic

SEQ ID NO: 10556 - protein, 176 aa, Artificial Sequence
  Synthetic
SDLERLDELLKRVLEKARKLVKENDEHSEEVRKTVEKVVRDNDKLAEDLADKVEKIRDEDTVRKLAEDLKRISEKLLREVEELVRRNDELSKKILDDVRKLVERLIREAEDLLRKKDEERVKEVLDRVDEILKRVIKAAEESLKRSHEINRRLIKAAEDSLRRVKKILDELEERVR

SEQ ID NO: 10557 - protein, 176 aa, Artificial Sequence; identical to SEQ ID NO: 10556
  Synthetic

SEQ ID NO: 10558 - protein, 176 aa, Artificial Sequence
  Synthetic
STLDKLRELLRRVEETVREVLERNDEHSKEVKRRVDKLLRENDEHSKELADLVRKIKDEDTVKKLVEENKRRSEELLKTVEELVRRNDELSKKLEEDVRRLVRELEERAKRALDRRPTREMEKVLTDARRSLRRLEERVRESLERSHRINRKLRKDVRESLERSKRILDKLREEVR

SEQ ID NO: 10559 - protein, 176 aa, Artificial Sequence; identical to SEQ ID NO: 10558
  Synthetic

SEQ ID NO: 10560 - protein, 176 aa, Artificial Sequence
  Synthetic
SVLEELRKLVEKVLREVDKLLKDNNRHSEEVEKTVKRLLDENDRLLEELADRVEKIKDEDTVRKLVKELDDRSKDILREVKKLLKENDDLSKRLLDEVKKLVDRLEERVRDALRKDDKEEAKKVLTEVRRTLEELERRVRKSLKDSHDINRKLEKEVRDSLKRVKDRLDELIKRVR

SEQ ID NO: 10561 - protein, 176 aa, Artificial Sequence; identical to SEQ ID NO: 10560
  Synthetic

SEQ ID NO: 10562 - protein, 177 aa, Artificial Sequence
  Synthetic
RKAEEVLKRAKKIVDEVDKKNRESLERTRKIVEDVNEENREVLDRLRRRAEELKKEVDDERVKRMLDEILKEVKKRIEEVVRRNEAVIEESRRLVEELSERNRELVKRLEEVVRREDSDDVVRRIEEVIEKARRENDESVRRDEKLMKEVKDENKKTVDDIRRLLKDIEDKVREAKR

SEQ ID NO: 10563 - protein, 177 aa, Artificial Sequence; identical to SEQ ID NO: 10562
  Synthetic

SEQ ID NO: 10564 - protein, 177 aa, Artificial Sequence
  Synthetic
SKLEEVVKRLEEIVRRVKRADEESLKRTRKIVEEVNRDNRRSLKESRDRVDELKKRVDDDDVVRRLDRLIEESEKLVRDVERDNKRIIEESEELVRRSAEMNRKTLEEVKDLVRKSDTDEVVKRIEEVAKRNEELNRETVKRDEDLVREAKRRNEETVERDKRLVEKITKEVDETKK

SEQ ID NO: 10565 - protein, 177 aa, Artificial Sequence; identical to SEQ ID NO: 10564
  Synthetic

SEQ ID NO: 10566 - protein, 176 aa, Artificial Sequence
  Synthetic
SLIETIRDLAKKLKEESDKSVETDKRLVEELRRRSKKTVDDIDELVKRLERMVEDDKRKEALKKKLEDLIRTIETILEKSRRDLKELIDRSRRLLEESRRLVEEVERRVRELLKDKDTEDAKRVLEELKRIIEDLLRKNKKSLDDTEREVRRLIKENETVVRKLEEIVKRLEEKIR

SEQ ID NO: 10567 - protein, 176 aa, Artificial Sequence; identical to SEQ ID NO: 10566
  Synthetic

SEQ ID NO: 10568 - protein, 176 aa, Artificial Sequence
  Synthetic
SLLEEIAELVERLRRESKESVKRDEELVDELKKRSEETVKEDKRLAEELDRLAKKIPDKDTLKEKADRVREESKRLVKESRDLLEEVRRRSEDLIRRSRKLVTDVIREVERLLAERPVEEMKKVLDDLRREIKKLEEENERSLERTRDIVRKLDRTNEESARESEKIIREVVKEVK

SEQ ID NO: 10569 - protein, 176 aa, Artificial Sequence; identical to SEQ ID NO: 10568
  Synthetic

SEQ ID NO: 10570 - protein, 176 aa, Artificial Sequence
  Synthetic
SLLERIKEEVEKLRKESEESVETDERLVEELKKEVKDLVEKDRKLAEDLKDEVDKDKRTEALDKRLKEVIRESEEILKRLREKLKELIRRSEKLLEDSRRLLDKLRREVEELLKERDEERAKEVLRDLRRTVKELTDENEKSLERTRREVEKLIRELEESLRESRRRVKRLLEKVK

SEQ ID NO: 10571 - protein, 176 aa, Artificial Sequence; identical to SEQ ID NO: 10570
  Synthetic

SEQ ID NO: 10572 - protein, 176 aa, Artificial Sequence
  Synthetic
SLLEEIERRVEELEDRSRKSVERDKELAKEVDDRNEESVRTDEELAKRLADLVRKRDRDEELRKKLEEVIRESERLLEELHRENERVIRESKRLIEESKRLLEKLDRDVARLLEERPTERMEEVLKRLKEIVKELEERNRESLERTRRILEEVDRKNEESLKRSREIVRELDERVR

SEQ ID NO: 10573 - protein, 176 aa, Artificial Sequence; identical to SEQ ID NO: 10572
  Synthetic

SEQ ID NO: 10574 - protein, 176 aa, Artificial Sequence
  Synthetic
SLVEEIERRVEKLAEEVKRLVERDRKEVEKLEKESRDTVREIEELADRLRDAVEKERDEDSLRKKLEELIRTIEEILKESRRLLEELIRTSTEILKRLKEKLEELIRRVEELLKRNPDDEMRKVLTRLREEVRRLLDELRRSLEDTKRTVEDLERKNKTVVDELRKTVAELERRAR

SEQ ID NO: 10575 - protein, 176 aa, Artificial Sequence; identical to SEQ ID NO: 10574
  Synthetic

SEQ ID NO: 10576 - protein, 188 aa, Artificial Sequence
  Synthetic
SIDEVLKRIREISDDAKRKIKEVVEEIKKNADRLRREIERVLDEIRKVIRELLERIKRVEAPEEKVREILRRVERILEEVEKEIDRIRKRVEELTKRHVDEAEKLVKHNEEVLRDVERRIKELKDRGGVDEDLERLLREVERRTRRHEEELERLLRHNNKVSKEVREELKRLLDRVREMLEDVDRKLK

SEQ ID NO: 10577 - protein, 188 aa, Artificial Sequence; identical to SEQ ID NO: 10576
  Synthetic

SEQ ID NO: 10578 - protein, 188 aa, Artificial Sequence
  Synthetic
SVEEVRKEVKRISDEAREEIERVLERIKENAKRLIEDIRRVLEEIEEIIRRLEDEIRRVELPEERVRELLERVRDILRRVAEEIEKIEEEVKELTKRHEDEIRRLLKENKDVLDEIEERADDLRKKGGVDEDLEELLRRLERISRESRKRLEELLKHNNKESEEVRKRLKELLDDVRRVVEEVRRKLK

SEQ ID NO: 10579 - protein, 188 aa, Artificial Sequence; identical to SEQ ID NO: 10578
  Synthetic

SEQ ID NO: 10580 - protein, 188 aa, Artificial Sequence
  Synthetic
SIDEVLEELKRISTEAVERIRRVAERNRKSVEEVRKRIEEVAKRIREIATRLLERIRRVELPEKDVERLLREVEEEVRRVEDTIERLLEENEEIMRDSVRKIEKLVEDNRRVLEELTRRIERLKDNGGIDEELKKLLDELEKISRDSDERLKESTKKVRDVNRESDKKLKELLKRVEDVLEKVDRELK

SEQ ID NO: 10581 - protein, 188 aa, Artificial Sequence; identical to SEQ ID NO: 10580
  Synthetic

SEQ ID NO: 10582 - protein, 188 aa, Artificial Sequence
  Synthetic
SVDEVLERIRESAETILEEIRRVLERNKRSAETILEEIRDVARKIEKRIRDVLKKIEDVELPEEKVRELLEELREILERVKKAIEDLLRRNEEVMRDSKRKIEKLLKDNKDIMERVTREIKRLKDEGGVDEELRKLLEEVKKINDDSRRKLEKSTRDVKKVNDDSRRELERLLRKVEEVIRRVDEELR

SEQ ID NO: 10583 - protein, 188 aa, Artificial Sequence; identical to SEQ ID NO: 10582
  Synthetic

SEQ ID NO: 10584 - protein, 184 aa, Artificial Sequence
  Synthetic
KLEELVEEVEKVVREVKKELEDVVRTVREVVKRSKDDLREVVKEVERINRELEERLRRLATDERVEKTIRELIKRSRDSLRRAKDEVKKNLDENERLLREVEKRVEKLMRELEELLRRVREVVERNRDLTELLERVKTLIKEIRDRLRRLLEEVKRLVEESKKDLKRLLDENKRLVDEATKTAK

SEQ ID NO: 10585 - protein, 184 aa, Artificial Sequence; identical to SEQ ID NO: 10584
  Synthetic

SEQ ID NO: 10586 - protein, 184 aa, Artificial Sequence
  Synthetic
SLEELLKEVEKVIRDVKRELEKVVRDIEENVRRSAKRLREAEEEVERINRRLEEELKKKTTREEIKELVRKLIEDSRRSLEKARRDIAENEKRNKESLDRAKRTVEKLLEDLERLLREVEKVARNNRDLTELLKRVRDLIRRIRETLEKLLKENHDLSKRSKEDVERLLKENADLVKELTDRAE

SEQ ID NO: 10587 - protein, 184 aa, Artificial Sequence; identical to SEQ ID NO: 10586
  Synthetic

SEQ ID NO: 10588 - protein, 184 aa, Artificial Sequence
  Synthetic
SLEDLLREVKRVIEEVKRELEEVVRRVKEIVERSVRDLRRVVDEVRRINTELEERLRRLTTEDRVRDKAEKLIRESEESLRRAEKRVRENIRENERLLEKVKRTVEKLLRDLEELLKRVKEVADRNRDLTELLRRVEELIKEIRKELKRLLDEVKDLVDKSKENAKKLLEDNKRLVEKIARDAT

SEQ ID NO: 10589 - protein, 184 aa, Artificial Sequence; identical to SEQ ID NO: 10588
  Synthetic

SEQ ID NO: 10590 - protein, 184 aa, Artificial Sequence
  Synthetic
KLEELVREVEKVVDDIRKELEEVVRRVEEVVRRSKRTLEDVVRRVKKINDDLEKELRERSKDEEVRRKVEELIRESKKSLDEVRRNAERNAEENRRLLREVEETVKRLLEELEKLLDKVRKVVANNRDLTELLEDVKRVLDEIRETLERLLRKVEELVERSKRNAEELLKRNEDLAKKVRDDAK

SEQ ID NO: 10591 - protein, 184 aa, Artificial Sequence; identical to SEQ ID NO: 10590
  Synthetic

SEQ ID NO: 10592 - protein, 178 aa, Artificial Sequence
  Synthetic
DVEDVLRKIEEIIRRVLEEIKTVLDEIRKNNEKLKEDVDRVLAEIEKDSEDLKRKIKDIEDLIRELDESTDRVRKLAKRIKEKSEKSLRDAERLVKRLEEELKRILEEVEDLVRKKKESGELAETILRRVEELVEEIRRRLKEILDRDHELSKRLKEELKKILDDNHKLSRDAAERAR

SEQ ID NO: 10593 - protein, 178 aa, Artificial Sequence; identical to SEQ ID NO: 10592
  Synthetic

SEQ ID NO: 10594 - protein, 178 aa, Artificial Sequence
  Synthetic
SVEDVLREIKETSDDAARKADEVLKEIEKNNRRLKKEIDRVHEHTKEDSRRLKEEIKDIEELIRELDKSTDKDRKLVEKAKRDSEESLRDVERLAREVKEKLKRSTDDVRRLVEEKKESGDLMREMLERNRKLIEDLKRELEDILRRDHRLSKELLARLKESNEENHRLSKEIRERRK

SEQ ID NO: 10595 - protein, 178 aa, Artificial Sequence; identical to SEQ ID NO: 10594
  Synthetic

SEQ ID NO: 10596 - protein, 178 aa, Artificial Sequence
  Synthetic
RVEDVLRKVEEIIRRLKEEIDRVLEKIRETSERAVKDIRDVLRRIREDSKRLKEDIKDAKDAIRTLDRSTEEVEKLVKEAEKELKRSSDEVEKLARDLKRKLKEILDRARRLVREKRESGEDAERIVEEVRKLVEEIRKELEDILRKNEKLIEDLKRELKKILEENHRLSREIRERRR

SEQ ID NO: 10597 - protein, 178 aa, Artificial Sequence; identical to SEQ ID NO: 10596
  Synthetic

SEQ ID NO: 10598 - protein, 178 aa, Artificial Sequence
  Synthetic
SAEDVLREITKTSERAREDIKRVLDEIKRTSDEAVKTVTDIHEHTRKTSEDLKRKIKDIRELIRRLEESTDKDRRLVEEVKRRLEDSSRRAEELARRAEKRLKESTEKVKDLVDKKKEAGEVLRKILEENRELIERLKKELKELLDRNRKLIEDLLREAEKSNEDNKELIKKAEEDAR

SEQ ID NO: 10599 - protein, 178 aa, Artificial Sequence; identical to SEQ ID NO: 10598
  Synthetic

SEQ ID NO: 10600 - protein, 177 aa, Artificial Sequence
  Synthetic
SVEKVLEDITRELRRADEESKRALDHSAEVLKDLERRVKEVLDESREIIKELERRLRELKEVKDVLRRLEEENKELVRDIRRLLEEAIKENTELSKRSRETLDKIEKDVKKIVDDGVSDEEAKRVLDEVEKLVRELKKRNDELNEKTERLVRDLRRRLKDSLDKSRDLVRRLEEKAK

SEQ ID NO: 10601 - protein, 177 aa, Artificial Sequence; identical to SEQ ID NO: 10600
  Synthetic

SEQ ID NO: 10602 - protein, 177 aa, Artificial Sequence
  Synthetic
SVEEVLDEVRRIIEELLRLSEEMLRHSEEVIRDLERVSREVLERSKRIIDELLRELKDLDEVRKTLEDLIRKNTELSKTSKKVLDDARRENKKLSDDSRRVLRKLEEDIRRLVEEGVSDEVAKRAVEDVRRVVEDLERRNRTLNEKTKRLVEKLTRDNERSLKESKKVVDELREEAR

SEQ ID NO: 10603 - protein, 177 aa, Artificial Sequence; identical to SEQ ID NO: 10602
  Synthetic

SEQ ID NO: 10604 - protein, 177 aa, Artificial Sequence
  Synthetic
SVEEVLDEIRKRIEDLKREVDEVLDRSRRIIETLKERVDRVLKHSRELIKRLKDKLRELEEVKKTLDEIIRKNEELVRDIRKELKRALDKNKELVKEIRRELKEIIEEVKKLVDKGARDEEMKRALEEVKKLLDRLREELKRSLDESRKLVEELERRLRESNEESERLIRKLEREAD

SEQ ID NO: 10605 - protein, 177 aa, Artificial Sequence; identical to SEQ ID NO: 10604
  Synthetic

SEQ ID NO: 10606 - protein, 177 aa, Artificial Sequence
  Synthetic
SVEDVLREVEKIIRELDRKSEKVLEDSKRVIEDLKRKVEEVLRHSETLIRDLERRLKELEEVKRVLDKLRRDNERLVEDVKRELDEIIRKNKELSERSKRELERLRKAIEDLVRAGASDELAKEMVDRVRELVKKLEEENRRSLEESKKLVEELARRLERSNTESKRLIDKLREEAR

SEQ ID NO: 10607 - protein, 177 aa, Artificial Sequence; identical to SEQ ID NO: 10606
  Synthetic

SEQ ID NO: 10608 - protein, 177 aa, Artificial Sequence
  Synthetic
SVEEVLKDIEKKIRDLDRKVKEALRHSEEVIRRLEEEVKRVLDDSERILRDLKEKLRDLEDVKRELDRLLEENKRLVDDIRRVLEELERRNRELVDRIREVLKRIIEEVEKLVRDGASEELMRRIVEKVEELVKELDKRLRESNEDSKRLVEDLSRRAKKSLEESRELVRELKKRAK

SEQ ID NO: 10609 - protein, 177 aa, Artificial Sequence; identical to SEQ ID NO: 10608
  Synthetic

SEQ ID NO: 10610 - protein, 177 aa, Artificial Sequence
  Synthetic
SVEEVLDRIRKIIKELLDRSEEALRHSEEVIKDLERKVEEVLERSREVIRELLERLKELREVKKVLEELLRRNKELVDRIRKDLKKAIDENKKLSDESRRVLEEVRKKAKKLVDDGVDDEELKTMLEEVKKVVEELLRRNRKSNEDSKELVKELTRRLRKSLEDSKELVRKLEEEAR

SEQ ID NO: 10611 - protein, 177 aa, Artificial Sequence; identical to SEQ ID NO: 10610
  Synthetic

SEQ ID NO: 10612 - protein, 177 aa, Artificial Sequence
  Synthetic
SVEDVLREIEEILRRLEKESDDALEHSRRVIKRLEEESDRVLEESRRVIEELERKLRDLEEVKRELEKLIRKNEKLSKDSKDVLKKLIEENRRLSETSKEVLRELRKRVEDLVRAGADDEEMKKLLEDVKRLVDDLRRKNEESNRRSKELVDKLDKENKDSLKESRELVEKLEREAR

SEQ ID NO: 10613 - protein, 177 aa, Artificial Sequence; identical to SEQ ID NO: 10612
  Synthetic

SEQ ID NO: 10614 - protein, 180 aa, Artificial Sequence
  Synthetic
SVEEVVREVEEKLRKLIDDVRRVVEENRRNTERLRKRVTEVVKRNEDILRRLEEDIRRVERAEEAKEVLKRLKEETDRLLERVEEVVRRTKKKTEDLLRDVERLLREIKKELEDLLRNNVSEEVAKTALRKVEDLLKKLKERAEDSSRDNHRISKELTEELEESSKRVKTLVDELRKTVK

SEQ ID NO: 10615 - protein, 180 aa, Artificial Sequence; identical to SEQ ID NO: 10614
  Synthetic

SEQ ID NO: 10616 - protein, 178 aa, Artificial Sequence
  Synthetic
SVEEVLKESREISTRLAEEVKRVLDEIRRILERVKRINEKVNKDIEEILRRVKKTVGEKKRELVKKLEDEVRKILETNKRLSEELEERVRRLLEELERLLRKVVKENEDTVRDLARIEDERVAEKILKEDRDTVERLRKRVEDLLRDVRRLVEDSERKSRDLLRRVEELVRELKKRVD

SEQ ID NO: 10617 - protein, 178 aa, Artificial Sequence; identical to SEQ ID NO: 10616
  Synthetic

SEQ ID NO: 10618 - protein, 178 aa, Artificial Sequence
  Synthetic
SVEEVLKESKRVSEELNELNKKVNDDIRKILEKVNRENKKVNEDIERELRKLEEEVGRKKEELLREVVKEVRRLLKENERLSEKLRKEVEELLKRNEELSKRVVDDNKRTVDEARRIDDEEVAREILRDDKRTVEESKRESKRLLERVKKLVDRSAEESKKLLEDVKRLLEELRERAR

SEQ ID NO: 10619 - protein, 178 aa, Artificial Sequence; identical to SEQ ID NO: 10618
  Synthetic

SEQ ID NO: 10620 - protein, 178 aa, Artificial Sequence
  Synthetic
RVDEVLDESKKVSDRLHESIRRVLEKIEEILRRVNEENRRVNEEMKRILDELARTVGEKIREELEKVKKRAEDLVKTNEELSEDLKRRVRKLLKELEDLLRKVNEENKESLDRLKRIEDERVAREILKADRETVRRLEKRAKDLLDEVRDLVRESEKRSRELLKEVEDLVRKLTEEAR

SEQ ID NO: 10621 - protein, 178 aa, Artificial Sequence; identical to SEQ ID NO: 10620
  Synthetic

SEQ ID NO: 10622 - protein, 178 aa, Artificial Sequence
  Synthetic
RVEEVLKRMRDILRRVNEINRRVNRELERSSREILERIREILDRIRRILERLEERVGDKKKEEVDRVKDEARKLLRDLEETLKRDHDRDRKMLKENEDLSREVEKRVEELVRDLARIEDEKVARDLLREVEELVKESEELSEELLRRSRRSNEESLRKAEKLLETVRRLVEELEKKTT

SEQ ID NO: 10623 - protein, 178 aa, Artificial Sequence; identical to SEQ ID NO: 10622
  Synthetic

SEQ ID NO: 10624 - protein, 182 aa, Artificial Sequence
  Synthetic
SEAEAVEEEVRRLVEESEKRSKELLEDVERLVEESERRSKKLLDDVRKLVDDLKKELRRVRDRETMKKLLKELEDRVRRIIERLAELSKEVEDRVREIIKTNEEISDRLRKKVDELLEELKRRGVDDRVIERLKRILKEAHDKNKEVSDRIRKILEELHRKNRKVLEDIKRILDDVRREVER

SEQ ID NO: 10625 - protein, 182 aa, Artificial Sequence; identical to SEQ ID NO: 10624
  Synthetic

SEQ ID NO: 10626 - protein, 182 aa, Artificial Sequence
  Synthetic
KEAEDLLREVEKLVRESKKLSEDLLREVRKSNERSKRESERLLREVERLVRELKDLRDKVRDRRTLEKLLEDLERTAREIIKEIEKISRDDKKDVERIIRENERISEELEKRVREILEKIKRDGLDDRIIERIKRILEKVHKINREASKRIKESLDRAHETNKRVLDRIRKIVDDVRREVER

SEQ ID NO: 10627 - protein, 182 aa, Artificial Sequence; identical to SEQ ID NO: 10626
  Synthetic

SEQ ID NO: 10628 - protein, 173 aa, Artificial Sequence
  Synthetic
RLEEVKEELKRIATKLKEEIKENIRRLEESVEKIAKELAENIKRLEDILRDVKRKLRDERIVKTVEDIARRVVEDNERIMEEDKDVVRRLVERNEEIVRRVDETVKKIVELIDRGEPGEELVERLRRVVEEVRERLKDSSRELRKINEDSRKKVEDSSREVKKVVEELERRDT

SEQ ID NO: 10629 - protein, 173 aa, Artificial Sequence; identical to SEQ ID NO: 10628
  Synthetic

SEQ ID NO: 10630 - protein, 174 aa, Artificial Sequence
  Synthetic
KELEDVARKVEDLLRRIEKTNRDAIRESERLVRELKREVEKVEEESRRLLEEVERRIRDEDVIRRLREISERSKRELKKLLETITRISDKSVKDNEKLLRDTREVVRRVDEVLKNNGDAKKLLDEVRKVIEDNRKRSEELLEENRKVVEDVSRTLERILRENERVADEVDKEER

SEQ ID NO: 10631 - protein, 174 aa, Artificial Sequence; identical to SEQ ID NO: 10630
  Synthetic

SEQ ID NO: 10632 - protein, 174 aa, Artificial Sequence
  Synthetic
DELERVTEEIDKLSKDLERRVREVLEESRRLVEDVERVVREVLEEARRTAKDIADKVKNERILDEVREMTKRHEEELRRLLEELKRISEESKEELKRLLKENREAVEKVRRELENKGDVDKLLEEVRKISEDSKERLKEILKRNEEVARRVKRELKRLLETNREIIRRVEERER

SEQ ID NO: 10633 - protein, 174 aa, Artificial Sequence; identical to SEQ ID NO: 10632
  Synthetic

SEQ ID NO: 10634 - protein, 178 aa, Artificial Sequence
  Synthetic
RELEELLDKVRKIVEESKKRNEDLLREVREIVERSKEKIKKVLDEVRKIIETVRKSRLSDEKVRRLLEELRRKVEKLLDDDRKLAKELRDRLRELKKTNEDLARRLREELERILRDKPDVKEVEKVLRDVEELIRDSERASDRVLKDVEELIKDSERMSKKAEEDVDRLLRELDKDVR

SEQ ID NO: 10635 - protein, 178 aa, Artificial Sequence; identical to SEQ ID NO: 10634
  Synthetic

SEQ ID NO: 10636 - protein, 183 aa, Artificial Sequence
  Synthetic
DSVERVAEEVRKLLEDIKRVSDEVTKRLRDLLEDLKRVSDKVRKDIERLLEDLEREVRRKGGEELKKKVDKVTRELEELLRRNEEKVKEVERRVRDLLRRNNEKVKRAVKELRDLLESLRRIEEDRVLEEALRRVEELARRIKEHSKRVLETVRRLVEEIKKHSRKVLEEVRERIKRIKDELR

SEQ ID NO: 10637 - protein, 183 aa, Artificial Sequence; identical to SEQ ID NO: 10636
  Synthetic

SEQ ID NO: 10638 - protein, 183 aa, Artificial Sequence
  Synthetic
SEVEKAEKDVRDLLKDLRRVSEKVKRAVEDLLRDLKRTSDKASEDAKRLLDDLRRKVEERGGDRLRDEVREAEKEVEKLLRENNTEVDKVRKELEDELRRNEEMVRTVERRLRELLERIKRIEEDRVVKEILDEVEKLIREIKKHSEDLLRKVRKDIKRVKDHTKRVLDRIRKLIEDIKRRLE

SEQ ID NO: 10639 - protein, 183 aa, Artificial Sequence; identical to SEQ ID NO: 10638
  Synthetic

SEQ ID NO: 10640 - protein, 181 aa, Artificial Sequence
  Synthetic
DEVKELLDRVREEIRRDKERVKKLLEDSKRLNERDKREVKRLLEEVRELIKRLEDIIRKSDKDDELEKIVREIERRLRRVIEESEEHVKRTVDTDRKLLEDSKRHAEESARRLKEVLEDAKRKGLEEEVVKDLERLLRDLERVNDEVEKRLRDLTEDSKRFNDEVAREIEKLLEDVARTVK

SEQ ID NO: 10641 - protein, 181 aa, Artificial Sequence; identical to SEQ ID NO: 10640
  Synthetic

SEQ ID NO: 10642 - protein, 181 aa, Artificial Sequence
  Synthetic
REAEELLKRVEDLIRRLKDMIRKLLEDSKRLNERDVETVKRLLEDVERTIREIKDEVRRDKDKDRLRDLVRRVEERLRELLERSKDHVRRTAETDRELLDRLRRLVEKVERELRDMLRELEERGADERIVREVEKLLEKIKRDVDRVRRELERLTEESKRINDKAVRDIEELLEDLKRAVK

SEQ ID NO: 10643 - protein, 181 aa, Artificial Sequence; identical to SEQ ID NO: 10642
  Synthetic

SEQ ID NO: 10644 - protein, 185 aa, Artificial Sequence
  Synthetic
DELERLLEDVERVSRETKKLLKKLLDDAKRVIDKNREDSRRSLEEVERVIREAKELLKDGQEKEKLLRDVERIVKEVIEKNREVVDRVRDIVREIVERIERLVRKNKEDVDRVRREAEKRSRTKDTERRVRDVVKKIRELSEDVEREAKKVIDRLKELLEDIERENRRVEEEIKKLLEDVERTAR

SEQ ID NO: 10645 - protein, 185 aa, Artificial Sequence; identical to SEQ ID NO: 10644
  Synthetic

SEQ ID NO: 10646 - protein, 182 aa, Artificial Sequence
  Synthetic
KLVERLVKEAEDLTEEHKERLDRLLKENEKISRESKKRLKEILEENERVVEEVKKLLRDGQPKEELVKTVRKISEDSKRRLEELVRRNRKVSKESKERLDEILKTNEDMVREVEERLKREVDDRKKVDEVRRRLEELHKELEKVVRDVKRTSEKLVRDSEDMARKVVKTSEDLLRELEEEAR

SEQ ID NO: 10647 - protein, 182 aa, Artificial Sequence; identical to SEQ ID NO: 10646
  Synthetic

SEQ ID NO: 10648 - protein, 182 aa, Artificial Sequence
  Synthetic
SRAEDLVRRVEEMTRKHKKDLDDLLRENEEVSRRSKERIRKLLKDIKDVVDDVERVLRAGDDKKRLVEEAEKVARDVERDLRRLVKENRDISRTSKERLDDILRTNREVIERVDDALRREVSDRDKVEEVRERLKKLHTELEKRVREVKRDSERLVEDSERTVEELLRRVRKLLKEVRDSVK

SEQ ID NO: 10649 - protein, 182 aa, Artificial Sequence; identical to SEQ ID NO: 10648
  Synthetic

SEQ ID NO: 10650 - protein, 182 aa, Artificial Sequence
  Synthetic
SEAERLVEEAERVTREHKKRLDDLLKEVRRVSEDSKRKLEKILKENEDVVEEVKELLKAGDDKDKLLEKVRKISEDSRRRLEKLVEENKEMADRVRKALDDILDTNRRVVEEVKRRLEREVSDKEKVDRVRRELDRLHKELAEVVERVKRAVDKLLRDSEEEVKRVEERSERLLKEVADALR

SEQ ID NO: 10651 - protein, 182 aa, Artificial Sequence; identical to SEQ ID NO: 10650
  Synthetic

SEQ ID NO: 10652 - protein, 182 aa, Artificial Sequence
  Synthetic
SDVDKLVDDVRRETEKHKKTARDLLDELRKVSEESRRRLKRLLEEITEVVERIKRVLEAGRDKDELLERIEKVVREVREKLKELVKRNEDVVREVKRRLEELLRTNKKIVDEVKRMLDERVSDEEEVRRAKEELDRLHKEVEDVVRDVTRELDRLLKRSREVVERVREEADRLLEEVERTLK

SEQ ID NO: 10653 - protein, 182 aa, Artificial Sequence; identical to SEQ ID NO: 10652
  Synthetic

SEQ ID NO: 10654 - protein, 182 aa, Artificial Sequence
  Synthetic
SEVDELVERAERISRESKKTIKKILEDNERVSKRHKDELKKLLDELKRVVDEVRKVLERGTPKEELVKEVEEVVRRVKETLKRLLDTNHKISKESKERLRKLVEDNKRVVETVKKLLEDRVSDKEKVERALRELDRLLEESKRVVDEAEKTSDKLNKEVEEMARRVEEEVDRLLKEVRDDAK

SEQ ID NO: 10655 - protein, 182 aa, Artificial Sequence; identical to SEQ ID NO: 10654
  Synthetic

SEQ ID NO: 10656 - protein, 182 aa, Artificial Sequence
  Synthetic
SEADELVKEIEDVSRRSKEELTRLLEEAEKVSREHKKTLEELLRRIEKVVRDIKEVLRGGTPREELLKTIRKLVEDVRRELERLLRTNHEVVRRVEDRLRKLVEDNERVARKVKDELRRRVSDEKKVREVEKLLDKLLEESRKRAKEVLRALRELNREVAEVVRRVEERLRRLLKEVEEAVR

SEQ ID NO: 10657 - protein, 182 aa, Artificial Sequence; identical to SEQ ID NO: 10656
  Synthetic

SEQ ID NO: 10658 - protein, 182 aa, Artificial Sequence
  Synthetic
SDVDKIVEEIERISRDSERRIREIVERNKKVSEDHKRELERLLKEMEKVVEDVKKVLKDGDDKKKLKDEARRVVERVKDDLRKLLETNHEISKRSREELRKLVEDNERVVRKAEKDLKDRVSDKKKVDEARKKLRDLLERSKEVVKEAERRLEKSNRDVRREAERVRKALDDLLKEVDEAVR

SEQ ID NO: 10659 - protein, 182 aa, Artificial Sequence; identical to SEQ ID NO: 10658
  Synthetic

SEQ ID NO: 10660 - protein, 182 aa, Artificial Sequence
  Synthetic
SRADELVERAKRMTDEHKKTAEDILRENKRVSDEHKKTLEKILRENEKIVDEVAKLLEEGRDKEELVRRVEKVSRDSKRRLKELLETNHRISEESERRLRELLRTNREVVEEVRKRLKDEVSDKDKVREVEEELKRLHKEVEDVVDTVRRTSEKLNDEVRKVVETVTRRSEELLEELRRRAK

SEQ ID NO: 10661 - protein, 182 aa, Artificial Sequence; identical to SEQ ID NO: 10660
  Synthetic

SEQ ID NO: 10662 - protein, 182 aa, Artificial Sequence
  Synthetic
KEVEKLVTEIREMTERHKRTLEELLKEAEEVSRRHKEDLKRLLDENRKIVEEVARVLEKGEPKEELEKRVREVSKRSEETLRTLLETNHRVVKRVEDELKRLLETNRRMVETVKDLLRKTVSDKDKVERVLREADRLHEEVRKVVEKVREELRRLNEEVRKVVEEVRRDSERLVREVEERAR

SEQ ID NO: 10663 - protein, 182 aa, Artificial Sequence; identical to SEQ ID NO: 10662
  Synthetic

SEQ ID NO: 10664 - protein, 182 aa, Artificial Sequence
  Synthetic
SRVDELVDRARKMTEKHKEELKRIVEENRRVSKEHKERLEDILRRNAEIVERVKEVLKRGTPREKLVKDVREVSRDSKRRLDDLLRTNHKISEESKRRLRELLRTNEEFVRTVEDLLRREVSDEDKVRRALEELKKLHDELAKEAKRVEELLDKSNEEVEKVVRDVREASERLLEELERTAK

SEQ ID NO: 10665 - protein, 182 aa, Artificial Sequence; identical to SEQ ID NO: 10664
  Synthetic

SEQ ID NO: 10666 - protein, 182 aa, Artificial Sequence
  Synthetic
DEVKKLVDDARRLTEKHKTDLERLLDEARKVSEEHKKRLEELLREIAEVAKEILKVLRKGEDRERLVKEIEKVVRDVKRKLDELLKTNHDVVRRVEDELRRLLKTNKEVVDTVRDELERRVDDREKVKRVEETLERLHKEVEEVVRRVKKALRDLNDEVRRVVDEVRRRLEELLKRVEEEAR

SEQ ID NO: 10667 - protein, 182 aa, Artificial Sequence; identical to SEQ ID NO: 10666
  Synthetic

SEQ ID NO: 10668 - protein, 187 aa, Artificial Sequence
  Synthetic
REVDEVEERVTRLLKKVRDVAEESRRRSEELLKKSRDVVEEVKKEVDKLLEEVRDMVRRVKDKGVEEKLRKLIRDAEKILKELRKRLEENIRENEELLRRNEERLERLIRELEDLLTKLRKMLKDNAEGRVLKKLVEEVKKLADEIERELERTSKEIEELSRRSEEDLRRLVRKLREVVRKIEEDLR

SEQ ID NO: 10669 - protein, 187 aa, Artificial Sequence; identical to SEQ ID NO: 10668
  Synthetic

SEQ ID NO: 10670 - protein, 187 aa, Artificial Sequence
  Synthetic
REVERVERELERLLEEVREVAERSERESKKLLEDTRRVVRKVKEDVRRLLEEVRDVVRKVKDKGVEEELRKLIKELEDLLRRLDETLEKNIRDNERVLEDNRRILEELIRELEEMLRRLKKSLEDNAEGDVIRRMVEEVEKLARRIKETLERTVRRLEELVRRSEKNLRTLVEEVRKAVERIKETLR

SEQ ID NO: 10671 - protein, 187 aa, Artificial Sequence; identical to SEQ ID NO: 10670
  Synthetic

SEQ ID NO: 10672 - protein, 187 aa, Artificial Sequence
  Synthetic
SEAERVEEDVRRLLKRVEEVIKRSEERSRELLKKTEDVVREVRKRVKKLLDEVKDTLDKVRDKGVEEEARRLIEELKEILERLERNLRKHIKDNRTLLRKNKEDVTRLKEELEKIVEDLKRLLDDNVGGEVLDRLVEELRKLVEEIERDLERTVREIEKLVKDSDRNLEDMVRELRRVAERIKEELR

SEQ ID NO: 10673 - protein, 187 aa, Artificial Sequence; identical to SEQ ID NO: 10672
  Synthetic

SEQ ID NO: 10674 - protein, 187 aa, Artificial Sequence
  Synthetic
REVDEVRRRAEELLKEVRDVVTESEKESRRLLEDTRRVVEDVKRRVDRLLEEVRDLLREVSEKKVEEEARKLIRELERIVEDLERKLDRDIRENERLLEENKRRLEKLIRELEEILRDLDRKLRDNAEGDVLRELVKRLEDVAREIKKRLEDTLRKLEEVSRRSKENLRELVERLRRIADEIRERLR

SEQ ID NO: 10675 - protein, 187 aa, Artificial Sequence; identical to SEQ ID NO: 10674
  Synthetic

SEQ ID NO: 10676 - protein, 186 aa, Artificial Sequence
  Synthetic
DEVDRVREEIERLLREVEEVLERSERESRRLLREVEEMLERSDEEVRRLLKEVEEVLRDELTDEDLMRKIRETLKKILEDNEELVRRIKRRAEEALERDREVVEEIRKRAEKVLEEVERLLRDKKESGEVLEEILRRAKEEVEKLKRELERTVERLAELVEELKRELERSTREVRKTVEELKRRIK

SEQ ID NO: 10677 - protein, 186 aa, Artificial Sequence; identical to SEQ ID NO: 10676
  Synthetic

SEQ ID NO: 10678 - protein, 186 aa, Artificial Sequence
  Synthetic
DEAEDLERRARELLEEVERVLEESIRRSEETVKEVEDMLRRSTEEVERLLKRVEDVLREELSDEKRLEEIKRKMEEILKRNRELVEEIRKELEESLRRNRELVERAKRTLERIVRKVEKVIREKKDDGELLKRLIDEVRRLAEKIKEELKESSKRDEEKVEKLKKELKDSTDAVRELVERLEREIK

SEQ ID NO: 10679 - protein, 186 aa, Artificial Sequence; identical to SEQ ID NO: 10678
  Synthetic

SEQ ID NO: 10680 - protein, 174 aa, Artificial Sequence
  Synthetic
DEVEELVKEVEERIKKVHKENEDVLRESEELMKRLHEENERLLREVEELVRRIRELRKRGDLREEDVKRVLKRIEELVERARRENKKASDRNRDLIRRVKKTNDDVLREIEELVKEIDVREARERIRRLLTESRKSVEEVEKRLRELSKRSEESVERVERTARRLLKELEDMTR

SEQ ID NO: 10681 - protein, 174 aa, Artificial Sequence; identical to SEQ ID NO: 10680
  Synthetic

SEQ ID NO: 10682 - protein, 174 aa, Artificial Sequence
  Synthetic
EEVKRLVEKVRKLIEDSKRRNRDVLRRVEELVRRVHRRNEEVLRRVEKLVEDIKELLRRGDLREEEVEKIKRRLRELAREVEEENRRVAEDIRRLLDEVRRENERVLREIRELLKEIPVEEAEREIERLLEESKRSVEEVEERIRRLIRESEESVREVKERIDELLKDADRATK

SEQ ID NO: 10683 - protein, 174 aa, Artificial Sequence; identical to SEQ ID NO: 10682
  Synthetic

SEQ ID NO: 10684 - protein, 174 aa, Artificial Sequence
  Synthetic
REVEELVKDVERLMREVHRRNEKVVEEVEALIRKSKEDNERVAREVERLVREVEKMLRRGDIREEDIKRVLKEIEDLLEEVERRNRRVLEEIERLLREVTEDNREVVRKLERLAEEIPDREAKERIKDLVRKSRDSVREVRERIRRLLEDSKRSVDDLARRIRELLRKAAEKAR

SEQ ID NO: 10685 - protein, 174 aa, Artificial Sequence; identical to SEQ ID NO: 10684
  Synthetic

SEQ ID NO: 10686 - protein, 174 aa, Artificial Sequence
  Synthetic
DEAEELVDRVRKLAEDVHKKNEDVLRESDALVKDSDRRNREALRRVEKLVEDVEELLRRGEIREEEIDKVLKEIARLLDELRKENKDLSRRNEELIERVERENRRVLTEIDKLVKEIPVEEVKRRIKELLKRVEESVRTVEEELRRLSKESEESVKRVEDRIRELLKRLRDAAR

SEQ ID NO: 10687 - protein, 174 aa, Artificial Sequence; identical to SEQ ID NO: 10686
  Synthetic

SEQ ID NO: 10688 - protein, 174 aa, Artificial Sequence
  Synthetic
DEAEDLVRKVRKLIEESKKENEDLLREVRELVARVHEENERVLREVEKLVEDIRRLLRRGDLRREDVRRVEEEIKELLKEVRRINKEVLEEVKRLVDEVKRRNEDVLRKIEDLVRRIPVREVKKAIEDLLKESEDSVREVEEEIRKLLKDLEKSVRDVERAIEKLLDELRKDTK

SEQ ID NO: 10689 - protein, 174 aa, Artificial Sequence; identical to SEQ ID NO: 10688
  Synthetic

SEQ ID NO: 10690 - protein, 174 aa, Artificial Sequence
  Synthetic
REVEELVREAEELVRRVHKRNEDALRRSKKLVEDVHRKNEEVLKRVERLVERIEELLRRGDLREEDVERVLREIKKLIEEVEEDNERVSRENKELVDRIREENERVAKRLEDLVREIPDKEAAERIKRLIDEVRKSVEEVERRAEELSRELRRSVKEVRDALKRLLDDLRRATT

SEQ ID NO: 10691 - protein, 174 aa, Artificial Sequence; identical to SEQ ID NO: 10690
  Synthetic

SEQ ID NO: 10692 - protein, 174 aa, Artificial Sequence
  Synthetic
REVEELVKEVRRRVREVHERNRRVLEDSERLVREVHKRNEEALRRSEELIKRVEDMRRRGDLREKDIERISETNEKLVKEIKDENEEVSRRNEKLVDEVRRRNEEVLKELEKLLRDIPDERAEREIRRLLEEVKKSVEDLTRKARKLSRDLERSVREVEERARDLSRRLREKTR

SEQ ID NO: 10693 - protein, 174 aa, Artificial Sequence; identical to SEQ ID NO: 10692
  Synthetic

SEQ ID NO: 10694 - protein, 174 aa, Artificial Sequence
  Synthetic
SEVEKLVKDVEDLAREVHKRNKELVDEVRDRVRRVEERNKRVVDEVREEVKKLIDLLRRGDLREKDIRRMLERAKELIDRVKEDNDRVARTLEDLVRKVKEENEKVLTDIERLVEEIPDEEAKDRIRELLKRVEESVEKVKRDIERLIERSKESVRRLEERIKELLRELEEAAR

SEQ ID NO: 10695 - protein, 174 aa, Artificial Sequence; identical to SEQ ID NO: 10694
  Synthetic

SEQ ID NO: 10696 - protein, 174 aa, Artificial Sequence
  Synthetic
SEVEDLVRKVKKLMEDSDRENKRLVDEVRERVEEVKKRNKEVVDEVRERVKRLEEMLRRGDLREEDIKRVEKEIEDLVKEVKDTNKRVADELRKLVEEVKKRNRDVAERIKELVKEIPDKDAAEAIKDLIRKSEKSVDEVRREIERLIKESEDSVKRVTDEIRKLLKRLRDTTT

SEQ ID NO: 10697 - protein, 174 aa, Artificial Sequence; identical to SEQ ID NO: 10696
  Synthetic

SEQ ID NO: 10698 - protein, 181 aa, Artificial Sequence
  Synthetic
SELEEILKTVKKLVDDHKRLSEEILRRVRKLVEEHKRKSEEILKRVTDLAEDVKDKIRKDRSKEDLERIVREARERVRRMLEEDRENLERIVRTIEKVLRDDKEHLKDVERRIRKLLEDARRRGLPREVEKELDRLLKELERVSRESEKELRRLLKELEEASRESEERLRRLLRDVEEALK

SEQ ID NO: 10699 - protein, 181 aa, Artificial Sequence; identical to SEQ ID NO: 10698
  Synthetic

SEQ ID NO: 10700 - protein, 175 aa, Artificial Sequence
  Synthetic
DEIETVKEELKKLLERLEESSRKVERDLEDLLRRSEESTREVEKRLKELLEDVRRKLREKKELVREVEEEVRKLLEESRRSLEENRRLIEKLAKESRDSLREVEKRVRELLKKLDDGADVKEVLDRVRELARTHHELNRELLREAEESSREHHRLNEELVDRVRKLVKEVEDRAR

SEQ ID NO: 10701 - protein, 175 aa, Artificial Sequence; identical to SEQ ID NO: 10700
  Synthetic

SEQ ID NO: 10702 - protein, 175 aa, Artificial Sequence
  Synthetic
SEIERVKKALRKLLEDSRKSSEDLARELKRLLEESRKSTEKVERDLTDLLREIEEKLRDAKETVEEAKREVDRLLEESRKSLRDNERLVERLIRESERSLRENEDEVRRLEELLDRGKDLDTILERVERSSREHHKLNERLLETLRRSSEEHHKRNEELVRRVERLLEEVERRRK

SEQ ID NO: 10703 - protein, 175 aa, Artificial Sequence; identical to SEQ ID NO: 10702
  Synthetic

SEQ ID NO: 10704 - protein, 175 aa, Artificial Sequence
  Synthetic
SKIERVKEEIRRLLDTLKKSSETVIREIEKILKESRESSKKVEDDLRRLVREVEKKVREKKELVEKLKRVVDKLAEESRRSLEDNERRLTELIRDSERSLEEVKRRAEEVEKLLEDGKDVDKVLRDLEDLVRRHHERNKELLDRVRKSSEEHNRTNEELLKEVERLARKVIKDTT

SEQ ID NO: 10705 - protein, 175 aa, Artificial Sequence; identical to SEQ ID NO: 10704
  Synthetic

SEQ ID NO: 10706 - protein, 175 aa, Artificial Sequence
  Synthetic
DEIEEVKRRARELLREATESSKEVAKALDELLERDRDSSRRVKEDLKRLLEEVRRKLRKDKKTVEEVERRVKKLADESDKISEENERRVDKLKKESEESLRRLRDKVRKLEKKLEDGKDLEKVLRDVEKLMREHHELNRELLKRVEDSSRTSHELNKRLVDTVRKLVTDAAEKAK

SEQ ID NO: 10707 - protein, 175 aa, Artificial Sequence; identical to SEQ ID NO: 10706
  Synthetic

SEQ ID NO: 10708 - protein, 175 aa, Artificial Sequence
  Synthetic
SEIEEVDERIKALLKRSTESSKRVEDEARRLMKEDKDSSKEVEDRLRDLLRKVREKLRDSKETVEEVERRVTELAERSRRISRENAERLKDLLRKSKESLERNRRDAERVRKLLRDGMDLKKVLDDLKRSSEEHHRLNEELLKRAEDSSRTSHRLNRKLVEEVRRLVEKVLEEVR

SEQ ID NO: 10709 - protein, 175 aa, Artificial Sequence; identical to SEQ ID NO: 10708
  Synthetic

SEQ ID NO: 10710 - protein, 175 aa, Artificial Sequence
  Synthetic
DEIEEVKKTLKKLVEELEESTRRVEEELKKLLKESEDSTRRVEDELRRLLEEVERKLRDDKKTVRDVEEKVRRLAEESRESLRRNREEVKRLLEESRKSLEDVKRTIERILKLLDDGKDLDEVLKDVERLVKEHEDLNKELLKKVEKSSRDHHELNKELVRRVEELVREAIKKTT

SEQ ID NO: 10711 - protein, 175 aa, Artificial Sequence; identical to SEQ ID NO: 10710
  Synthetic

SEQ ID NO: 10712 - protein, 175 aa, Artificial Sequence
  Synthetic
DEVEKVKEEIRRLLKRLEDSTRDVERRLEELLRESTESSKEVEERLKRLLDEVRKKLKDKKDDVRRVEEEVRKLAERSRESLERNRRRVEKLMKESRDSLREVEKRAKEVEKLLDDGKDVKKVLEELRELVRKHEELNRKLLEEVRESSERHKKLNKELVDEVKRLAEKITEEAR

SEQ ID NO: 10713 - protein, 175 aa, Artificial Sequence; identical to SEQ ID NO: 10712
  Synthetic

SEQ ID NO: 10714 - protein, 175 aa, Artificial Sequence
  Synthetic
KEIEDVKRALEKLLEDDKRSTEELKDRLARLLEDSKRSSDKVIEDLDRLLKEVRDKLREREESVKEVEDRVRKLAEESRDSLRKNEDLVRKLLEESKKISDDNRKKVKRALELLERGADLDEILKRVEDSSRESHKKNEELLRRVRRSSEEHKRLNEELLREVEELVKEIVKEAK

SEQ ID NO: 10715 - protein, 175 aa, Artificial Sequence; identical to SEQ ID NO: 10714
  Synthetic

SEQ ID NO: 10716 - protein, 175 aa, Artificial Sequence
  Synthetic
SKIEEVKKALRRLLEDLKRSTDRVKEEAKKLLDESRKSSEEVKRELERLLEEVTRKLRDKKEVVKEVRERVKRLMEESERSLRENEETVKRLLEESEKSLRRVEEEVRRLEKKLEDGADADKMLRDIERLVEEHKRLNEKLLREVRESSKRHNEKNEELVKTVKKLVEDAEERAK

SEQ ID NO: 10717 - protein, 175 aa, Artificial Sequence; identical to SEQ ID NO: 10716
  Synthetic

SEQ ID NO: 10718 - protein, 175 aa, Artificial Sequence
  Synthetic
SEIETVKKELERLLDESRRSTETVEREVEDILRKSTESSEEVKDRLDKLLKEVRDKLRELKETVKKVEDEVRKLAEESKDSLRKNRETAKELLRRSRESLDKNRRDVEKAKKLLEDGKDLREVLERVRKSSEDHKELNKELLERLRRSSKEHNDKNKRLVDEVRRLVEEVIRRAT

SEQ ID NO: 10719 - protein, 175 aa, Artificial Sequence; identical to SEQ ID NO: 10718
  Synthetic

SEQ ID NO: 10720 - protein, 175 aa, Artificial Sequence
  Synthetic
REIEEVKERLKKLLKDVTDSTDKVRKDLEKLLEDDRRSSRKVEEDLRRLLKDVRDKLREEKELVKRVEEDVRRLLEESKDISRENEKTVKRLAEESRRSLEDLRRRIEEIIKKLDDGMDLEKVLREAEKLAREHERTNEKLLKDVEKSSRDSHKRNKEIVDRVKKLAEDIIRKTK

SEQ ID NO: 10721 - protein, 175 aa, Artificial Sequence; identical to SEQ ID NO: 10720
  Synthetic

SEQ ID NO: 10722 - protein, 175 aa, Artificial Sequence
  Synthetic
SEIERVKKRLEELLREVEESTRRLEERLKRLLEEAKRSSEEVEKELRRLLEEVRRRLRRDKKLVRELERRVKELLEDSRRSLEELKKRVRKLAEDSKRLLEEVKREVEKLKKKLDDGMDLDDVLRRVEELAKRAHDENERLIREVEELVRRHNKRNKELVDEVKRLVEKVIEEER

SEQ ID NO: 10723 - protein, 175 aa, Artificial Sequence; identical to SEQ ID NO: 10722
  Synthetic

SEQ ID NO: 10724 - protein, 175 aa, Artificial Sequence
  Synthetic
DEIERVKEELERLAKEDKDSTDTVKRELERLLEESKRSSDKLREDVERLLREVRERLRDKKEKVRDVEEKVKRLLEESEESLRENEKTVRKLAEDSERISRENERRIRDALRLLDAGADLKRILEEVKRSSEESHKLNEELLDEVRKSSEEHNKLNEKLLRDVERLVRKVLTETK

SEQ ID NO: 10725 - protein, 175 aa, Artificial Sequence; identical to SEQ ID NO: 10724
  Synthetic

SEQ ID NO: 10726 - protein, 188 aa, Artificial Sequence
  Synthetic
DELDKLLRDAEEVVRRVKEENKRLVKRDEEVVRRIHELNRKLLEDIRKVVEDVKEEIKEGRPDKELKRLLDDLKRKAEEVVRRSRELLKELEKLSRDVIRTSRELLERVKKIVEDLIKKLEDDMTSEDAKRKVKRVKDELKRLVEEVEEVSRRSEERSRKTLEDVRDSSRRLEEELRKLVKEVEEAVR

SEQ ID NO: 10727 - protein, 188 aa, Artificial Sequence; identical to SEQ ID NO: 10726
  Synthetic

SEQ ID NO: 10728 - protein, 188 aa, Artificial Sequence
  Synthetic
DELEKLLEDIRDVVRRIKETLEKLVKEDRDVVEKVKEDNKRLLKEMEDVVRKVKEEIRSGLPREVLERVLERVRRIAEEIIRRSRKIVKDVEKKSTDLKRRLDEILKEAKERVEEIAKEVKKKVTEERLERRAEEMEERLRRLVEEVREVVERVKEESDRTVEEVRRSSDRVEKEVERLVREVEDKVR

SEQ ID NO: 10729 - protein, 188 aa, Artificial Sequence; identical to SEQ ID NO: 10728
  Synthetic

SEQ ID NO: 10730 - protein, 178 aa, Artificial Sequence
  Synthetic
EELERLMRRSEESLKRSEDTVRELIREAREILKRIKEELKRLLEEAERILEEVKKTVRDLRDKKEVLRKLLEDLRRLVEEIERRLKKLLDELREVVREIKERLKKLNDDHRELIKEVAAEVDSKDLIKTARDTLRESERVSKELEERLKKIVEEVERLVEEVKKELERIVKDAERDVK

SEQ ID NO: 10731 - protein, 178 aa, Artificial Sequence; identical to SEQ ID NO: 10730
  Synthetic

SEQ ID NO: 10732 - protein, 178 aa, Artificial Sequence
  Synthetic
DELRKLARDAEEILKRSEEEVRKLKKRSDDSLRRSREEVKKLEDEIREIVDRIKKRVEERPEAKEELRKLLKELEDLVREIEERLETLNREHKKLIEEIERRLEKLNEDLDRVVKDLARKVDVEELKRTLEEIVERSKRVSDRLRERLKRTLDDSRRISDDLRRRLKKLVDDIRREVK

SEQ ID NO: 10733 - protein, 178 aa, Artificial Sequence; identical to SEQ ID NO: 10732
  Synthetic

SEQ ID NO: 10734 - protein, 177 aa, Artificial Sequence
  Synthetic
KEIEDVKEELKKVLEEDRDSLRKVEKEHRRLAEEVKRKVRELEESLKRIVEEVERIAREAKKGEVLKELRKRIRDLLEELKRVLKEVEDRARESIERNRRVSEKSERDIEKIMKELEDGKDLETVIREVRRILEESKRLNDKSREEVRKLVEELKDIVRRIEETVRRLLEEAKERLR

SEQ ID NO: 10735 - protein, 177 aa, Artificial Sequence; identical to SEQ ID NO: 10734
  Synthetic

SEQ ID NO: 10736 - protein, 183 aa, Artificial Sequence
  Synthetic
DSVDRLRRRVDEVLKTVEDALRRNKKDAEDLLRRIEEVLERLERRSEKLLKEIDEVLKRVPEKLVRDARRRLEELREHSKRLVDDLRRDLRRILEKNRELNDKIRKDLKRLKDKVEKLAKDGVSDEILTRAVEEIDELLRKLKRELDESTKESRKRVEELEKRLRDNTKRVKKDVDDLKRRVS

SEQ ID NO: 10737 - protein, 183 aa, Artificial Sequence; identical to SEQ ID NO: 10736
  Synthetic

SEQ ID NO: 10738 - protein, 178 aa, Artificial Sequence
  Synthetic
SSIERLEEESRKNIKELEDSVKELKEEVDRLVEELERSVRELAKIVEDVVRELKKRARKREKEVKEVVERARKLIDEVRRENERVIEEMRRLLKEVEDDNRRVVEESKKLIEEVKNGDDDEEVKRVLEESHRLVREVHERNKRVAERVRDLVRRVHEENERVAEEIRDLVRRVEEEVR

SEQ ID NO: 10739 - protein, 178 aa, Artificial Sequence; identical to SEQ ID NO: 10738
  Synthetic

SEQ ID NO: 10740 - protein, 186 aa, Artificial Sequence
  Synthetic
SEIEDVVKKLRDLSERNVRDIDRLVKEIDELLKRDKEEIKRVVDDIKRRVREIKKIIEEDRDKEKLRELVRKVEEDLEEIVKEVKRHSDELAKRLREIVERVKRHSEEVIKTLRELVDRVRKRVREEKEMLDRLRKVVDELVKENKKAVEDLKKRVEDVIRESKRVVEEARRVVDELKKELRDELK

SEQ ID NO: 10741 - protein, 186 aa, Artificial Sequence; identical to SEQ ID NO: 10740
  Synthetic

SEQ ID NO: 10742 - protein, 188 aa, Artificial Sequence
  Synthetic
SEIEKLVEEAKRLVKEAEDRLRKLSKESEESVRRVVKTLKDLVRELERLVEEVRKIIERNEGKEELEELVDRAKRKLEEVLKRVTELVKRHHEKNEKSLRDVEDLARRVKRKLEDILREVRERVTSDEMRKRVKELEEAVKELTKEIKEVVDRHRETVERSSRKVKTVLDDLRRVVEEILRRVEDAAR

SEQ ID NO: 10743 - protein, 188 aa, Artificial Sequence; identical to SEQ ID NO: 10742
  Synthetic

SEQ ID NO: 10744 - protein, 188 aa, Artificial Sequence
  Synthetic
KKIEDLVEEIKRLSDENRRRVERLSEDSKRSLEENKKKLKELVERIKKLLEEVSDKIRKDEDKDRLRELVKRLKEKLRELLEEARESSERHHRENEKSLKEVEDSSREVRKTLEKLVEDVRRDSTSEEAEERLRRAEDTVRRLVERNREVLEEHERTLRRSSEESKRALKEVERVVREVLKRVDEELQ

SEQ ID NO: 10745 - protein, 188 aa, Artificial Sequence; identical to SEQ ID NO: 10744
  Synthetic

SEQ ID NO: 10746 - protein, 188 aa, Artificial Sequence
  Synthetic
DELEKLVRDLEKRVKEVKDELKRSSEESERSLDEVRKTLKKLVEEMRELLKEVKRIIERNEDRDELKKLVEEAERRLREVLERVRKLVEEHHRRNEELVRRSRELVDDLRRELEELEKDVRDKSTSEEARERLERLRKRVEELLREVEKALEDDEKTVRESSKRIKKVLKELEDTARELVKEVRETAR

SEQ ID NO: 10747 - protein, 188 aa, Artificial Sequence; identical to SEQ ID NO: 10746
  Synthetic

SEQ ID NO: 10748 - protein, 188 aa, Artificial Sequence
  Synthetic
SELEKLVRDLERLSEDNKRRLKESSKESKESLDRVRETIKRLVEEAEELLKRVVDTIRRTEDKEKLDKLVEELKRRLEKLVRELKELVDRHHKRNEELLERSRRSSEDVKKKLKEVLEDVARKSTSEEARERLERLREKVEELARDNERALREDERTVRESSERLRKVLEEAKDRIDKLVKAVEDAAR

SEQ ID NO: 10749 - protein, 188 aa, Artificial Sequence; identical to SEQ ID NO: 10748
  Synthetic

SEQ ID NO: 10750 - protein, 188 aa, Artificial Sequence
  Synthetic
SELEKLVEEAKRLSDKNEEDLRRSSRESRESLKENKERIERAVKRLADLVRDVKEKIKRTESKEDLKRLVDELRERLKRLLEKVRKSSEEHHRENERLLRESTKSSEDVVRRLDEIAEEVARRSTTEEMKERLERLRDTLKKLKERNKEVLREDRETVTDSSRRSEEVVREAEERVERLLREVEEAAR

SEQ ID NO: 10751 - protein, 188 aa, Artificial Sequence; identical to SEQ ID NO: 10750
  Synthetic

SEQ ID NO: 10752 - protein, 188 aa, Artificial Sequence
  Synthetic
DELEKLVRELEELVKRVKEELERSSKESEDSLRDVKKKIEDLERKLDKLLKEVTDEIRRNESREDLKRLVEEARRTLEKVLDDIRKLVEEHEKKNKKLLDDSRELVERLKERLEEVEKDVRDKSTDDEMRKRLEDLERKVRDLARRVEKALEEDERTVRESSKRIRELLKRLEDKVRKIEKDVDDARR

SEQ ID NO: 10753 - protein, 188 aa, Artificial Sequence; identical to SEQ ID NO: 10752
  Synthetic

SEQ ID NO: 10754 - protein, 188 aa, Artificial Sequence
  Synthetic
SELERLVREVRELSDDNRRKLERSSRESERSAKEVERTLEKLVKELRELVERVKRDIERVRDESRLKELVDRARKTLEDVLRDVKRLVDEHRERNRELLERSEKSSRDVEERLKDVVRDVREKSTTEEMKERLKELEKEADDLRRENEELLDRDRRTVEESSKRVEKALRDLEREVRRILREVEETMR

SEQ ID NO: 10755 - protein, 188 aa, Artificial Sequence; identical to SEQ ID NO: 10754
  Synthetic

SEQ ID NO: 10756 - protein, 188 aa, Artificial Sequence
  Synthetic
SKLERLVEELKRLSDENVKDLERSSRESEESLKRNKEEIERVVERLRELLEKVVRDIKDDEGRERLDKLVRDLEEALKELVKRVRKSSEDHKRRNEELLRRSEESSRRVEEVLRRVLEEVTRDVTSEEAKERLDRLREAVEKLREDNKRALDRDRETVERSSKKSEDAVRRAEEDVRRLTETVRRAKK

SEQ ID NO: 10757 - protein, 188 aa, Artificial Sequence; identical to SEQ ID NO: 10756
  Synthetic

SEQ ID NO: 10758 - protein, 188 aa, Artificial Sequence
  Synthetic
SEIEDLVRKLRELLRDVKKKLKESSKRSEDSLRRVKEEIDKLVEELKKLLDEVKKEIERTEDKDELRKLVEEAARTLKRELDRIEEEVRRHDELNKKLLDESRKLVEDAARELEKLVEEVRRRSTTEEAEKKMRELEEEVKKLLEEVDRALKDDERTLRKSSKDIKKVLDDLRRTVKKLKEDVEETMR

SEQ ID NO: 10759 - protein, 188 aa, Artificial Sequence; identical to SEQ ID NO: 10758
  Synthetic

SEQ ID NO: 10760 - protein, 188 aa, Artificial Sequence
  Synthetic
DEIERLVEELRKLSERNKRELDRSSEESRESLKRVKEELKKIVEELRRLLEEVKDRIRKDESREDLERLVKELEERLRKLLDEVRELVERHDERNKKLLDESRKSSKEVKDELRKLLEDVERKTTSEEARERAKRLEKEVRDLAKENEKALEEDERTVRRSSEEIADLLRKVEKVVRELLEEVRRAAK

SEQ ID NO: 10761 - protein, 188 aa, Artificial Sequence; identical to SEQ ID NO: 10760
  Synthetic

SEQ ID NO: 10762 - protein, 188 aa, Artificial Sequence
  Synthetic
SSLEDLVRRARELSDRNREKLKRSSDESRESLKRNEEEIRRLVEELRELLERVRDLIRKLEDKDTLTELVERLKRELERVLEEVKKSSEEHDRRNRKLLEESRRSSKRVKEELKKLVEDADKEVTSEDAKRDLDRLRREVERLIRDNERLAEEDARTVEKSSRDSKKLVEDLEREVEKLRREVERDRK

SEQ ID NO: 10763 - protein, 188 aa, Artificial Sequence; identical to SEQ ID NO: 10762
  Synthetic

SEQ ID NO: 10764 - protein, 188 aa, Artificial Sequence
  Synthetic
SSIEDLVRRLRELSKRNTEELKRSSEESEDSVREVEDRVRELVKRLRELLKRVEDLIRKIEGKEELEKLVRDAKKTLDDVLKEITDLVKEHNDRNRRLLEESEESSRRVKEKLKKVLEDVRRESTSEEMEKRAKELEEEVRDLTRRNEDALRRDRDTVKRSTERVDKVLKDLEREVRDIKRRVDEATK

SEQ ID NO: 10765 - protein, 188 aa, Artificial Sequence; identical to SEQ ID NO: 10764
  Synthetic

SEQ ID NO: 10766 - protein, 188 aa, Artificial Sequence
  Synthetic
RELDELVKELRKLVEEVKDELRKSSKTSKELVEEIKERLERLVRELKRLVDEVRKTIRRLEGEKELRDLVRKAKKRLEDLTREVEKLVREAHERNKKLLEESERLVDRLRERLEELARDVATKSTSEDARRKLEELKETVRELLREVEKALDEDRETVKRSSEEVEEMLKDLRRRVTELDERVEREAT

SEQ ID NO: 10767 - protein, 188 aa, Artificial Sequence; identical to SEQ ID NO: 10766
  Synthetic

SEQ ID NO: 10768 - protein, 188 aa, Artificial Sequence
  Synthetic
DEIEKLVEDAERLSRENEKRVRKSSEESKKLVKEALDELKKLVEELEKTVRDVDREIERNEDRDELRRLVEDVRRRLEELLRDVRRLLEEVHRTNEKLLEDSERSSREVKKDLKRLVEDVRRKSTTEEAKKRMEDMERRVRELEKRNKKVLDEDRETVRKSSKDLEDAVRELEERVRRLAKKVKESAD

SEQ ID NO: 10769 - protein, 188 aa, Artificial Sequence; identical to SEQ ID NO: 10768
  Synthetic

SEQ ID NO: 10770 - protein, 188 aa, Artificial Sequence
  Synthetic
RELEELVKRLRELSRENEERLRRSSDESRKLLERNKERVKKVVDDLRRLVEEVKKEIERDRDRKRLEELVRRAKEVLERLLRDVRKSSEEVHDRNRKLLEDSRRSSKRVKEDLERVRRDVAEKSTSDDARRRLKELEEEVKRLAKRNEDLLREDERTVRESSRRSEDVVRRAEEMVRRLLEEVERARK

SEQ ID NO: 10771 - protein, 188 aa, Artificial Sequence; identical to SEQ ID NO: 10770
  Synthetic

SEQ ID NO: 10772 - protein, 188 aa, Artificial Sequence
  Synthetic
SELEKLVDELRKLSDENRRRLEKSSRDIEKLLKEIRDRIEELKKEIEDLLKEVKERIERLEGRDELRRLVDELRDRLRRLLEEIKRLVEEARKRLKEVLDRSEKSSRDVKRTLRKVLEDARRRSTTEEAEELLRRLEKRVEELARENEEMLKRDEDTVEEVRKRVTDVLRELKRVVEEVRRKVEEEAK

SEQ ID NO: 10773 - protein, 188 aa, Artificial Sequence; identical to SEQ ID NO: 10772
  Synthetic

SEQ ID NO: 10774 - protein, 188 aa, Artificial Sequence
  Synthetic
SKLEKLVKDAEELSRRNEEELRRSSDESRKLLEKNKRRVERLVEELRKLVKKVRDDIRRERDEEKLRKLVEDVKRRLRELLEEVRRSSEEVKKRNRELLERSTKSSKEVEDVLRKVLEDAARDSTTREAEELLRRLEEMLRRLTKKNRELLRRDEETVRRSSKRSEEVVRRAEEEVERLVKDVEDTRT

SEQ ID NO: 10775 - protein, 188 aa, Artificial Sequence; identical to SEQ ID NO: 10774
  Synthetic

SEQ ID NO: 10776 - protein, 174 aa, Artificial Sequence
  Synthetic
KDEERAKKVVEEIKKRVTEIVRRHHKTNEDLVRRVRESSEKHHRRNEELKERVTRKIRKEELLRKLKKLLDESSERSKRLVDELEKEVRKSSEDLRELLKRLTDRLEEVKKLIEDGADIETLVRELEELLKRLEDEVRRLTKRSKEVIDRIHKLNEDLTRESERVLKEVEDRDR

SEQ ID NO: 10777 - protein, 174 aa, Artificial Sequence; identical to SEQ ID NO: 10776
  Synthetic

SEQ ID NO: 10778 - protein, 174 aa, Artificial Sequence
  Synthetic
RETEEVKKELDKLVEEAERAVREHHKENDRLVKRLEEVIRRHEKSVRELVEKVRREVRDESVVRELEEVAKESLERLRKLLEELVKRAEDSSREVEKLLRDLRRDVEELKKMVENGVDLEKIVRRARELVERLKERLKELTRRSEELVKDLERKIERLSRELARIVKEVLDRDK

SEQ ID NO: 10779 - protein, 174 aa, Artificial Sequence; identical to SEQ ID NO: 10778
  Synthetic

SEQ ID NO: 10780 - protein, 174 aa, Artificial Sequence
  Synthetic
SREEEAKKRLEELLREVEKVVRDHHRENEKIREEVERVVEKHKKRNRELVEAVRKRIRDKDVVKEAEDLLRKSSKDLEELLRTLEELIRRASERLREILERVERVVRELKKLVESGMDVREAVERLKEIVERVRRKVEKLTEDSRRVLEELKRRIEKLTRDSERVLKEIEDRTR

SEQ ID NO: 10781 - protein, 174 aa, Artificial Sequence; identical to SEQ ID NO: 10780
  Synthetic

SEQ ID NO: 10782 - protein, 174 aa, Artificial Sequence
  Synthetic
SDKEEVKKEIKKLKEDIKRAVDEHRKVNKRILEEAEKSSREHEKENRDIVRRVREEVEKREVVRTLEERIRRSSDTSRELLRELKERLEDSTRKVEELLRRAEKVLDEALKLIEAGEDIKEVVKELKKILEKLKRELEDLSRKSEDVLRRLHELNKRLTDDSRRVLDEVREDTK

SEQ ID NO: 10783 - protein, 174 aa, Artificial Sequence; identical to SEQ ID NO: 10782
  Synthetic

SEQ ID NO: 10784 - protein, 185 aa, Artificial Sequence
  Synthetic
SEVDRLLKELEDVLKKVEDDIRRHIKRNEDILRESKKLADKLITEIEDMLRKVEEMIRNNSSEDTLRELLERLRDLVKKIRDRVEESDDRLRKLVEESRRNLEELLERLKRLVEKIKEDLERTVDDEEAVKRLEDTARRVEEEVRRLIRELEDTSRRVLEESRKISKELDERLRRVIEEVEKAAK

SEQ ID NO: 10785 - protein, 185 aa, Artificial Sequence; identical to SEQ ID NO: 10784
  Synthetic

SEQ ID NO: 10786 - protein, 185 aa, Artificial Sequence
  Synthetic
SELEKLIKEIRDILKESEDAIKENLDRNEEALKRVAEEIKRLIDELRKMLEDVKRMIRDDSSEETLKKLLDDLRKLVEEIRRRLKRLLDELRRLVEESREDLERLDEELKRIVDRIDKDAEEKVDDRRAVERVREELEKVIRDSRKLSRDLEEASRRVEEDVRRLIEELERRLKEVIKAVEDAAR

SEQ ID NO: 10787 - protein, 185 aa, Artificial Sequence; identical to SEQ ID NO: 10786
  Synthetic

SEQ ID NO: 10788 - protein, 185 aa, Artificial Sequence
  Synthetic
DEVEKLAEELREILKRSEEMIRENLKRNRDLLRRSKEEVDKLKDELEEMLRRVRRVIEDNSSEETLKRLLEELKDLVRRIREELKRSDDELRKLVKESKDNLRDLDRRLREVVEEIRKRLEDEVDDRELVKDLERKAREVIRTSEELSRRLAKTSEEVLEESERVVEELERRAERVEEEITKAAK

SEQ ID NO: 10789 - protein, 185 aa, Artificial Sequence; identical to SEQ ID NO: 10788
  Synthetic

SEQ ID NO: 10790 - protein, 185 aa, Artificial Sequence
  Synthetic
SEVEDLLRKLEEILRRSKENVERNVRENREMLKKVEKTIRDLIRRAEKLLREVEEAIRNNSSEETAKKLLEDLEREVKKIRDTLKKLLDDLKKLVEDSKRDLEEVDKRLEDVVRKIKDELRRRVDDEDAVRRLEKELERVIKTSRDISERLERESRRVEEEVRKLIEELSRRLEEVRERVKEATR

SEQ ID NO: 10791 - protein, 185 aa, Artificial Sequence; identical to SEQ ID NO: 10790
  Synthetic

SEQ ID NO: 10792 - protein, 185 aa, Artificial Sequence
  Synthetic
REVEEALKDLERILKESEDNVRRNIKKNEDLLRRVEERIRELLDEARRLLERVKEVKKDNSSEDELRELLERLKKAVEDIERELKKLLEDLDKAVRESIEDLKKSDRDLEEVVKKIKEDLRDRVDDKDLVERLKEELERVTRDSRRVVDELRKRSEKVREDVRRLIEDLRRRLEKVIRDVEEDAR

SEQ ID NO: 10793 - protein, 185 aa, Artificial Sequence; identical to SEQ ID NO: 10792
  Synthetic

SEQ ID NO: 10794 - protein, 178 aa, Artificial Sequence
  Synthetic
DETERIIRDLERVLEEIARLAKKNIDDSRRVLKELAEKLKRDSERAKKLLEDVEEIIRRNEKDKRDVVREVEKVLKESKKSSEDVARELKDVLRKSRKSAKDLERTVKKVLEDMKEKVDRRLDEDVDRVVRKVLEDLRRLLEEVKKVNDDSEKEVRRLLEENERKNRRVEEEVKKLLK

SEQ ID NO: 10795 - protein, 178 aa, Artificial Sequence; identical to SEQ ID NO: 10794
  Synthetic

SEQ ID NO: 10796 - protein, 178 aa, Artificial Sequence
  Synthetic
SELEDIIRRIEEVLKRNEELNRKNIKESRDLLEEIRRKAKEDSDRVKEVLRRLEDEVRRNELPKEELERKLKEVLDRSKRSSEELKRDVERVLEDSERSVREVVKRDEDSLREIEKLVKERADEEVKRKVDKVVEDIKRVSEESTRANDESRRALEKVVKENEDTNREVVKRVRDAEK

SEQ ID NO: 10797 - protein, 178 aa, Artificial Sequence; identical to SEQ ID NO: 10796
  Synthetic

SEQ ID NO: 10798 - protein, 178 aa, Artificial Sequence
  Synthetic
SELEEIIDRIRTVLERNRELNERNIRESKRLLDEIKKRVEDDNERSKDIVRRVETEVRERRLPEEELRRKLAEALERSKDSSRKLAETLRRLLEDSKRSAREVVERDRKSLEDIKKLVEDRADERVDEVVEKVLDEMRKVSRTSEESNRKSEEEVRKVLKENNDMNRESVERLRRTEE

SEQ ID NO: 10799 - protein, 178 aa, Artificial Sequence; identical to SEQ ID NO: 10798
  Synthetic

SEQ ID NO: 10800 - protein, 186 aa, Artificial Sequence
  Synthetic
DEVRRVIEELERLLEENRRHSKEDNERSKKINKENHDHSKESTDRAEKLLREVEKLIRETEDKDTIKKIIEEIIRTAEDLVRRNERKAERSIEELERSLRRNATLSEKIIRDARRLIEELVKRKGKDTDRVRDVDRTVKRVVKESRRSTRENEKTNTDVVRSTDESLKEDKKEVDRVIEELDRAVR

SEQ ID NO: 10801 - protein, 186 aa, Artificial Sequence; identical to SEQ ID NO: 10800
  Synthetic

SEQ ID NO: 10802 - protein, 186 aa, Artificial Sequence
  Synthetic
SEAEKVIEDAKRLLKENEDHSKEDNDRVRELLEEVKRHSEESTRRAEKILEEIRELVEKVSEKDKISEEVERVIEELRKLVDENRRRIEKIIRDSEKSVERNRRLSEEIIRRLEELIRDLIRKKGKDTEEVKRVEDEVRKLVKASRESTERNERTNREVAERLKKSLEEDRERVRKVVEDLRRAEK

SEQ ID NO: 10803 - protein, 186 aa, Artificial Sequence; identical to SEQ ID NO: 10802
  Synthetic

SEQ ID NO: 10804 - protein, 183 aa, Artificial Sequence
  Synthetic
DELRKVLKESEDSLERLRRTLEESIKRSRDSLRENTELVKDSLRRSEESLERVEKSNTDSEEAKKIADDVVRENRELVKRVRKHSKDVVDTNRKLVDDVRKIVDRVVRENEKVLREVRRDMRENKEMLKRLEDEIRRSIEELRKALRRVEEEHRKVIEASKDLVRRLEEAHKEVIDRLKEKLR

SEQ ID NO: 10805 - protein, 183 aa, Artificial Sequence; identical to SEQ ID NO: 10804
  Synthetic

SEQ ID NO: 10806 - protein, 183 aa, Artificial Sequence
  Synthetic
DEIERVIEESRKSLDDLRRKAEESIRRSEESLREVEERLKRSIREAEESLKKVENSNKDSKELKDLVEKVVRDNRKLVEEVKRIVEKVVRDNERVVDEVRRRVEEVVKENRKRLEEVRRELKDNDEVVRELKKMIDKSERDLEELLDRVRRKHERVIEELKKLLKRVKDAHERVIRELEKTRK

SEQ ID NO: 10807 - protein, 183 aa, Artificial Sequence; identical to SEQ ID NO: 10806
  Synthetic

SEQ ID NO: 10808 - protein, 185 aa, Artificial Sequence
  Synthetic
SEVEDLIRRVRKSNKESEDVLRESIERSEESNERSERTARRIIEEAERILEEMEESLKKGLPEKDLKKIADELRERLKRLLERVKRVVDEDRRTNEELVRRVEKIVKEDEDRLKELLDEVRRLDLPEEVVRRLEEEVKRVAEHTRKLLKDVRKKHEESIRHSEEVLDRLEKKLREIMKRVTERTK

SEQ ID NO: 10809 - protein, 185 aa, Artificial Sequence; identical to SEQ ID NO: 10808
  Synthetic

SEQ ID NO: 10810 - protein, 185 aa, Artificial Sequence
  Synthetic
KEVEDIIEDVKRSLEESKRMADKSITDSRRSNEESKRIVEEIKRKIDEILERIERKARKGEPKEDLDRIVKELKEELKRLLEEVTRVLEEDADRNRKLLKEVEKIVKEDRERLEKLLDEVRKLDLDEKVVRELEKRVKEVVKTTEDVLREVERTHRESIKHSEDLVRRLEERLRRVAKEVERTRK

SEQ ID NO: 10811 - protein, 185 aa, Artificial Sequence; identical to SEQ ID NO: 10810
  Synthetic

SEQ ID NO: 10812 - protein, 185 aa, Artificial Sequence
  Synthetic
SEVEKAIKEARDSLRESKRLLEESIKRSEDSLEESRRVVEEIKKRLEELLREVKESVDQGQPEDDLRKIVEEAKRRLKELLDRVREIVERDERRNRELVKEVRKIVEEDLKRLEDLLRRIRNLDLDEKKVRDLERMVKRVMEETEKALEDVERRHEKSIRDTRRVLKELEDTVRKVLKEVDRERQ

SEQ ID NO: 10813 - protein, 185 aa, Artificial Sequence; identical to SEQ ID NO: 10812
  Synthetic

SEQ ID NO: 10814 - protein, 185 aa, Artificial Sequence
  Synthetic
SKLEKVITEVRDSLRRSRKMAEDSIRRSEELLKELEDLLKKVRDTLRKILKDIEDLARKGLPKEELTRIVDELEKRLKRLLDEVDKALKRLVKENERLVEEVREIVERDKKTLDKLLEDIERLDLPKELVDDVRREVEKVVEDTRRVLEEVERTHKESIDRLRKLVERVRREIEEIARRVKETRD

SEQ ID NO: 10815 - protein, 185 aa, Artificial Sequence; identical to SEQ ID NO: 10814
  Synthetic

SEQ ID NO: 10816 - protein, 183 aa, Artificial Sequence
  Synthetic
SVVEKLKDEADKLVKRNEDLARRLEEVSKDTIDRLEDVLRKLREVLKRLRRRLEEVLKRVDREELKRDVEEVEKELEELVRKIEKEVKDVVRTSRELVERVKRTLEDDIRRMEDLARKLSRLTDREKFEEVIKRLRDSSKRSEDKIRKVLKDSRDLLEDVRRKIEDVIRRMEKLIKEVEDRVR

SEQ ID NO: 10817 - protein, 183 aa, Artificial Sequence; identical to SEQ ID NO: 10816
  Synthetic

SEQ ID NO: 10818 - protein, 181 aa, Artificial Sequence
  Synthetic
SVVEELERVMRELKKRNEELSRENHESVKEAEKRNKRLSEELEKVSRDVIKDLERVVEEVEEVKDEVKRVIDESKRSLEEVKRHSERVVKRLRDLNKDSEDHSREIVRTMEKLLEDARRLTDEREIRRIIEELKRLSDENEERIRRISEEIKDLSRRNEETVRRVIEENRKLLEDATRRTK

SEQ ID NO: 10819 - protein, 181 aa, Artificial Sequence; identical to SEQ ID NO: 10818
  Synthetic

SEQ ID NO: 10820 - protein, 181 aa, Artificial Sequence
  Synthetic
SLREKLKEVIRRLEEENRRVSEENHRSVREVEEENRKVSDELRKVAEELKRRLEEVVRRVREVEELVRELVERMERILRRVEDHSRRVVEELRKLNEESERHSRDVIRKLRELLERAKRLTDSREIEDIIRRVKKLSKENKETIERISREIRELSKRNEEEVRRVIRRLEELLEELERTAK

SEQ ID NO: 10821 - protein, 181 aa, Artificial Sequence; identical to SEQ ID NO: 10820
  Synthetic

SEQ ID NO: 10822 - protein, 181 aa, Artificial Sequence
  Synthetic
RVIEKAEEVVDRLKKRNKEVLKENHDSVREVEKENRELLEKAEKVVRELEERLKEVVEEVSEVTEDIRRVREELKKILEDVARHSKETIDLLRKLNKESEKHSEKTMRDLEKLLEELRRLTDEREIERIIKEAEELSKRNEEVIDEISKRIKELSERNRERVEKVIEEAKELVKRVTDKVK

SEQ ID NO: 10823 - protein, 181 aa, Artificial Sequence; identical to SEQ ID NO: 10822
  Synthetic

SEQ ID NO: 10824 - protein, 178 aa, Artificial Sequence
  Synthetic
KDEEKAEDVVRRLTEEVRRVHEKTRDVVRRVTERSNDVSRRSKEEVRELLERADDLARKGKISEELVRRVKEELERVVREDEELNEDLKRKLDDLLRRDEKLVREIERRLEEVVKLVRDGMSVEDLIRELKRLVDELRERSEDLIRKAERVLERLEEESRRLLKELRDLLEDVTRKAE

SEQ ID NO: 10825 - protein, 178 aa, Artificial Sequence; identical to SEQ ID NO: 10824
  Synthetic

SEQ ID NO: 10826 - protein, 178 aa, Artificial Sequence
  Synthetic
SETEKAREVVRELEKRNDEVHKETRDVVRRLEETSDEVSKDSERKVDRLREEVKKVRDDGKVDDKLVKDVEDKLKKVTDEDRRLNEEAKKELRRVVEEDRRSVEESRKRLEEVVRLVEDGKDVEELIRRMEKLTEDNERRSRKLIEELKRLLEDLREKSERLIRELERLVKELRDRAE

SEQ ID NO: 10827 - protein, 178 aa, Artificial Sequence; identical to SEQ ID NO: 10826
  Synthetic

SEQ ID NO: 10828 - protein, 178 aa, Artificial Sequence
  Synthetic
SEKEKAREVVKKLKKRVDEAHKKTKDVVEELRKRNRDVHRTTREVVRDLLKKVKDVERRGEVSEEVVRRVEERLREVVEEDEKSVRESERVLDEVEKDDRRLVEEIRRRLEDVVRMVEAGKDVETLIERLRELIDELRRRSEKLIKELREVTKRNKERSDRLIKELEDLVKKLKDDAT

SEQ ID NO: 10829 - protein, 178 aa, Artificial Sequence; identical to SEQ ID NO: 10828
  Synthetic

SEQ ID NO: 10830 - protein, 186 aa, Artificial Sequence
  Synthetic
DEVEKLIEDLKRIVERDEREIRELIKELDDHVRKDEKIARDLERRLKEILDEVRKMVTDNSSEETVTRLLREVEELVRKIEKDARDSLESNRELAERIKERAERSLRELEKRVTEIEERLKERLREKKELLEKVKRVLEEVRRRSRETLERLREVLERSIRDSERTLEKVREMLERVRKEIEKLRK

SEQ ID NO: 10831 - protein, 186 aa, Artificial Sequence; identical to SEQ ID NO: 10830
  Synthetic

SEQ ID NO: 10832 - protein, 186 aa, Artificial Sequence
  Synthetic
SEVEELDKRLRDHVRRDEEIVERLIRELKRHVERDREEARRLIEELRRLLEEVKRMMEDDSREDDVRRLLEEVRELVARIIERAEDSLRSNEDLVRKIEERLRRSLKSNRDLVKEIKKILDRDLREDRKLVRDVEKSLEESIRRSEETLKTVKDVLDKSKEDSKRTVEDVERVLREAEKEAKRATD

SEQ ID NO: 10833 - protein, 186 aa, Artificial Sequence; identical to SEQ ID NO: 10832
  Synthetic

SEQ ID NO: 10834 - protein, 186 aa, Artificial Sequence
  Synthetic
SEAEKLIKELEDHVKRVEDRARELIDELRKHVEEDERRARKLIEELRRLLKEVKRMVDDNSSEEVVKRLLEEVRRLVEEIERRARKSLESNKELVKEIRERVTRLLESNRELVRRIEEVLDRDLREDEDLVRRVRKVLRRSEEDVRRLIEEVERVLKRSEEESRRTIREVEEVLKEVERAVEELAR

SEQ ID NO: 10835 - protein, 186 aa, Artificial Sequence; identical to SEQ ID NO: 10834
  Synthetic

SEQ ID NO: 10836 - protein, 180 aa, Artificial Sequence
  Synthetic
SLEDRVREVVERSERDLRRSTDEIRRVVEEAEKALRRLVREVEEVVREVKERLERVVREGRVDRETVRRVIEDIERALDEVRETVRKIIEDLRKILEDVRRHSERVIRENRKLLEAARNGDEDTVRKVIEDSDRSLEENKRLVKKVIDEIKERLKEMKKRAEEIIERLKKLLEEVEERAR

SEQ ID NO: 10837 - protein, 180 aa, Artificial Sequence; identical to SEQ ID NO: 10836
  Synthetic

SEQ ID NO: 10838 - protein, 180 aa, Artificial Sequence
  Synthetic
DLTKRVEEVVRRSRERLERSTRDIKRKAEEVKERLKKSSKEVEKVIREVETELERLRREGKVDEDTVREVLERIRRLLEEVKEHSKRVLDDIERLLRDLEEHSKEVVRRNERLLREIKDGDEKKVEEVLRRSEKSVRDNKKRVEEVAETLKKILTDNRRLVKRVKEELDKLIRDVEERAR

SEQ ID NO: 10839 - protein, 180 aa, Artificial Sequence; identical to SEQ ID NO: 10838
  Synthetic

SEQ ID NO: 10840 - protein, 179 aa, Artificial Sequence
  Synthetic
SEKEDVERVVERVKREADELLKENHKSVKDVDERVKETVERNHRSVRKAEEDVKRVEREDKRLKELVEELRRRLKELNDRSKKLSRESAERLKKLNKESEEVIREVKRRAEEIVEMVKRGDVEVREVAKELEDIVRRIKELVERSNRELKKIVEDNERVVEESDRRIKEILERITEASR

SEQ ID NO: 10841 - protein, 179 aa, Artificial Sequence; identical to SEQ ID NO: 10840
  Synthetic

SEQ ID NO: 10842 - protein, 179 aa, Artificial Sequence
  Synthetic
SEKETVEEVVDKVRRDLDKSLEDNHKSVEEVRRRVEKTLRENHESVERARKRARDLEREDRELKEMVERAEEELEKLNRESADISRRSEERLEELNRRSKRLTDESKRKLEEIKDVVRRGDIEVREVVERAKRILEDNKKKIDESNERLERIVRENKEMVERSDRRIEEIVERIERETR

SEQ ID NO: 10843 - protein, 179 aa, Artificial Sequence; identical to SEQ ID NO: 10842
  Synthetic

SEQ ID NO: 10844 - protein, 179 aa, Artificial Sequence
  Synthetic
DEKEEVEKRAEEVRKKVDKLLKENHESVEDARRRVDKTLRENHESVEEVKRRVDEVRREDERLERVVREIKKRLKKLNDESKKLSDDSKERLKRLNEESEKVARDIKRELKRIVELVRRGDVRAEDVMEELDRLVEDLRRKVEDSNRKIKRIVDENKREVEKSNRKLRELLKELEDRAR

SEQ ID NO: 10845 - protein, 179 aa, Artificial Sequence; identical to SEQ ID NO: 10844
  Synthetic

SEQ ID NO: 10846 - protein, 179 aa, Artificial Sequence
  Synthetic
SKKEDAERVVREVTREVRRLLKENHDSVREVLKRVDETVERNSRSVKEVLRKVREVEREDRRLREVVKEIEKRLRDLNERSKKLSKESKEELKKLNDESRKVVEEIERRLKELVDLVRRGEVDLKEVVDRARDLIRDLTRKVKESNERLEEIVERNEREVRKSDEDLKRLADDLERKAT

SEQ ID NO: 10847 - protein, 179 aa, Artificial Sequence; identical to SEQ ID NO: 10846
  Synthetic

SEQ ID NO: 10848 - protein, 179 aa, Artificial Sequence
  Synthetic
REKEEVERVVEDVRRRLDESLERNHKSVRDALREVDRTVEENSRSVEKVRKRLKEVEREDKELEDLVRKIKEDLDRLNEESRRLSEDSKRRLKDLNRKSAKITRDSKEELRRIVEAVRRGDVEVREVKKELEKIVRDNERVVEDSNDKIRRIVTKNTEDVKRSDETLERIVEEIERRAR

SEQ ID NO: 10849 - protein, 179 aa, Artificial Sequence; identical to SEQ ID NO: 10848
  Synthetic

SEQ ID NO: 10850 - protein, 179 aa, Artificial Sequence
  Synthetic
KEKEDVERKVEDVKRDVDRVLEENHRSLKEAEERSNKLSDTSRRVAKRVVDDVRRLKREDERLVRLVEELKKELKRLVEEDKKINDEIREELRRLNEDSKRVVDDLKRRLKEIVDAVRRGDIDVKEVVDRLEKIVRDIRKEIERSNRDVERLVRTLEEVSKRIIDTLERIIDKIREDTK

SEQ ID NO: 10851 - protein, 179 aa, Artificial Sequence; identical to SEQ ID NO: 10850
  Synthetic

SEQ ID NO: 10852 - protein, 178 aa, Artificial Sequence
  Synthetic
SEAEELIEELERIAEEDRKLVEDSIRKLRKILDEDRKIMKRLAEELDRILEDVKRKVDKGLSEKELKDVVKEVEDKLREVLRRAEESVRESEERLRENEERNKESVERSRERLDRVIEDVDKVKELEEVVRKVKRESDRTLEKSKKVVDEVRRRSEETLEKLRRVVERVRKRVDEASK

SEQ ID NO: 10853 - protein, 178 aa, Artificial Sequence; identical to SEQ ID NO: 10852
  Synthetic

SEQ ID NO: 10854 - protein, 178 aa, Artificial Sequence
  Synthetic
DRADELRERLKEIMERDRRIMKELEDELRELVERDERIIRELERRLEEIVKDVERKAKSGQDEESLKRVVEEAERVVEEVEKRVRESVKKTKDALDELIRRAEDSVRRSREELEDLIRKVSDVDELRRVVEEVEKDSERTLKELRRVVKEVEERVEKTLRDLEEVLERVKERVKRLKD

SEQ ID NO: 10855 - protein, 178 aa, Artificial Sequence; identical to SEQ ID NO: 10854
  Synthetic

SEQ ID NO: 10856 - protein, 178 aa, Artificial Sequence
  Synthetic
KEAEDLMREVEELVRRDEEIIKRLADELEEIVDDNRRKVEDLVRRLEEILRRVEESMRKGLSEEELRRVVEDVERRLRELIREAKRSVEESRRRLEEVRKRVEESVERTKRELDRLIEEVKDVKELREVIERARKRVEETLRELERKLEEVRKTSEDLLRRLEEVVKRVKEEVEKLEK

SEQ ID NO: 10857 - protein, 178 aa, Artificial Sequence; identical to SEQ ID NO: 10856
  Synthetic

SEQ ID NO: 10858 - protein, 178 aa, Artificial Sequence
  Synthetic
SEMDELRKELEDLARDDKRRVEESIRRLEKIAEDNERLARESIKRLRRLVTELEKLARKGLSEEELERVVRRIDEELKRNEEENRRSVEKSERDLRRNEEENKRSVDETEEVLRRLIEEVKDVKELKEVVDRVREIVKKTLEESREVVKKVREDSKRLLEESKRVVEEVKKRVEELKK

SEQ ID NO: 10859 - protein, 178 aa, Artificial Sequence; identical to SEQ ID NO: 10858
  Synthetic

SEQ ID NO: 10860 - protein, 175 aa, Artificial Sequence
  Synthetic
DEVEEVKEELKRTSRDDERKVEEIRKRLEESTRRLRELAEELKDELRKSSRDLERLRRENKDLTDVLRKNEELVKRIDDKLKKVLEDNKRLVDEIRKTAEKSVRDNEEVVRRIKEELKDVREVERALERSLKRSDETVKEVEELLRRSLEDSKKLLEEVREALERSKKRSDELRR

SEQ ID NO: 10861 - protein, 175 aa, Artificial Sequence; identical to SEQ ID NO: 10860
  Synthetic

SEQ ID NO: 10862 - protein, 175 aa, Artificial Sequence
  Synthetic
KEVEDVKEELRRSSKKLRELAERLKKLLEDILDEDRKLAEEIKKRLEDSSRKIEELKRRNRDLTDILRENRELVERARRRAEESLKKVKELLDKIREAIREVLERNKELVDEIRKRLKDVDEVERMLKESDKESKRLLEEVDRMLKEVIKASKKSLDDVDRVLRRSERESEKRRK

SEQ ID NO: 10863 - protein, 175 aa, Artificial Sequence; identical to SEQ ID NO: 10862
  Synthetic

SEQ ID NO: 10864 - protein, 175 aa, Artificial Sequence
  Synthetic
SEVEKVKEELRESSRALRKLVEKIRRILRETSERDRDTVREIADRLRKSSRRVEELKRNNKDLTDVLRDNDRLVKEIEKRLKDSLDENKRVVDKLREEAKRALEENKKLVTRIEKDLKDVDEVRRVLEESERRSKKLLDEVEELLRRSERTSRESLKEVKERLRKSLEESERRAR

SEQ ID NO: 10865 - protein, 175 aa, Artificial Sequence; identical to SEQ ID NO: 10864
  Synthetic

SEQ ID NO: 10866 - protein, 183 aa, Artificial Sequence
  Synthetic
SLVERLKKVVEDAERELRRLTKETEDVLREAEETIKRLSERLKKANEDTERKIRRLAKENRDEKVIKKLEDVVRRSTKLVEDVHRDNERVLDEVRKLVDEVRKTNEDVLREVRRLMEELARLTDEKKIDDAIKRIRDLIERVEEINKEVVDRIKELIERVEEINETVIRDSERLIKEVEDEVR

SEQ ID NO: 10867 - protein, 183 aa, Artificial Sequence; identical to SEQ ID NO: 10866
  Synthetic

SEQ ID NO: 10868 - protein, 183 aa, Artificial Sequence
  Synthetic
SLEEDLRRVLEEVKRELKELSKRSKEVNRKTEETARRLSEKSEKVNRETKKRVEDLMRENRDEKVIRELRDAVRESTRLLEELKEDNRRVVERSTDLVRKVDRINREILKEVEELVRRLSRLTDEKAIRDAIRRLKELVERVKRTNEEVVKESEELIERVRERNDDAVRKSRRLIERLTEKVK

SEQ ID NO: 10869 - protein, 183 aa, Artificial Sequence; identical to SEQ ID NO: 10868
  Synthetic

SEQ ID NO: 10870 - protein, 183 aa, Artificial Sequence
  Synthetic
SLKETLEEVLKEVKRRIEDLSRRLEEVLRRAREELKRLSDDSRRVVEEAEERVRRLMEENRDEDVIRKLREALKEVRRLLEEVERRNRALMKEVEDLVRKVNKDNRRVLEEIKRIVEKLSRLDKKEEIKRVIDELRRLIEEVEKRNREVVEEIKRLIKEVADDNRRALERIRRLIRKLEEEVK

SEQ ID NO: 10871 - protein, 183 aa, Artificial Sequence; identical to SEQ ID NO: 10870
  Synthetic

SEQ ID NO: 10872 - protein, 183 aa, Artificial Sequence
  Synthetic
SLTERLREVLKKVEDTLRKLSERLRDVLRKAEKTIEEISRRSEEANRETKERAERLMEENRDERVIRKLEEVVRRSTKLVRDVDRRNKKVLRDVRELVKKVNEENKKVLKEAREKVDELSRLTDKDRIEDVIRELDRLLEEVRRINEEVLRRIEELIKRVKEENDRVMETSRRLIETVKEEVK

SEQ ID NO: 10873 - protein, 183 aa, Artificial Sequence; identical to SEQ ID NO: 10872
  Synthetic

SEQ ID NO: 10874 - protein, 183 aa, Artificial Sequence
  Synthetic
DKVRKILKEMRDLVRRNKEEIDRSIRKIEELIERNKREIDKSIEELKRLLDEVRKIVKDERDKEKLRRIVEEVDKRIEKIHKENEDHSRRSSEEVEKIHRENKEHSDRSSEDIRRLLEELRKDGLEMVRDVARVVKEVHDDNRRLTEKSERVVREAHRRNEEIVKASEEAVREAKRRLEELRR

SEQ ID NO: 10875 - protein, 183 aa, Artificial Sequence; identical to SEQ ID NO: 10874
  Synthetic

SEQ ID NO: 10876 - protein, 183 aa, Artificial Sequence
  Synthetic
DKVREILKRLEDLVRTNKERIDESIEELERLADENRRRIKKSIDDLRRLIEEVERIVKDRRDDRTLDKIVTEAKETVKRIHEENERNSKRSSETVKKIHDENREHSKRSSEEAKRLIDELRKDGLEVVRDVERVLEEVDRANRDLVRRSKEVVDKVHETNKKLVEESKEAVDRVTELLERARK

SEQ ID NO: 10877 - protein, 183 aa, Artificial Sequence; identical to SEQ ID NO: 10876
  Synthetic

SEQ ID NO: 10878 - protein, 183 aa, Artificial Sequence
  Synthetic
DEVEELVKKLEKVLREIEEMSERLSDENRKVLEKIKEDSKRLNEELERVLRRIREASRDKREEVLRKLVEELKKVLEEVRERSEDLLKEAKDIARESRKRSEELVRRLEEVLREVKRAAERDVKSELLERLREVLEDVKRKLDEIHRRNEESLERLEREVKRLNEDNRRSLKTVDDRLRETKR

SEQ ID NO: 10879 - protein, 183 aa, Artificial Sequence; identical to SEQ ID NO: 10878
  Synthetic

SEQ ID NO: 10880 - protein, 179 aa, Artificial Sequence
  Synthetic
SEKEKLDAVLREVEEAAKKNIDKNRRSLEEVAEVVRELVKENRKSLEEVKEMIERIIREIRNKEDLVRKAREVLKEIERLVRESIKELERLLKEIEKLVEESVRRSRKLVKEIEELVKKGGDDVEKIVEDLKRVLEESHKLSEDVDRLIKRVVEEAKKLSRDVNEDVKRVVKEVKDEAD

SEQ ID NO: 10881 - protein, 179 aa, Artificial Sequence; identical to SEQ ID NO: 10880
  Synthetic

SEQ ID NO: 10882 - protein, 179 aa, Artificial Sequence
  Synthetic
SEKEKLDDVLRKVKDTLAENIKNNKESLDRVREEIERNIRRNEESLDRARRTVEKIIEEIREDEDLVRRAEEMVRRVADLVRKSVERSRELLKRLEDLVRKSVEDSKDLLRRVEKLVREGGDDVEKLVEELRRLLKESHELSREVNDRLRRALEESHELSKEVNETLRKLLEDIRREAK

SEQ ID NO: 10883 - protein, 179 aa, Artificial Sequence; identical to SEQ ID NO: 10882
  Synthetic

SEQ ID NO: 10884 - protein, 179 aa, Artificial Sequence
  Synthetic
KDEERLKKVIDEVRKRVEENIRTNEDSLRKAEETLKRNIRKNEKSLEDARREIEELIREISDDEDLVRELEDVVRKIAELVKRSVEESERLAKELRDLVKESVDRSRKILEDLERDVERGGKDVEKLIKKLRDLLEESHRLSEEVNRTLKRALDESHERSKEVDKRIEEMVERVRRKVK

SEQ ID NO: 10885 - protein, 179 aa, Artificial Sequence; identical to SEQ ID NO: 10884
  Synthetic

SEQ ID NO: 10886 - protein, 179 aa, Artificial Sequence
  Synthetic
SEREKLEKVLEEARREIERLAEENRRSLDRARKEVKRLIDNNRKSLDDVRKRVDKLVKDISDDERLIRELERVVKDIEELVRDSERKAREMVKRVERLVRESIRRLEDVVRRLEDLVRKGGDDVEKLVEELKKVLDDVRKESERVNRTLKKLLEDIERLSREVNKRIKEMVRKATEDVR

SEQ ID NO: 10887 - protein, 179 aa, Artificial Sequence; identical to SEQ ID NO: 10886
  Synthetic

SEQ ID NO: 10888 - protein, 179 aa, Artificial Sequence
  Synthetic
SEKEELDKVLKEAEDKIEENIRDNERSLRDVERAVRRIIENNRESLEELDKAVKEIVRRISDRKELITRLDKAVKDVKRLVDRSVEEAKRIVDEARELVRRSVEESRRLVERLKKLVDDGGDDVKTLVEELRRALEESHKLSEDVNRALKKVLEEIADLSRKVNDKLRELLKRLEEEAR

SEQ ID NO: 10889 - protein, 179 aa, Artificial Sequence; identical to SEQ ID NO: 10888
  Synthetic

SEQ ID NO: 10890 - protein, 179 aa, Artificial Sequence
  Synthetic
SKEEKLDKKLKEAERTIRENIKENRESLERARKTLEENIRNNEDSLRRVEEEVRRIIEEIRDDEELVRRAEDVVRKLRKLVEDSVRDSERIMEEIERLVRDSVRKSEELVERIKRLVEEGGEDVDDILRRIEEILRRSHRLSKEVNKRIKELLDRSHELSKRVNDELDKVLKEIRREAK

SEQ ID NO: 10891 - protein, 179 aa, Artificial Sequence; identical to SEQ ID NO: 10890
  Synthetic

SEQ ID NO: 10892 - protein, 179 aa, Artificial Sequence
  Synthetic
DEDEELKKVLDRAKKRVDELVRNNEESLERVKRAVDRLIEKNERSLERAEDELRKLVKEISDDEDLIKKIRDAVEEVRRLVEESRRRAEEVVKRAKELVERSIRELERVVKRLADLVREGGDDVEKLKKELDDMLRKLEELSRRVNRTLEELLRRIEELSREVDERIKKVLKEIKDRVK

SEQ ID NO: 10893 - protein, 179 aa, Artificial Sequence; identical to SEQ ID NO: 10892
  Synthetic

SEQ ID NO: 10894 - protein, 179 aa, Artificial Sequence
  Synthetic
SEKEELDDVLRRVEEKVRRNVRKNEDSLKKVEDEVRRNIRNNEKSLEDAERDVRKLAKDVSDDEDLIRRLKEVVDEIRKLVEESVRRSKRLLEEIRKLVEESIRRSEDLVRTVEDLVRKGGDDVKKLLKELEDLARESHKLSRDVDRKLEDALRRSHRLSREVNRKIEEMVRKLREDTR

SEQ ID NO: 10895 - protein, 179 aa, Artificial Sequence; identical to SEQ ID NO: 10894
  Synthetic

SEQ ID NO: 10896 - protein, 179 aa, Artificial Sequence
  Synthetic
KEEERVTDALRRVRETAKKNIEYNRRSVERVERTLKELVKNNTRSLERVRKAVKELVERIRDKEELIRELERVVKELEKEVRDSIKRIEEAVKRSKDSSETHVKTSEDVVRRLEDEVRKGGDDVDKLIERLERVLEKSHRDLRRNSKDNKRILDEIKKESEEVNRRLEEVLRKIKEDVE

SEQ ID NO: 10897 - protein, 179 aa, Artificial Sequence; identical to SEQ ID NO: 10896
  Synthetic

SEQ ID NO: 10898 - protein, 186 aa, Artificial Sequence
  Synthetic
DKVRELEKTLRDLLRENHRISEDLNKKLKDMARRNKKHSEDVIEKIKRLLDRLREIVKRDGGEDKRVVEELRRIVEEVRRLLREDEKENERSLEEVEKLVRESEKRSKKILEDAKKLVEDLERDNIDDELVRRVREVLREVEERLRDNIKDNRRSLDDHRRVIEETRRESKRAVERAEDEVKKLED

SEQ ID NO: 10899 - protein, 186 aa, Artificial Sequence; identical to SEQ ID NO: 10898
  Synthetic

SEQ ID NO: 10900 - protein, 186 aa, Artificial Sequence
  Synthetic
SKVEDLIRRLKTLLDDLRRISREVDEKIKEILKEVERHSKEVIDRIKDILRRVEEIVRRKGGEDEEVVEELRRVVEEVERLLREDVKEIDRVVKEVRDLLRRSVEIIEEIVKRVRDLVEEIKRDNIDKRLVERVEKVAREVEEAVRKLIEKNKESVERAEETARRLIERSKRAVDEARRKIEELRR

SEQ ID NO: 10901 - protein, 186 aa, Artificial Sequence; identical to SEQ ID NO: 10900
  Synthetic

SEQ ID NO: 10902 - protein, 186 aa, Artificial Sequence
  Synthetic
SKVEELIERIERLLEEVRRISDKVDEDLERLIRENEKHSKKIIKELEKLLKELEDIVRREGGEARRVVEILKKIVEDVRDLVRRDEKLNRDSAKTAEDLVRTSEEDLKRVLEEVKRLLEEIERDNIDKRLVERLRKVVEDAEREIRRLIEKNKRSLERHKRELERTIKESRDVLKKVEDRVRELAR

SEQ ID NO: 10903 - protein, 186 aa, Artificial Sequence; identical to SEQ ID NO: 10902
  Synthetic

SEQ ID NO: 10904 - protein, 186 aa, Artificial Sequence
  Synthetic
SKVEDLERRIRKILREVEEISERVNRALKRLLDENRKHSEKIIRELEELLRRLEEEVRTKGGEAREVVEAIKEIVERAKRLVDEDRRLNEESRKRAKELVDESRKTLEEVVKEVRKLAEELEKDNIDKSLVDRVRKAVEEAEERIRRLIENNERSLRRHEEAIKKTIEESDKVLEDVRRRAEELLK

SEQ ID NO: 10905 - protein, 186 aa, Artificial Sequence; identical to SEQ ID NO: 10904
  Synthetic

SEQ ID NO: 10906 - protein, 186 aa, Artificial Sequence
  Synthetic
SKVERLIERLKELLDENHKISERVNKELERLARENDKHSKDLIRDIERILREVEEIVRRDGGEAEEVVRRLREVVKEVRDLLKEDADRNRESAKEAEKLVKDSEDTSRDILREATELVERIERDNIDRRLVEEVRRVLREVREAAKENIRNNRESLKRHKDALRKTIEDSARVVKRAEERIRELER

SEQ ID NO: 10907 - protein, 186 aa, Artificial Sequence; identical to SEQ ID NO: 10906
  Synthetic

SEQ ID NO: 10908 - protein, 186 aa, Artificial Sequence
  Synthetic
SKVDELVERIERLLRELTKHSKEIIDRLKKLLEDNERINRDVIRRIEEILKEVKRIVERDGGEDERVVRTIEEMVKRLAELVKRVEEINDESAKTVTKLVEDDMRELRRIVEEVEKLAEDLERDNIEEELVRKVREVVDRARERVEELIRRTEDVLKKHREELKKLIEESRRVLEEAKKTADELKK

SEQ ID NO: 10909 - protein, 186 aa, Artificial Sequence; identical to SEQ ID NO: 10908
  Synthetic

SEQ ID NO: 10910 - protein, 185 aa, Artificial Sequence
  Synthetic
DEVRKLKEDLRRLLKENKEKVEKVIRENEKLLRENKKMVEDAERDLRRLLKELEDLVRKRGTDEDLAETAKRVKEEVDRILEELRRHSKRSSEESRRSVEEVERHSRESSERVDKIIRDAEARGLPKELVDEVRRVARRVKEENKRLLDEVRKVSEEVERTNRELVRRVEEVVREVRERIDELLR

SEQ ID NO: 10911 - protein, 185 aa, Artificial Sequence; identical to SEQ ID NO: 10910
  Synthetic

SEQ ID NO: 10912 - protein, 185 aa, Artificial Sequence
  Synthetic
SEAEDLERRIEKLLEDNTRLVERVIEENEKLLRDNAEHSKEVEDRLRDLLRRLEEVVRKRGTDEELKKLADEVVKRVRDILRENKKHSDDSSRRSEKSVDDVRKHSKESSDEVKRILDDIRRRGLPEELIKRVEEVVRKAKKTNEDLLREVEKVSREVKKANEDLLRRSKEVVDEVEKDIERLKR

SEQ ID NO: 10913 - protein, 185 aa, Artificial Sequence; identical to SEQ ID NO: 10912
  Synthetic

SEQ ID NO: 10914 - protein, 185 aa, Artificial Sequence
  Synthetic
DDIERIIEKLKELLERNKRHTEEVIKELERLLRENERHSREVKKRLEELLKRLEDVVRREGTDERLKKLAEDVLREVRDILRRNEEHSRDSSEKVREIIERNEEHSRRSSDTVDKILEEVRRKGLPEEVIRRIEEAVREVKEANKDLVRESRRVARRVEEENKRLVEESRRVVEKVEKRIRDLLR

SEQ ID NO: 10915 - protein, 185 aa, Artificial Sequence; identical to SEQ ID NO: 10914
  Synthetic

SEQ ID NO: 10916 - protein, 185 aa, Artificial Sequence
  Synthetic
DEIDEARKELEEILRENREKVDEVRKRLEKLLRENEEVVKEIIRRLKELLKELERVMREEGTDERLKELVREVMDRVRKILEEAEKHSRDSSREVDKILKEVEKHSRDLVRRVREIIRRLEAKGLPEKLVREVRKDAERAERELRRSVEDIRRVVERVKRENERLLREVEKVVEEVKEELRKIET

SEQ ID NO: 10917 - protein, 185 aa, Artificial Sequence; identical to SEQ ID NO: 10916
  Synthetic

SEQ ID NO: 10918 - protein, 185 aa, Artificial Sequence
  Synthetic
DEIERVIEELKKRLDENRRVLEEIIRRLEELAKRNKRHSEELEKRLREELDKVRKRLEETGTDEEVEKILRTVKREVDKILRENEEHSRKSSEDVKKILDEARKHSEDVVRTVEDILRDVARRGLPRELIERMREVVEEVERALRKSLKDVEDVVREVEKKNKELLEKSKKVVEDVRRTLEKLRE

SEQ ID NO: 10919 - protein, 185 aa, Artificial Sequence; identical to SEQ ID NO: 10918
  Synthetic

SEQ ID NO: 10920 - protein, 185 aa, Artificial Sequence
  Synthetic
SEVEEAIKTLKKLLDDNKRHTEEVIRRIEELLKRNEEHSRKVIEDLERLLRKLEKMVRDRGNDERLKKLVRDVLERVKELLKRNEEHSRRSSKRVEEILRENEEHSRRSSRTVKEILKDVRRKGLPEEVVRRMEEAVRRAEETNKDLVRRSREVVRRANETNKKLLEDSKRVVERVEKRLEELLR

SEQ ID NO: 10921 - protein, 185 aa, Artificial Sequence; identical to SEQ ID NO: 10920
  Synthetic

SEQ ID NO: 10922 - protein, 185 aa, Artificial Sequence
  Synthetic
SELEEIERELEELLRENKKLVDRVREELKKLLDELRKHSERVIREIERLLEELERVVRKRGTDERLKELVEKVKEDVKKILRENEALAEEVDRRVDKILRDVEEHSRDSSRRVEELLKDARDRGLPEELIKRLTDVVRKVKEDNKRLVEEARRVVEEVKREIKRLLEESREVVRRAERRLEELRR

SEQ ID NO: 10923 - protein, 185 aa, Artificial Sequence; identical to SEQ ID NO: 10922
  Synthetic

SEQ ID NO: 10924 - protein, 185 aa, Artificial Sequence
  Synthetic
SEIEDAERKLKKLLEDNTDMARRLIERLRKILEENKRHSERVKRELEEILKELEDLLRRKGTDEDVARKVEDIERRVRDLLRRNREHSRRVLEEVRKILEEAERHSRESSREVKRILDDLRAKGLPEELVKRVEDVVRKVDEDNKRLVEEVRRVVEEVRKTLEDSLRESERVVREVKKRLEDLKR

SEQ ID NO: 10925 - protein, 185 aa, Artificial Sequence; identical to SEQ ID NO: 10924
  Synthetic

SEQ ID NO: 10926 - protein, 178 aa, Artificial Sequence
  Synthetic
SEREKMEKVVREAKKDLDRSLKRVKEVAEEVKKELDRSLEEVKRVSEENKKEVDRIRKKGDVDDEILRRNKERSDRSLEEAKEITDRTKRKVEELLKTIEEVSRRSKRKVDRISEEVDRGKDVDTLVRRLEKILEENRRIVKEIEDRLRKLLEDNKRVVDEIIKRNEDSVRDVERRAK

SEQ ID NO: 10927 - protein, 178 aa, Artificial Sequence; identical to SEQ ID NO: 10926
  Synthetic

SEQ ID NO: 10928 - protein, 178 aa, Artificial Sequence
  Synthetic
SEREKVEEVVREAKERLDESVKRVEEVSRENKKEIDRLLEEVKKVIEEAKRRLEELRRRGLVDEKVVREVEEELKRLLEEIRKVVEENKEESDRSLKEVEDISRESKERVDRILKRVDDGSDVDEVLKELRRILRDNERMVKEVIERNRKSVEDLERIARRIIEEIERLLKELTDRAR

SEQ ID NO: 10929 - protein, 178 aa, Artificial Sequence; identical to SEQ ID NO: 10928
  Synthetic

SEQ ID NO: 10930 - protein, 176 aa, Artificial Sequence
  Synthetic
SEDEEVEEAADRHRRSVEDSSRDLKKVLDEDRRTVAESSRKLKEILREVEREVKRVEDDGSVSDEEVRRMLDELRKLVERHHRENERLLRESEKLVKKHHDDNERSLDEVRKLVEDREGDVEELKKRLKELSDESRKSLERVKRKLEETSRRSEESLRRVKKDAERLVREIEKRAK

SEQ ID NO: 10931 - protein, 176 aa, Artificial Sequence; identical to SEQ ID NO: 10930
  Synthetic

SEQ ID NO: 10932 - protein, 176 aa, Artificial Sequence
  Synthetic
SEDEKVKKVLDDVRRKAEDSSRRITEVLRRHEETVRRSSEKLKKLLDELREDADRVRRAGKVDEETVRKLVEDVDELVERHHRRNEESLKRVKELVEEHHKLNEDLLRRVEELVRAKKGDVKDLERKARDIVRKSEESLERVVRELERLSRDSERSLKKVKEDLERVVEEIRRRAD

SEQ ID NO: 10933 - protein, 176 aa, Artificial Sequence; identical to SEQ ID NO: 10932
  Synthetic

SEQ ID NO: 10934 - protein, 176 aa, Artificial Sequence
  Synthetic
SEDEEVEKVLREDEESVKRSSDEIRKLLEDHERTVRESSDELKKALDEVRKRLDELKRRGQVSEETVRELVRRVEELVKDHHRKNEESLKRAEDLVREHHKENERLLEESRELVRRREGDVEDLKREAERTSEESRRSLEEVRRRLEELSERSRESLKRVKDELKRVVEEIEERAR

SEQ ID NO: 10935 - protein, 176 aa, Artificial Sequence; identical to SEQ ID NO: 10934
  Synthetic

SEQ ID NO: 10936 - protein, 176 aa, Artificial Sequence
  Synthetic
SEDEEVKRVLDELRKRLKESSDRLREVLKRDKRTLEKSSEDIDRALKKVERALTEVLKEGKVDEEAVDRVLRDVRRLVREHHELNRKLLEESKKLVEDHHRLNEKLLRDVEELVRRREGDVKELLDTLRKLVEESEESLREVVERLDKTSEDSKESLRRVIETLDRLVKDIDEKAK

SEQ ID NO: 10937 - protein, 176 aa, Artificial Sequence; identical to SEQ ID NO: 10936
  Synthetic

SEQ ID NO: 10938 - protein, 185 aa, Artificial Sequence
  Synthetic
SELEKLKKEIDDLSRDLDRILKELKKRVEELTRRSEKVLEDLRKTLEDIVKTLEDLARGGLDKEELRRRIKEVKDRVEEELKRLTEEIRRVSEELERLLREVEKVVEKSKRDLDELLKRLEERGLPSELVKRAADVVEKHRRSLERLLRTVTKIVKDHHERNEEIVDEVRKVVERAKERLEEIRK

SEQ ID NO: 10939 - protein, 185 aa, Artificial Sequence; identical to SEQ ID NO: 10938
  Synthetic

SEQ ID NO: 10940 - protein, 185 aa, Artificial Sequence
  Synthetic
SEVDELRRRVKKLSDDSKRVLDELSRRLKELSERLAEIVKEVHRRNEELVDRLRRLKDKGEPKEDLDRMVRELLKTSKKILDEVTKRLRDSLEEVKKLLEDLRRLIEESSRTLEKLLEDLERRGLPSELVEEVKRVVEKHHEDNKRIVEALAEMVKDHKRTIDELRRRLEESVKDAEKKLRDVSR

SEQ ID NO: 10941 - protein, 185 aa, Artificial Sequence; identical to SEQ ID NO: 10940
  Synthetic

SEQ ID NO: 10942 - protein, 185 aa, Artificial Sequence
  Synthetic
SELEELERRLKELSDESRRVLRELLERLKELSKDLERILEDLKEKVKKIEKDLRELKKRGLPKEELKREIDKLVKDVRDLLRRAKKRLEDSLREVEDLLRELEKRITEVSDEVRKLLEDLRARGLPSDLVREVARVVKEHHDENEDIVRRVKEAVDEHRETIERLRRAVERVVKEVERRLKEEAR

SEQ ID NO: 10943 - protein, 185 aa, Artificial Sequence; identical to SEQ ID NO: 10942
  Synthetic

SEQ ID NO: 10944 - protein, 177 aa, Artificial Sequence
  Synthetic
SKDEELERVVKEVREVLDDVNREVTKVSDDVKKRLDELLEEVRRVSDEVRKRLDEVLRERDEEEIRKILEEVRETSKRLNEEIDRAIRTVDKRSKELNETNKRAVDEVKKTVDRLRKEVKDVEEAKRRLEKLVRDIRRLTEEHKKRHEDLVREVEEIVKKLKDDHRRLVEDIERAIR

SEQ ID NO: 10945 - protein, 177 aa, Artificial Sequence; identical to SEQ ID NO: 10944
  Synthetic

SEQ ID NO: 10946 - protein, 184 aa, Artificial Sequence
  Synthetic
SVLDELREKAKKNIKESEELLRRNEDHSRRDTERSKKLLEDLERRVKEVVREAERIKKKGMPEEEVRERLERLLRELREDIKRIIEELRRSLDENRKLSEEIIRRLKKSAEDLTRDVRELLKRLDKDVVRDLERVVKEVEDSNRKVADDSRRSTEDNKRKNEKVERDARELLKEIEEIVRRLEK

SEQ ID NO: 10947 - protein, 184 aa, Artificial Sequence; identical to SEQ ID NO: 10946
  Synthetic

SEQ ID NO: 10948 - protein, 184 aa, Artificial Sequence
  Synthetic
DSLERLREIVERIVREARRLLRENEEHSERDTREVERLLEEVERRLRRVVEEAEKIKKRGSPKEEAMKRLDDLLRRVKEEIDRIVRESKESVDRNRRLSEEIIKTLEKLIEDMEREVDKLVKRLEEDVVREARRIVDELRKEVKEIVERSRKSTEDNERRNRKVIEDLKRLVKELEDRIREIKK

SEQ ID NO: 10949 - protein, 184 aa, Artificial Sequence; identical to SEQ ID NO: 10948
  Synthetic

SEQ ID NO: 10950 - protein, 184 aa, Artificial Sequence
  Synthetic
DFEERLKEVLKDAERVVDENKKENKKVLDKAKKVVDENRDRNRRVLEEVEREIRRLIDEIRKDKDLVDRLRRVLEEIEEKHRDAVRRTEELLRKVKEDHERVVRESERLLEEIRRKLDDLRRKGLTKEVEEVLKEIKDILRESSKTSKDLVRRTEEILEESSRDSDRVAKESKKLLEEVKEEVR

SEQ ID NO: 10951 - protein, 184 aa, Artificial Sequence; identical to SEQ ID NO: 10950
  Synthetic

SEQ ID NO: 10952 - protein, 184 aa, Artificial Sequence
  Synthetic
SFEEKLDKVVREVEDKIRRLVKRNRDAVKRVADEIRKLKDRNEEVVDRAREKIKRLIDEIRRDEDLVRRLKKVLEEVERRHKELVRRAEKALEEIRRSHERNIRELERVLEEIKKEIEDVKRKRVTKEVEEVLTRLKEKLKRVEESSEKVVRDSERLLEKIKKLSKDVEDESRKLLERVEREVR

SEQ ID NO: 10953 - protein, 184 aa, Artificial Sequence; identical to SEQ ID NO: 10952
  Synthetic

SEQ ID NO: 10954 - protein, 183 aa, Artificial Sequence
  Synthetic
SEVERLLKELKELLEELKKKVDDVLKDLEELLKRLEDHTREVVKRSEDLLRELEEMKRRGDLREELLKRAVEESSKLVRDDRERLRKALEEVEKRIRDVKRELEKAVKEIEEKVRDLERKLKDKEEVVRELRRVLEEVRRTAERLLEKLDTVLKKVEDKIRELLKESTRVNKDAKREIDRLRK

SEQ ID NO: 10955 - protein, 183 aa, Artificial Sequence; identical to SEQ ID NO: 10954
  Synthetic

SEQ ID NO: 10956 - protein, 183 aa, Artificial Sequence
  Synthetic
SEVETILEDLRRLLEELKKHSDEVVKEIKDLLREIEKHTREVVKTSKKLLKELEELRKRGDLREEELERAVEESSKLVEDDEREIRKMLKRIEDLVRENKDKLRRAVEEVERKVRELKRRLKDKEELVRKIEKVLKEVRETIKKIAEDSDRVLEEAKEVAKRLKDESDRVNEEVRKRIEELKK

SEQ ID NO: 10957 - protein, 183 aa, Artificial Sequence; identical to SEQ ID NO: 10956
  Synthetic

SEQ ID NO: 10958 - protein, 183 aa, Artificial Sequence
  Synthetic
SDVDRVLEEIRKLLEDLKRHSEKVSEENEDLLRKNTELNKRVSEDNERLLEELKRLRERGDIREEDLKRALDRVRKTVETVKEENKRSLEDVRRTVETNKRKLERVVEEIKKLIEDAKRRLKDKEELKKKLDEVLERAKRTIDRLLETSDRSLEKVERDLRRLNEELDRSLERAERTIRELAK

SEQ ID NO: 10959 - protein, 183 aa, Artificial Sequence; identical to SEQ ID NO: 10958
  Synthetic

SEQ ID NO: 10960 - protein, 183 aa, Artificial Sequence
  Synthetic
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 10961 - protein, 183 aa, Artificial Sequence; identical to SEQ ID NO: 10960
  Synthetic

SEQ ID NO: 10962 - protein, 185 aa, Artificial Sequence
  Synthetic
SSIEKVKREVDEVIKTSKKSSEDSEKLVRDVEERLRKLVKDVRDRVKRVIEEMERLVRERKDKDVRKELRELVRDVEREVKRVEDEMEKLLRDIEEEVRRDIKRSRELVDEVRRRVADVIRKDGEESELVERLKEVLKRLEEVSEESERRNREVVRRLEDTARKLTEELRRVLTELRDVLRRLEK

SEQ ID NO: 10963 - protein, 185 aa, Artificial Sequence; identical to SEQ ID NO: 10962
  Synthetic

SEQ ID NO: 10964 - protein, 179 aa, Artificial Sequence
  Synthetic
KDEETLKRLLEKAKEVVDRLKDENEKVTRDNHESVKKAKDANKRSNEKSERVARDAIRRVREAKEVVDTAEKLLRDNHEHSRDTVKKARELNETSRRHSERIVEKIEEILEEVERTLRENRGDVRELAKKVEKAIRELEELSRENREAVKRISDEIKRLSDENAKDSERIIKEIDDRVR

SEQ ID NO: 10965 - protein, 179 aa, Artificial Sequence; identical to SEQ ID NO: 10964
  Synthetic

SEQ ID NO: 10966 - protein, 179 aa, Artificial Sequence
  Synthetic
SDDETVTKLLKEAEKVVRELTKRNKELLRKNHESVREAKKRNEDLSRKLEEVVRRLIEEIREREDVVRELEKLLEDAKRHSERIVREMEDLNRKSKKHSKETVDRLKDLLRKVEETARARKGDVKDLAKKIEDVIREMEELTRRNEKRIEEISDEIRRLSDTNRREIERIREELRRRAK

SEQ ID NO: 10967 - protein, 179 aa, Artificial Sequence; identical to SEQ ID NO: 10966
  Synthetic

SEQ ID NO: 10968 - protein, 179 aa, Artificial Sequence
  Synthetic
REDERLEEIARKIKKVVDELVERNKKLTEDNHESVRRAEKRNRELSRELEEVAKRAIERIRSDKKVVDEVKKLLEDAKKHSKEVIDELRRLNEESKRSSEDTIRRMRKLLRELEETVKAKKGDVEDIERKVEDIIRRLEDLSRRNEEKVRRISEEIKKLSKDNERTIKEIIKEIEERVK

SEQ ID NO: 10969 - protein, 179 aa, Artificial Sequence; identical to SEQ ID NO: 10968
  Synthetic

SEQ ID NO: 10970 - protein, 185 aa, Artificial Sequence
  Synthetic
DELDRLREEIKALIKESRESLKRLEEESRRLAEELRKLIRELKERIERIIEEARRLAKEIKDKDELRKRLEDLLRRVERLVEEVRRRLKEVVDRDRKLVEDNRRLLEELVRRVEELVRDLDAKITDDDVRKKVEDVLEEARRRITDDEDKTKKVHDESRRVVEEVRERVKRLLDKARTVVKEIEK

SEQ ID NO: 10971 - protein, 185 aa, Artificial Sequence; identical to SEQ ID NO: 10970
  Synthetic

SEQ ID NO: 10972 - protein, 185 aa, Artificial Sequence
  Synthetic
SEVEDLERKIEELIERAKRLVEELEERSRRLIRELEELSKKNEEDIERLIKEAKKLAEDIKDKETLRKLLDEVLKRVRDSVERSKEELERVVREDRELNKRVKDTLRKVLEDVERLVRDIEKKLTDEEMRRRVRELLKKAEEVVRRLEKDSDRVSKESEDMVRELLRRNEEALRKAEEVVREIKR

SEQ ID NO: 10973 - protein, 185 aa, Artificial Sequence; identical to SEQ ID NO: 10972
  Synthetic

SEQ ID NO: 10974 - protein, 185 aa, Artificial Sequence
  Synthetic
KDIDELRKRIETLIREAKKLVDDVRKRSEDLIERLKKLSEDNARDIERLLREAEDLARKIKDKEELERRLRKVLKEVEDSVRRSRKELEDVVREDEELNRRVKRALEEVLKTVEKLVRELEKKIDKREVKERVRRLLEKAADVVRRLIEESNRVSDDSRRVVKELLDRNKELLDRARKRVEEIRK

SEQ ID NO: 10975 - protein, 185 aa, Artificial Sequence; identical to SEQ ID NO: 10974
  Synthetic

SEQ ID NO: 10976 - protein, 185 aa, Artificial Sequence
  Synthetic
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 10977 - protein, 185 aa, Artificial Sequence; identical to SEQ ID NO: 10976
  Synthetic

SEQ ID NO: 10978 - protein, 176 aa, Artificial Sequence
  Synthetic
RKVEEVEKHSRESIKEIERLVEEVRKHSKDSIRRIEKLVEDVERHSRKVIEELERDKIDEKAKRLLEEDEKLVREIKERIKKLSRENEERVKDIARRIRELSKRNEETVRAIARKIDKDMVRRLEKILKEDKEVVKKAEEELRELLKEDREVVKRAEEELERLLKETEDVVRKVET

SEQ ID NO: 10979 - protein, 176 aa, Artificial Sequence; identical to SEQ ID NO: 10978
  Synthetic

SEQ ID NO: 10980 - protein, 176 aa, Artificial Sequence
  Synthetic
SALEEVKRHSEESIKAIEELVRRVEKHSRESSKRNEELIREVEDHSRRVIEELKRKKADREARELVKEDERRVKEVAEESRRLSKRNEELVRRIAREIERLSEENERLVKAVLRTLSEDVVRAAEKLLEEDRDAVRRAKEKLDELLKRDRDSSREAIRELERLLKETRDVLREVER

SEQ ID NO: 10981 - protein, 176 aa, Artificial Sequence; identical to SEQ ID NO: 10980
  Synthetic

SEQ ID NO: 10982 - protein, 184 aa, Artificial Sequence
  Synthetic
SEIEKILKDVDKKLKDSSRESEESVKESRDLLRESSERSERSVRETRKRVDDLLRLVDERKDEKLIREIEERARRIADKNRRIVEESKRLVEEAVRKNEDIVRKSAELVERIIRELEDLLRKRNEEDMKREIDKLVEKLKKVLRDNKRLHEKVIRELEEVVTRNEELHRRVIKEAKEVVDRVRK

SEQ ID NO: 10983 - protein, 184 aa, Artificial Sequence; identical to SEQ ID NO: 10982
  Synthetic

SEQ ID NO: 10984 - protein, 183 aa, Artificial Sequence
  Synthetic
SEVEEVLRRIEELLREDKRHVEEVVREIRELLKRNKDMVDEVLKRIEDLLREIDEARKRGDLREKAVEDLLRTVEELVRRAEEHTERLLERVERLLERNKEHSERVLEEVKRLIDDVKRKVKDVEEVIRKLDDILRKVKRVSEDNKRETDKVREEVAEVVKRSKDKLDKVRKDVKRVIERVRT

SEQ ID NO: 10985 - protein, 183 aa, Artificial Sequence; identical to SEQ ID NO: 10984
  Synthetic

SEQ ID NO: 10986 - protein, 183 aa, Artificial Sequence
  Synthetic
DEVEKAAEDVERRLREDEDHARKVVKRIRELLEEDTRTVDKVLREIEKLLKDITDLRRRGDIREEDIDRILRKVERDIERIEEHSKRVLEEVKRLVDRNRKHSKDLLDEVRERAKDVKRKVKDKKELTEKLDRLLERVEEVSKRNEDATRTVEKEVEEVVRRTKKKLDDILERVERVARELKR

SEQ ID NO: 10987 - protein, 183 aa, Artificial Sequence; identical to SEQ ID NO: 10986
  Synthetic

SEQ ID NO: 10988 - protein, 184 aa, Artificial Sequence
  Synthetic
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 10989 - protein, 184 aa, Artificial Sequence; identical to SEQ ID NO: 10988
  Synthetic

SEQ ID NO: 10990 - protein, 186 aa, Artificial Sequence
  Synthetic
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 10991 - protein, 186 aa, Artificial Sequence; identical to SEQ ID NO: 10990
  Synthetic

SEQ ID NO: 10992 - protein, 186 aa, Artificial Sequence
  Synthetic
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERVKEAIKELVKDVDRVMREVDRANRELTKTSKKVLEDVDRTNRRLVKEVRDVVERARK

SEQ ID NO: 10993 - protein, 186 aa, Artificial Sequence; identical to SEQ ID NO: 10992
  Synthetic

SEQ ID NO: 10994 - protein, 186 aa, Artificial Sequence
  Synthetic
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 10995 - protein, 186 aa, Artificial Sequence; identical to SEQ ID NO: 10994
  Synthetic

SEQ ID NO: 10996 - protein, 186 aa, Artificial Sequence
  Synthetic
DEIEELRKKAEEIIRRMEDLVRRNTETIKRSIETLKKLIDENRRRVRKIIETMKELKRRGGEDKETLLRRIDELLRRVEKHSKDSSDTVKRIHEENEKHSRDSSRKIEELLKTLRDLAEDVKRKIDKEEVKEAIERLVRRVEEVVRKVREENKRLNEESEEVVRRADRTNREILKRVRDAVREVRR

SEQ ID NO: 10997 - protein, 186 aa, Artificial Sequence; identical to SEQ ID NO: 10996
  Synthetic

SEQ ID NO: 10998 - protein, 181 aa, Artificial Sequence
  Synthetic
DAEDTLRDITRKVRKVLEEHRETIERTIRKNRESLERVKRAIEELIERSRRALEEVTRSGIEERVVKKAEDLVRRDEKTLRKVVDELKKLVDESEEINKDSLRKVEKLVRDAEDTLRKVPPRDEMLKRVEDIVKKLIEDLREMAKRNRDISKEVDDRLKKILDEVRKHSEEVIKRLKDEER

SEQ ID NO: 10999 - protein, 181 aa, Artificial Sequence; identical to SEQ ID NO: 10998
  Synthetic

SEQ ID NO: 11000 - protein, 181 aa, Artificial Sequence
  Synthetic
SAEETLERLAREVRKVLEEHARKIKKTIDDSRRVLEEHRKTIKRTIDESRKVIKDVRDDGIEEEAVKRADELLRRDEKLNKESLDTVRELVKRDVEENEKSLRDVERLVEEIKERLERVPPDEEVLRRVTEEVKELIERIERLLKENRKHSKKIIDRLRELLEENRRHSEELRKRLEDERR

SEQ ID NO: 11001 - protein, 181 aa, Artificial Sequence; identical to SEQ ID NO: 11000
  Synthetic

SEQ ID NO: 11002 - protein, 182 aa, Artificial Sequence
  Synthetic
SSLDEIRRKVREAIERLERLLEENRRKVEEVKRRNERLLDRNREVVDEVIKRLEEMRKDDEAVKRVRKILEEVRKHSRESTEESKKTVDEVRKHSEESSKRVKEILDELRKSAEDIERKNREKREVDEELKRLVEEVKKVVDDVRRENKRLLEEVERVSEEVKKTNEKLLERVKRVVEEAER

SEQ ID NO: 11003 - protein, 182 aa, Artificial Sequence; identical to SEQ ID NO: 11002
  Synthetic

SEQ ID NO: 11004 - protein, 182 aa, Artificial Sequence
  Synthetic
SSLDTAREHTRDVIKKIDDILRRNEKLVDDVIRELERLLRENAEVVERVIDRLRRLKKDKEALEEVEKILREVEKHSRDSTREVRRILREVEEHSRKLLEEVKKILDDNRKLIEDIKRKNREKREVVEELKELRKRSEEVVDRAEKALRRSVRKAEKVVEEVERANKRLLERVKKVVDDMRR

SEQ ID NO: 11005 - protein, 182 aa, Artificial Sequence; identical to SEQ ID NO: 11004
  Synthetic

SEQ ID NO: 11006 - protein, 185 aa, Artificial Sequence
  Synthetic
EVRERVKEVIERSEKSVRELERIVEELARRLRESVEDLERKIRELSKELRRVVEELVRTRGESSEEIKKVEETVREVDKELKELVERVREENERAIKRMRELLERVERENRRVVKEAKDLVDKRGDEEVVRRIEELLKEVHKENKRVADELKKLVEDLHDRNRRVKEEVKRRVDEVRRKAEEVAR

SEQ ID NO: 11007 - protein, 185 aa, Artificial Sequence; identical to SEQ ID NO: 11006
  Synthetic

SEQ ID NO: 11008 - protein, 185 aa, Artificial Sequence
  Synthetic
EVDERIRRLVEESRKSVEDLARIVDELVERLRRSVRDLEEKSKRNKEELEKVLRDLARTRGDKSEKVKRIADIIRRVEEESEKLIDRVRKENKKVIEDMRRLIRKVEEENKRVIDDLRRLVKERGTEEVVERVERLIEKVHRDNRRVAEKLREDVRRVHEDNKDVARKSHKLVKEVRDTVREVRR

SEQ ID NO: 11009 - protein, 185 aa, Artificial Sequence; identical to SEQ ID NO: 11008
  Synthetic

SEQ ID NO: 11010 - protein, 178 aa, Artificial Sequence
  Synthetic
DVLKEVEEDSRRNHERNRRVAEKVTDDSRRNVKRLEEVAEEIKDDSRKNKERLDKLRGDDEVVRRLAENVKRSARKLEEELKRLTRNVERTVKEVEEIIRRSRKNVDDTRKKLETEITDKEIEKILRDVLKENEDSLRELKEILERLLEENRKAVEKLKRILEELLRRNDEMLKRVRT

SEQ ID NO: 11011 - protein, 178 aa, Artificial Sequence; identical to SEQ ID NO: 11010
  Synthetic

SEQ ID NO: 11012 - protein, 178 aa, Artificial Sequence
  Synthetic
SVDEEVRRDSKKNKEDLDRVAEKVKRDSEENMRRLEEVARKVTEDVKRNKKTLEDLRGDEDVLRRLKENVERSREELEEIIERLERNVRRTVEEVERIVKKLRENVERTKKEVEERITDEEIRRILKELLERNERALEELKKRLRKVLEENKTVLEELRRRLEELLRRNKRMVDEARR

SEQ ID NO: 11013 - protein, 178 aa, Artificial Sequence; identical to SEQ ID NO: 11012
  Synthetic

SEQ ID NO: 11014 - protein, 179 aa, Artificial Sequence
  Synthetic
DEVEKLVEDVARVNKKSLDEVRRLLEELEKVSRDHRREVERSLREAEKVLEDLKREAEKTRDKDTLKKLLDELKRILEEIKDRHRRLTEHNKKVLDEVRETIRRIIERNKEVLDELLKRIGEEDDEIRKVKKHNEDVLRKVRKILKDAERISKRALDENERILKEVEKRVRDVIRELER

SEQ ID NO: 11015 - protein, 179 aa, Artificial Sequence; identical to SEQ ID NO: 11014
  Synthetic

SEQ ID NO: 11016 - protein, 179 aa, Artificial Sequence
  Synthetic
DEVDDVVRRLEEENRKSEERAKDTLRKAKKVLDELKKRVKESEDRVKEVLDDVEERVRRTTDKETLRKLLEELRKILKKVEEDHKRLTKTLRDLLKRVKEEHDKLTDENRKLLEEVLRRLGKDDKRVRDALRHNEDVLRRNDEIVDELRKRVEDVLKKNEDDVRRVAEEVRRVIEELRK

SEQ ID NO: 11017 - protein, 179 aa, Artificial Sequence; identical to SEQ ID NO: 11016
  Synthetic

SEQ ID NO: 11018 - protein, 179 aa, Artificial Sequence
  Synthetic
DRVEEVVKRAKDENRKSEEEVKKSLKDLEDLSREHEKRIRDLLKEVKEILDRIREEVEKKRDRKTLEEIVKKLADVLKRVDDEVKELLKHNKEMLEELRKRHKKLTKDNRDVLEELRREIGEEDDEIRKLERHNEEVLKKNETIARDLEKRSREVVKRLEDILRKVEREVEKALEEVRT

SEQ ID NO: 11019 - protein, 179 aa, Artificial Sequence; identical to SEQ ID NO: 11018
  Synthetic

SEQ ID NO: 11020 - protein, 182 aa, Artificial Sequence
  Synthetic
SVEEELRKLKEEIDRVLEENKKIIDDIRKELDDVNRENKKIIDDIRKEIDDVLERVRGEDKDRMREIEEVARRAKEKLDRLLEKSTRLIEKLKEELDDLVRRSAELAKEMKDRLKELKDNNVDEKDLKKLLEEVRELLERSRRASEELLREVKRLLDESRKESKRLADDVRRLLEELERRTK

SEQ ID NO: 11021 - protein, 182 aa, Artificial Sequence; identical to SEQ ID NO: 11020
  Synthetic

SEQ ID NO: 11022 - protein, 182 aa, Artificial Sequence
  Synthetic
SVEDIIRKIEKELDDVNRENEEIIRRIKKELDDVNRRNEKIARDSKKRVDDVLRKVTGEDKDKVDEIRRIAEEAKRSTDELLKESTELIERLKKRLEELLRESSRLIEELKKRLEDLLRNNVPEEVVKKIREEVRKLLEESKRRSDELAKEVRELLKRSEDKSRRNLEEVEKLLKEVEDRTR

SEQ ID NO: 11023 - protein, 182 aa, Artificial Sequence; identical to SEQ ID NO: 11022
  Synthetic

SEQ ID NO: 11024 - protein, 179 aa, Artificial Sequence
  Synthetic
KDLEDVLDKVRKDLERSKKHSDDVVKTIRELLKESEKHSEELVKRVEKLLEELRRMTTRGDAREEKVDRVLEEVDKLLKENRDESRRVKDEVRKLAKRNRDVSKELLDRVKEEIERLRRRGVDESILRELERRVKKVVEENDEITRRVEREVEKVDKKNKDITDTLRTRVKKAVDEARK

SEQ ID NO: 11025 - protein, 179 aa, Artificial Sequence; identical to SEQ ID NO: 11024
  Synthetic

SEQ ID NO: 11026 - protein, 190 aa, Artificial Sequence
  Synthetic
SDIERLLREVEKVIRDSEEETRKLLEEVEKALKDSRDSSEDVKRKVDDILRKLRELRRRNELPKEELTRRAEEEVRKIDRLLEENYKRSKEVVDEIKKKLDEVIKRSDELVRRLEEELRRVLERVKEREDMERIERLLREVRKRVEEAAKRNKDVIKEIEERVRTVHDENRRLLEEIAKRVRDVLEEVRT

SEQ ID NO: 11027 - protein, 190 aa, Artificial Sequence; identical to SEQ ID NO: 11026
  Synthetic

SEQ ID NO: 11028 - protein, 171 aa, Artificial Sequence
  Synthetic
KVEEELEKEVRRALEESKRLLDRLTEHSKRVLDELRELLERVERDVRRVLEELKRERDDEKATRIIEEVRKRLKDVVDRIRELVERNKRELDKAVKDSTRLVEEIKELLREKLEDKDVVDRLEKELKKVNDEARKRIEELLRESDRVLEEVKKKMRELERELKKVLKEVRD

SEQ ID NO: 11029 - protein, 171 aa, Artificial Sequence; identical to SEQ ID NO: 11028
  Synthetic

SEQ ID NO: 11030 - protein, 171 aa, Artificial Sequence
  Synthetic
DEVEDADRKVRTVLEDLRRRLEELKKHSDDVSRRNEKLLRELKEHSDRLVEEIKRDKKVERVEELVRRNEKKLEDAVREVEKTVRDNKEKLKRVVEKIEEDIRRVEEELKRDVRDKRVVDELLKKLRDVLEEVRRTVDELVKRSEESLRRAREVIRRLLEKTREVLEEVRT

SEQ ID NO: 11031 - protein, 171 aa, Artificial Sequence; identical to SEQ ID NO: 11030
  Synthetic

SEQ ID NO: 11032 - protein, 173 aa, Artificial Sequence
  Synthetic
STEDVLRKIKEDVKRVIDDNRRILDEVRRTSKRVLDDLRRNLKHIAEEVERVLREVDKEEVVRELKKILDEIREEHRRLIRTNEKVLEDIERDHRRISEELKRILDEVDELLRAGKPSKELLEKAKRVVDEIKRLAEESLKRLEDLSRDHKRRAKELNDEIRKVVDELRKRAT

SEQ ID NO: 11033 - protein, 173 aa, Artificial Sequence; identical to SEQ ID NO: 11032
  Synthetic

SEQ ID NO: 11034 - protein, 173 aa, Artificial Sequence
  Synthetic
SLEEVLDEIRKLVERALRDLERNLRHVTRTSEEVLRRNEEILRRIEEKVDRVVRNVKTEEVVREMRKILKELRERHKRLTETNREALKRIAERHKRLIEEVKRILDEVAEVIKKGEPSKELLDEIRRVLEEVKRRVEELNKELKDLSDKHKEKAKRTDETITDVLRKAEERER

SEQ ID NO: 11035 - protein, 173 aa, Artificial Sequence; identical to SEQ ID NO: 11034
  Synthetic

SEQ ID NO: 11036 - protein, 180 aa, Artificial Sequence
  Synthetic
SVEELLREVAELVKRVDEDLRRLLEEVRRSNEEVIRRLEEILKRIEEENRKVVEELRRRGVSEDLVRESKRLVDESRRVIEKLVKESRDSVERTRETVDRLREELKRLVEEIKKMVEDNSSEETVKRLLDELRELLERLKRTIEELLKRNRDLLRDAEEKARRLLEENRKLLKKARDTAT

SEQ ID NO: 11037 - protein, 180 aa, Artificial Sequence; identical to SEQ ID NO: 11036
  Synthetic

SEQ ID NO: 11038 - protein, 180 aa, Artificial Sequence
  Synthetic
SLEELVRDVERLVKESIEELERVVEDVRRLNTELKEKLERVAREIKKRNDDLVRELRTAGTEDRLIKESRELVRRSEDTVRRLIERSEEIARRTEKNVKRHVKENKDVVEKIREVVTKNSSEEVIDRLRKELEDIIRESRKNLEDLLRENKRLVEEVERTLRELLRTNKELLERIREEVR

SEQ ID NO: 11039 - protein, 180 aa, Artificial Sequence; identical to SEQ ID NO: 11038
  Synthetic

SEQ ID NO: 11040 - protein, 180 aa, Artificial Sequence
  Synthetic
SVEEMLEKIRRRATESVKRLRKILKEIKERNEKAIRDDRRLLEEIERRIREVVKRLRDAGVSEDLVRRLEEILKRVKEAVEKSVRESKKLVDDTKRNVEKHIEDNKRVVDRVEEAVRRNSSEETVKRLEEEVEKIVRDSERNAREMLERNRRLIEESKKRTKDLLKEVEDEVRKLEEEVR

SEQ ID NO: 11041 - protein, 180 aa, Artificial Sequence; identical to SEQ ID NO: 11040
  Synthetic

SEQ ID NO: 11042 - protein, 184 aa, Artificial Sequence
  Synthetic
SVEEIVRRIREELKKVEEDSERIVRTVEDVLRKVLETVERIVRESEKRSRDAVRRIREKLSDKEKLKEIEDEARKSVEELRKLLEDVERRVRELVKKARDLHRRSKEVVDEIRKKVEKLLKDGGSDEVATRLLKEVKEELDRLREENERLLRELKETVEKLKRDAEKVVEDDERLVRELEKRVD

SEQ ID NO: 11043 - protein, 184 aa, Artificial Sequence; identical to SEQ ID NO: 11042
  Synthetic

SEQ ID NO: 11044 - protein, 183 aa, Artificial Sequence
  Synthetic
DIEELLEEIRRRAEEAHRRNEDLLRKIKELVKKARKDNEKVVRDIERRLREVLERVRKKITDDRLREEIERLVDEVRKLLEDVKRESEKLVREAEKLLKDLERRSKEVLDRIEKLLRDVSRSTDREEVKEVLKRVEDLLRTSEEETKELLKRVEDELRRSKEDSEDVLRKVEELLERIDRRVT

SEQ ID NO: 11045 - protein, 183 aa, Artificial Sequence; identical to SEQ ID NO: 11044
  Synthetic

SEQ ID NO: 11046 - protein, 182 aa, Artificial Sequence
  Synthetic
KEIEEILEEVKRLLDKLKEDSDRILERVRELLERSKEKSREILKRVEDLLRELEKLVRDDRDEDTLRDLLRELEERVKELLKELDKTSKDVLDEVRKLLEENNRLLDELTKRVDELLRRISEDEELRRVLEEIRRLLEEVRRKIEEASRRLKEDADRVHRKNEEILKRIEELIEEVKRRVEK

SEQ ID NO: 11047 - protein, 182 aa, Artificial Sequence; identical to SEQ ID NO: 11046
  Synthetic

SEQ ID NO: 11048 - protein, 182 aa, Artificial Sequence
  Synthetic
KEVEDILREVDKLLKESKRKSEEALKRVKRLLDELKKTSKRILREVEKLLERLRRLKKDDRDKDRLREELKKLLKTVEDLLRDNDRLLREVEERAKKILKDVRETSERLLRTVKKLLEEIPKDKDLKKIVDDIRRKIDKVDKDNERLIKELEDRVRKAREDIRDISRRIRELVKRVVDEVEK

SEQ ID NO: 11049 - protein, 182 aa, Artificial Sequence; identical to SEQ ID NO: 11048
  Synthetic

SEQ ID NO: 11050 - protein, 182 aa, Artificial Sequence
  Synthetic
DEVETILRDVKRLLEESRRESERVLEEVRRLIEELKKRSRDIMEEVKKLLEELREIVRRDRDKETLRKLLEELEREVRKLLKRNNELLEELLRRARKLIEEVERTSRELFKTVEELVRRIEPDEEARRLLEEADRLVREVDKENEDILRRIEESVREVEERIRRISRAIEESIRRVKEEVER

SEQ ID NO: 11051 - protein, 182 aa, Artificial Sequence; identical to SEQ ID NO: 11050
  Synthetic

SEQ ID NO: 11052 - protein, 182 aa, Artificial Sequence
  Synthetic
KEVEDLLREIERLLKESRERTKKVEEDVKRLLDESRKTSEDVLREVERLIRELEKIVREDRDKDRLEELLRRLKETAKELLRKVEELSRRLKETVDKLLRDLEEDSKKLLEDVKELLDRIPPDDKARKLVEEAKRRLDTVNEENKDVVRKIKEDLERVDEENRDVLRRIKRIVERVEEEVRR

SEQ ID NO: 11053 - protein, 182 aa, Artificial Sequence; identical to SEQ ID NO: 11052
  Synthetic

SEQ ID NO: 11054 - protein, 180 aa, Artificial Sequence
  Synthetic
DEAERLLRRIEEILKRSKDVSDKLLEDNEKLVRDVKRRLDEHLRKNREALKKLREELKRNRDERDLERLIRESKKLLDDSEKNIRKLVKESDRLLEETERENRRLIKELRDIVKEIAERIGKDDDEVVRRIEELVKKLEEDNKRVVEEIKKLNDDLRREVKRVLDEARKLNKEIVDELRK

SEQ ID NO: 11055 - protein, 180 aa, Artificial Sequence; identical to SEQ ID NO: 11054
  Synthetic

SEQ ID NO: 11056 - protein, 180 aa, Artificial Sequence
  Synthetic
SEVDELRRRVEEVERRSEENSRKHLEDNEKMVDDLRKNLERHLKENKELVERVRRVVEDNTSEELLKRLIDESEDLVRRSEENIRDMIRRSRELAKRSKDNNEEVIRRLKKLIEDIVRTIGKDVDRVVEDLKRRADELVRRNERAAEEVRRLNEEVVEDLKRVVKEVKDLNDELVKEVRR

SEQ ID NO: 11057 - protein, 180 aa, Artificial Sequence; identical to SEQ ID NO: 11056
  Synthetic

SEQ ID NO: 11058 - protein, 183 aa, Artificial Sequence
  Synthetic
SVEEVLKEIEKEHRRSEEEVKDVLRKARKINEEVERRVKEVVDRIRETIARVRKEVKDRNGERLEELERRLERILREVERLAKELIDRLRRTVEDSERLVKRLVEENRRVLEDVRRLVRELDKVKDVLKKLLDRSRRLVEKVRDDLRKAEEKNRRVAEEIKETLKRMEDRVREELKEIKKKAK

SEQ ID NO: 11059 - protein, 183 aa, Artificial Sequence; identical to SEQ ID NO: 11058
  Synthetic

SEQ ID NO: 11060 - protein, 183 aa, Artificial Sequence
  Synthetic
SVEEVLKEIEDLHKKSIDEVREVLKEAEDLNRRAVKEVEDALRESEELNRRVTKEVRDENGKDLEELEKELRENVRRVRETVRDLKRKLEETVRESREDVERLVRENERVVKEVRDLVRKLDKVKEVLDRLLEKSEKLARDVRKRLKEVLDKNRKVVEEIRKVLEELLRHSERKLERIRERLK

SEQ ID NO: 11061 - protein, 183 aa, Artificial Sequence; identical to SEQ ID NO: 11060
  Synthetic

SEQ ID NO: 11062 - protein, 184 aa, Artificial Sequence
  Synthetic
DVEDVVRELKKLLDEITRRSEEVVKRLHDRNEEAKEEVRRVVKEVRERLKKVVDDVRRELKDSEKLERVEEKIEEAVRRLDEELRRLEEELDRSSDRLRKLHETTRRLIEEAKRRIKELLDRNGDREVLRKLKKEIKDLLDRIEELNKKVLDESEKLIKEIREDLRRVKEEIKEELKRIREEVR

SEQ ID NO: 11063 - protein, 184 aa, Artificial Sequence; identical to SEQ ID NO: 11062
  Synthetic

SEQ ID NO: 11064 - protein, 184 aa, Artificial Sequence
  Synthetic
SVEEVVRRIKEKLETVVDESRRVVKDLHDKNKEIVEESRKVLRESEKVDEDVVEEVRRRLGNSEKLREAEKKIEKSTEENRRLHKKTADEIKESSERLRELHERTRREIEKAMERVERVLRKGGSDEELEKLLREIEDLLRKIRKLNKEVLDRSRKLLEDIRRLNKRALERNRKIAKEIRDEVK

SEQ ID NO: 11065 - protein, 184 aa, Artificial Sequence; identical to SEQ ID NO: 11064
  Synthetic

SEQ ID NO: 11066 - protein, 172 aa, Artificial Sequence
  Synthetic
DSAEKLERDVRRALERIRKRLEENDRRVEEILERIRRRLREDLETSREVLERLRKENVREDEVRDLARRVKENTDRTLEEVKRLIEEAKKHSKDVLDDVKRDAERLKEEIRRVPVDESVIEKLERLLDELLEEVKRVVETSEKKLDELLEEVKRVVEESKKALDDLLREVEK

SEQ ID NO: 11067 - protein, 172 aa, Artificial Sequence; identical to SEQ ID NO: 11066
  Synthetic

SEQ ID NO: 11068 - protein, 183 aa, Artificial Sequence
  Synthetic
DKVDEVLRRVRELLERLRKLLEDNKKTTDELLEELRRILKEDEDRTRKLLKRLRDVKREEIKDKDTLTKTAEEIAKRLEDSNRTSKEIVERIVKELRESNERLERIADEIRERVERLLKKAKEEGVDDRMMKRLKEELERIRKKVREVLERSSRAVERIEREVDEVVKRSSDTVKRILDEVRK

SEQ ID NO: 11069 - protein, 183 aa, Artificial Sequence; identical to SEQ ID NO: 11068
  Synthetic

SEQ ID NO: 11070 - protein, 183 aa, Artificial Sequence
  Synthetic
SEAERVRRRVEELLRELREHSRRVLEEVKRLLEKLREDNERSLRRIKKLLDELRRVRERDLQDKDELRKLLRELKEDVKRIIEENDKIVKKLLEDAERLARENEEMLKRLKEEAERLIRDLRRKGVEEEVLRDIERRVREIEKEVREVTRAIEESVKKIEKESRDVLRAIAETIRKIEEEVKK

SEQ ID NO: 11071 - protein, 183 aa, Artificial Sequence; identical to SEQ ID NO: 11070
  Synthetic

SEQ ID NO: 11072 - protein, 183 aa, Artificial Sequence
  Synthetic
DEAEEVLKTVKKLLDDLRRRNEDSLRRIEELLKRLRDHSKRVLEEVRRLLEELRRVKERDLKDKEELERLLERVLREAERLLKENEDLLEELERRVRDILRRNREMVEELRRRAKRLLERLRERGVREEVLRKIKKDVEKIVRDSERVIKTIEEKIDRIKKEVKRVTDEIRKRVEEIAEEVRR

SEQ ID NO: 11073 - protein, 183 aa, Artificial Sequence; identical to SEQ ID NO: 11072
  Synthetic

SEQ ID NO: 11074 - protein, 181 aa, Artificial Sequence
  Synthetic
SELEDVLRRSRDLLRRLKELLERLLETVRKLIEEAKELLKKILEDSRKLIREVEEMVRRGDIDDDTLRRIKEENRRLNKELRDRVKKLEEDIRRLIKKLEDEVRKAKEDNERLLKKLRDDEDSEEIRRVIKESKDLSRALEETVRRVERKIEDLLRRIKEEAERVIKESEKLIEDAERATK

SEQ ID NO: 11075 - protein, 181 aa, Artificial Sequence; identical to SEQ ID NO: 11074
  Synthetic

SEQ ID NO: 11076 - protein, 177 aa, Artificial Sequence
  Synthetic
DEDEEVERELKKIKDKSKKVLDKSRKTIDELRKEVERTLRRWTKRSKDLLDKVEAAKRRNVREEELKRLVDEWRKEVDKVREEVERLKKKLKDELRRLEREHRELVREIEEELKRLAERGVPEEVLRKVDTILKEIKRRNEKVLKELRDIIDDLAKKLDEVLRRDEELAKKVTEELK

SEQ ID NO: 11077 - protein, 177 aa, Artificial Sequence; identical to SEQ ID NO: 11076
  Synthetic

SEQ ID NO: 11078 - protein, 177 aa, Artificial Sequence
  Synthetic
SEDEDARRTLREMLEESRKHLKEWEDTSRELEKKSREVLKETRKTIAKLADRVRKAKENNVDEKSLEDLTREAEETLRKLAEDHKRLVKEWREVIERLRKTVEDLVRKIREILKRLAEKGVSEEVLEDIRRKVEKLEEDNRRVMKKDEDAVRRVEEENRKVLKELKERIDRLAEELK

SEQ ID NO: 11079 - protein, 177 aa, Artificial Sequence; identical to SEQ ID NO: 11078
  Synthetic

SEQ ID NO: 11080 - protein, 177 aa, Artificial Sequence
  Synthetic
DEDREAEETIKRLLDRSRKTLEESRKTSEDLRRKSEKVLRETRKSLEDSLRKVREMKKRNVSEELLEKLRKELEDNLRRLERKHRELVKEWRKVTEDLERKHRELIKEIERILKELREKGLDEKVLRDLEEIVRRAAKANKDVLDEDRRVMEEAREENKRVIDEYRKILKEATDELR

SEQ ID NO: 11081 - protein, 177 aa, Artificial Sequence; identical to SEQ ID NO: 11080
  Synthetic

SEQ ID NO: 11082 - protein, 177 aa, Artificial Sequence
  Synthetic
SEDEEAKKTLDELLKKAEELVKKIKETSERLLRKSDKLLEETKKTIKELDDEVKEVKKRNVSEEDLKRLAEKLREILKRLEDRHRKLVEEWEKVTRELAKELEDLRREVKRILDELRKRGVSEEVLRRIEEIIRRVTELLKKVLKEDREVVEEARKKNEEVLDRLKKIIEEAEERLR

SEQ ID NO: 11083 - protein, 177 aa, Artificial Sequence; identical to SEQ ID NO: 11082
  Synthetic

SEQ ID NO: 11084 - protein, 177 aa, Artificial Sequence
  Synthetic
DEDEKAKRMLEEAEKKSKKHVDEVRETSKRLLEESKKLLEETDRSLRKSLERVDRVKKNNVDEKDLKRLLEELEKNLRDLARRHEKLKRDWEEVTRRLEETAKKLVEEIRRILEELRKEGVDKRVLDDIKTKVERLEERNKKVLDDDREMVTRAEEENRRVIKKYRDILEEARKRLK

SEQ ID NO: 11085 - protein, 177 aa, Artificial Sequence; identical to SEQ ID NO: 11084
  Synthetic

SEQ ID NO: 11086 - protein, 177 aa, Artificial Sequence
  Synthetic
SEDEDLDRVAEKLKREHKKSVEEIKRVLKRADEESKKLVRDTERVIEEIKREVEEARRRNIDEELVERLKKKIEDILRTLEERHKKLIKELREILKRLSDESRRLAEETEKVLEDLERKGVDEEVLKKLREIVRRVKEENRKVNEEVEKRLRELEEENKKVIEDLKKTVEELVERLR

SEQ ID NO: 11087 - protein, 177 aa, Artificial Sequence; identical to SEQ ID NO: 11086
  Synthetic

SEQ ID NO: 11088 - protein, 188 aa, Artificial Sequence
  Synthetic
DDLEDIKRRLDEMREEVKRHVKRLKEVAKEIEDEHKETVRRNKEVAKKLAREIDDARRRNRNEEELERIIRRLRETLKRLTDRNKEVIDRSREKLKRLKERSEETIRRLRRKLEEIRKDIERVKKAGADKDKVDKVLREVTEEVKRLEEEIKKVDKEIEEIVRRVERENEEVVRDIARIVEELERKLR

SEQ ID NO: 11089 - protein, 188 aa, Artificial Sequence; identical to SEQ ID NO: 11088
  Synthetic

SEQ ID NO: 11090 - protein, 188 aa, Artificial Sequence
  Synthetic
RELEEVIKRIEKTVTDNERANKESVDRIREIVDRLKKEIEESVRRMRDSVKKLEEEIRRRGASEEVKETVERLMRELEKHIRESEREIEKLAREAEEHIKRSNERVKKSVKELRDLLETVKRLKERGNEEELIRRLEKVLKEHHKRVEEIVKENEDVARDLDRRIKEIVERNRKVLEDLRRRIKELKK

SEQ ID NO: 11091 - protein, 188 aa, Artificial Sequence; identical to SEQ ID NO: 11090
  Synthetic

SEQ ID NO: 11092 - protein, 179 aa, Artificial Sequence
  Synthetic
SEIEDALRRAERVSRESAKKLEDALRKYEKVSRDLKRRLDEVLKRYEDTSRKIAKDLRDNGVDEETVRRLVETSKEDLKRLERELRELARRSDEDLKRLDRELKELVERSKELLKEVERRNIDEETIERLIEKNKREVDKLLKKIEEVIKRNKDEVDKLLKKIEEVIDRNRRAMEEIAR

SEQ ID NO: 11093 - protein, 179 aa, Artificial Sequence; identical to SEQ ID NO: 11092
  Synthetic

SEQ ID NO: 11094 - protein, 184 aa, Artificial Sequence
  Synthetic
SIEDELRKIVEDIEREIKKLEDDLRRVSKDHRDEVRRILEKLKEHIERLEEDADRLKKAKEPKEKLDERVERLKEHSKKVVKEARDRLRELEERNRKIDRELEEELKKLEKRVREEVKKVRTRKDTETVREMIKRLEELVRRVKRRIEDVIRRNREVVDESRRRIEKAIEDNERVLKKIEEEVK

SEQ ID NO: 11095 - protein, 184 aa, Artificial Sequence; identical to SEQ ID NO: 11094
  Synthetic

SEQ ID NO: 11096 - protein, 184 aa, Artificial Sequence
  Synthetic
SIEEEIKKVVKELEDEARKLLKKIEEHSEDLKRKLEDLLRKVEDHIRRLREEIERIKRENLDEERVKRALDKLEESSRRVVEELKKKVKELRDSSEELKKEVRKKVEELRDRVEKEIEEVKKRKKTETVKKAIKELRDLVDKIEEDLKRVLDENERVLREIARKIDEIIEKNERELRRVLEEIR

SEQ ID NO: 11097 - protein, 184 aa, Artificial Sequence; identical to SEQ ID NO: 11096
  Synthetic

SEQ ID NO: 11098 - protein, 172 aa, Artificial Sequence
  Synthetic
DEAEELERRLREEVKRVETDLRRTTRELEREVEEVRRRLEKTSRENNDRSEKAEREDSRDKRLEEELKRESDRLEKEHRDLIKKLRDSLEKMRRDHKRLIDELRKRLEDLERKIKDKEVVDRLREIITDLVRKLEENVKRLEEIIKRLEEELKRNVDRLRENSKRLAERLRT

SEQ ID NO: 11099 - protein, 172 aa, Artificial Sequence; identical to SEQ ID NO: 11098
  Synthetic

SEQ ID NO: 11100 - protein, 172 aa, Artificial Sequence
  Synthetic
SEAEKVLEEVRRLIEEIRRRLKETTDDVRRLVRELKEEAKRLLEEDKRLVDDLRRRNAKDETLTRRLRRHAEETKKTIEELIRALEEALDRLRKRHEELLRELDETLRRLEERIEVKEVVDKIRKVAEELKKELKDNADRVRRIAERLKEELKRVAEKSDRIIRTLEEELKR

SEQ ID NO: 11101 - protein, 172 aa, Artificial Sequence; identical to SEQ ID NO: 11100
  Synthetic

SEQ ID NO: 11102 - protein, 172 aa, Artificial Sequence
  Synthetic
SEVERLVREVEKDLERERRRLEKTVRDSERLVRELKETLDRLLKRDKDVVDDARRKNSKDERLRKRLEEHLRRTKEELRRLKEENRDVARKLREEHKRTEERLDERLEDLERKISDKSVVDRLREIVKELKDRNRKVVKELEDIHRDSDRELDDVVRRSDEIIRELVERLKT

SEQ ID NO: 11103 - protein, 172 aa, Artificial Sequence; identical to SEQ ID NO: 11102
  Synthetic

SEQ ID NO: 11104 - protein, 181 aa, Artificial Sequence
  Synthetic
DLEEIIKTIREINERLNRRVREVEERLRRTSRELEERIRDVVRKLREINDRLRKEVEARGLDKGKLEEAERESERTERENEKLLKRIEDSLRKSEEEIRRVIKKLEDESRELEKRLEDLLREGRVDERLVRENEEAVKRLTKELDDLLRKNEELIRRLEEEAKRVLERNEKIARDVREELK

SEQ ID NO: 11105 - protein, 181 aa, Artificial Sequence; identical to SEQ ID NO: 11104
  Synthetic

SEQ ID NO: 11106 - protein, 181 aa, Artificial Sequence
  Synthetic
DLEEIIRKIREINRELNETVKKVVRELEEDTRRVKRRIEEIVKELERTTRELDKRVKDSGLDKSELDRIRKELRDSEEELKELLKEIEERLRRSNDKLRRVEEKIRKRSEELKKRLEEALREGRVDEKLVEDNRKEVRDLEEEARKLLRENHELTKRLIEEAERILKKNEELIRKIEEEER

SEQ ID NO: 11107 - protein, 181 aa, Artificial Sequence; identical to SEQ ID NO: 11106
  Synthetic

SEQ ID NO: 11108 - protein, 181 aa, Artificial Sequence
  Synthetic
SLEELLEELERILREVEERIKEVVRRLEEDTRRVEEEIRRIVEELKRINRELEELVRRTGLDKSELDRLRRESEETEKRNRRLEEEIKKRLEESNRRIKELLDRAKERLKKIADDIKKVFDDGRVDERLVKEVRDTVKELEDELKELLDRNHELTRRLEEEAKRLLEENKKRADDVKEELR

SEQ ID NO: 11109 - protein, 181 aa, Artificial Sequence; identical to SEQ ID NO: 11108
  Synthetic

SEQ ID NO: 11110 - protein, 184 aa, Artificial Sequence
  Synthetic
RLDEVIRRVEEVIRDVERRVAEVVKRLRDSSKTVKEKIETVIRRNKEINKRLEDLIRESGVPEEVKRKAEEVLERSDRENEKLLREADRRLRESEKKLDDLRKEIEDTVRRLRERLKDVARRGVPEDDLRRTLEEVKRTIDKLKEDAERLLEENKDLIRRLEEELKESSKRNDTLVKKLKKELK

SEQ ID NO: 11111 - protein, 184 aa, Artificial Sequence; identical to SEQ ID NO: 11110
  Synthetic

SEQ ID NO: 11112 - protein, 182 aa, Artificial Sequence
  Synthetic
REMEEALKRNNELSERLRRELKRVLEENHRLSRDLEKKLRDLLERVRELVERLDRMKEEGKADEDTLDKLRREVEDLLRRLEELLREIKRKSEELLERLKRLLDELRKESRKLLEDLRRKSDTEEVRRVLEEIRRDTEELEKDARRVLTELRRNLERLRRKVEKVLEEIRRILEELERRVRK

SEQ ID NO: 11113 - protein, 182 aa, Artificial Sequence; identical to SEQ ID NO: 11112
  Synthetic

SEQ ID NO: 11114 - protein, 175 aa, Artificial Sequence
  Synthetic
DKLEKLEEKLEKDVRRWDDELRRDLEDSKRLVDTIRKRLEKLLRDHRELVRRIRELLRDGRVPEKLMKELEDFNRRVAEEVKKLRDDLRRKLRESAERHKKIAEELRRELKRIEDEVGRNEVVRRLEEEVRRLEEKVKEVLRRNEEEVRRLEKDIERVLRESTKIVEDLKDEVRK

SEQ ID NO: 11115 - protein, 175 aa, Artificial Sequence; identical to SEQ ID NO: 11114
  Synthetic

SEQ ID NO: 11116 - protein, 184 aa, Artificial Sequence
  Synthetic
SVEEVVEELERIHREVKREIDEVVDRLREINEEVRREIKEVLDKIREDLERLKEEIDRDLKDKKTADRLKEEIDRLLREVEETVERLERRHEDAKRRTRERVEELKRRHDKVLDEIRELIRRGVSDDILREMLRKSEELVRESREDLKRLLEEHRKLVEESRRELERLKKEVKDAVEEVRRRLK

SEQ ID NO: 11117 - protein, 184 aa, Artificial Sequence; identical to SEQ ID NO: 11116
  Synthetic

SEQ ID NO: 11118 - protein, 184 aa, Artificial Sequence
  Synthetic
SVEEVVEELKKIHEDVKRKIDEVLKRLKRINDELRKRIREVLERLRREAEKLMEAIRRDARDRDTVKKLEEELRRLLKRLEDTARELVKRSDKLLEDTERTARKLKEDHDRVRKKIEDLVREGVSDDILREMLKESKELVKRSEKTLRELEKRHRDLVREVEETLKELEREVERKVREVERRVR

SEQ ID NO: 11119 - protein, 184 aa, Artificial Sequence; identical to SEQ ID NO: 11118
  Synthetic

SEQ ID NO: 11120 - protein, 184 aa, Artificial Sequence
  Synthetic
SVKEVLDEIRKINDDARRRLEEVLKDLKRINDELKERVDRVHDRNRRLLEELKKEIRTKLKDKRKADELERRLKELLEESKKLADEMKKRSDDVLRETERTARELTERHRKLLEEVKRLVEAGVSDDILREMLERNKELVKESKKVLEELEREHRELVREVKKRLDDSTEKIKTEVDKVKKELD

SEQ ID NO: 11121 - protein, 184 aa, Artificial Sequence; identical to SEQ ID NO: 11120
  Synthetic

SEQ ID NO: 11122 - protein, 184 aa, Artificial Sequence
  Synthetic
SVEEVIKEIEKIIRDLKEELKKVLTELEKRNEELKRRVEEVHEESRRLLDTIRKEIERKLKDKKEADRLEEELRRALKKDEELVREVIKRSEDLLRETRKRAKELSDRLEELRKRVEDVARAGISDEVLEELLRRVKKTVKEVREDLDRLRKEHEELVDRVREELERSLREIKERLERIKRRLD

SEQ ID NO: 11123 - protein, 184 aa, Artificial Sequence; identical to SEQ ID NO: 11122
  Synthetic

SEQ ID NO: 11124 - protein, 180 aa, Artificial Sequence
  Synthetic
KEAEELLEKVRKLVKEIEDRLRKSSEENRELVKRVEDELRETTKKNKKLVDEIKERREKSDKDKKKVDDDIRKELEDVSRENKEILKRIEDESRKSEEKNKKLADDVKRELDEMRREVREKVKDEDVLRRIEEILERVERAVREVLRRNKEINDRLRERVEDVVRKNEDILRRVLDEVRK

SEQ ID NO: 11125 - protein, 180 aa, Artificial Sequence; identical to SEQ ID NO: 11124
  Synthetic

SEQ ID NO: 11126 - protein, 180 aa, Artificial Sequence
  Synthetic
DEVERLIEEVDKLVKTIEEELRRSSEKNKDAVRRVKRRLEKSNEDNREVVRRVDKERRDSDKDRKKVRDEIEERSRRTEEENKRLLKELKEESERLEEENRRLLEEVERRLERMEEEVRKKVKDEDVLRTIKEILRELRERVEEVAKRNKEINDRLNEDVERVVRENKELNDRLRERVDR

SEQ ID NO: 11127 - protein, 180 aa, Artificial Sequence; identical to SEQ ID NO: 11126
  Synthetic

SEQ ID NO: 11128 - protein, 180 aa, Artificial Sequence
  Synthetic
DEAEKLIEEVKRLVEDLERKLDESSRRNEETVKRIDKELKDSNKKNRDTVKKVTDTAKDSDKDREEVLRRLKKRSEETKEENKELLKRVRERLEKVKEDNDRLLEEITRALRELEDKARKTIKDEDVLRTIKKILDDLERRVEEVVRRNREILKDLERKVRRVFEENEKLNRELEERVKT

SEQ ID NO: 11129 - protein, 180 aa, Artificial Sequence; identical to SEQ ID NO: 11128
  Synthetic

SEQ ID NO: 11130 - protein, 178 aa, Artificial Sequence
  Synthetic
SKADEVEKDVDRKLKEVKKRLDETRESVRRKLEEVRRELEESEKSVETVLREVKKTKDRGTSEEALKDIKRRLREHNKRLTEKHEKIKRELDKHNKELTDDHERIKEELKEKVRKLEEDGLEEEVLKKLKDIATELRERLDRNNKELTDIHRELKERLDRNNTKLSEIHKRLEEELDK

SEQ ID NO: 11131 - protein, 178 aa, Artificial Sequence; identical to SEQ ID NO: 11130
  Synthetic

SEQ ID NO: 11132 - protein, 178 aa, Artificial Sequence
  Synthetic
SEVDEARKRVRDVLEEVRKALEETEKSVRRTLEEVEKRLKESEDSVRKVLEDVRRELERGTSEEVLKKIEEDLRRHNKRLTETHKEIEDRLRDHNRKLTDLHRRLKKELDRLLKELKDKGLDEEALRELEEIARRLERELEKNNKDLTDIHETLRRRLEDNNRKLSKIHEDLARELRK

SEQ ID NO: 11133 - protein, 178 aa, Artificial Sequence; identical to SEQ ID NO: 11132
  Synthetic

SEQ ID NO: 11134 - protein, 182 aa, Artificial Sequence
  Synthetic
KEAEDMLREVKRLIDRIKKVLEDVLKAIEELIRRLEDIHRKVNEDSERLTEDLKRTIGTERDEAREVLKRLEDLNREIRKRSEEVKRELRKVLEDARKRLEEIERELEEMLRRLEREVEKGTSKEKIEELLRRVEELIRRIEEEVRKLLEDVERKIRESVKEAEELLRRSKKEIERVKREDT

SEQ ID NO: 11135 - protein, 182 aa, Artificial Sequence; identical to SEQ ID NO: 11134
  Synthetic

SEQ ID NO: 11136 - protein, 182 aa, Artificial Sequence
  Synthetic
SEAERVIRESERLTDELRKELEKALRRSKKLSDELRKIHEDANREVRKLIEDLKRTIGTESEEARDVLRKLEKELDRLRRESERVEKESEDLNREIKRRLDELLRRSEELNERIRDLLRKGTREEILKKLLDESRDTVRRVEDTVRKLVRRSEEFVRKSKERVKRLLDDVRRKIEDVKRKTK

SEQ ID NO: 11137 - protein, 182 aa, Artificial Sequence; identical to SEQ ID NO: 11136
  Synthetic

SEQ ID NO: 11138 - protein, 178 aa, Artificial Sequence
  Synthetic
DEEERLLREAEEMHERNKRLIDKLRREVEESLKEVEREIRRLLTDIARLVRRVEELKKNNIDRKEVEDLLRRIEEELEKIERELRKILRDDERKLKEAEDRLRRMLEENKRVLRRIKEENKEAEEVLREIRKLVEESRKILEKVIRDWRRITEELKDRLRRVLEELKKLVDELRKTLT

SEQ ID NO: 11139 - protein, 178 aa, Artificial Sequence; identical to SEQ ID NO: 11138
  Synthetic

SEQ ID NO: 11140 - protein, 178 aa, Artificial Sequence
  Synthetic
SDRERLLEEIKDLNRRNKEILERILRRSEELLKKAEDLLDKIKRDSDRAARKVEELKRRNISEELVKELLKELEDINRELKKEIERLLKEWEKDSRELEDEIRRVLEENRKKLRDVKEENKELEEVLRRLEKIVRDSERELRRVREEDKKVADEIREKLKRVHDESERIVRELKETLR

SEQ ID NO: 11141 - protein, 178 aa, Artificial Sequence; identical to SEQ ID NO: 11140
  Synthetic

SEQ ID NO: 11142 - protein, 181 aa, Artificial Sequence
  Synthetic
KELEDVKKRVDDLLRENERVVRELLESSKRLNEENEEAVRRLDESSKELAKRVKEIKDRGTSEDAVRKVDEELKEHLKEVKKRLEDLVRKNEEHLRRVKETSDRMKKKNDEELDRLRTKDGDDRDVRRVLEFVKEVIKEIERIHKKVNDDNRKLIEESIRRLKKVLDDNKRVIDELRKTLK

SEQ ID NO: 11143 - protein, 181 aa, Artificial Sequence; identical to SEQ ID NO: 11142
  Synthetic

SEQ ID NO: 11144 - protein, 179 aa, Artificial Sequence
  Synthetic
DEEEEVKKRVEELLDELRKSIKKSVDDSKRVLDEARKSVERSREELEKLLRALEDILRKGNKTGELLERLKRLLDKLREDADRWRKELEKLVEDLKRHADEWTKELDRLIRELRKRLEAREDDLRRLEEEAKRLVEEVRRRDEEHLKRSEELLKEVEERDRELLKRARDLFEDVRRKIE

SEQ ID NO: 11145 - protein, 179 aa, Artificial Sequence; identical to SEQ ID NO: 11144
  Synthetic

SEQ ID NO: 11146 - protein, 179 aa, Artificial Sequence
  Synthetic
SEKEEVAKRLEEALKRLEDTIRKVSEENERVLRTLEDRARKSAEKVERLLEELRKRLEDSNNQGELLETLERLIERLRRETEDLKRKLKELVTDSRRRTKELEDKLKERAKELRKEIKADKLDLEELKKRVEELTREVEEEIRRLKETSKRLEEEVKRLIEDHDRRVRELKDEVERRIR

SEQ ID NO: 11147 - protein, 179 aa, Artificial Sequence; identical to SEQ ID NO: 11146
  Synthetic

SEQ ID NO: 11148 - protein, 177 aa, Artificial Sequence
  Synthetic
DEAREVIKTLRKLLRDSAEILTRVTEEDREVLRELAEIIKKVTDEDRRVLEEARRELDDERVLDELEKLSRDIEKELEKLLRDLTKRSEDIRRDVERLLTDTERDIRRLIRELERRQGDRILEELLERIKRLHEENKKAVDRWREESKKLKEEVKKKVKEWKDTSEELLRRVKERAR

SEQ ID NO: 11149 - protein, 177 aa, Artificial Sequence; identical to SEQ ID NO: 11148
  Synthetic

SEQ ID NO: 11150 - protein, 177 aa, Artificial Sequence
  Synthetic
KEVEEVIKTLRRLSEKLAREHKKVIDELRDLLRRSEEELKRVAKADEDLLDEIRRKVQDRSVLEELRKKSETMKRELKKLLDDTRKKIEDIERTNERVLREHRKKTEDLIRELDKRRGEEILEEVKERIDRLVKENKEIVDRSRELAKELHDRNREMLTKWLEDSKRLVEEAEKKAR

SEQ ID NO: 11151 - protein, 177 aa, Artificial Sequence; identical to SEQ ID NO: 11150
  Synthetic

SEQ ID NO: 11152 - protein, 177 aa, Artificial Sequence
  Synthetic
DKEKEVTDELRKAKRDNDEVVKEIEKESRRLLEEVKETVKRDKKVLRELEEEVKEAKKKNVSEDLVEKLLRKWEKVSKELKDRHRRLIEEWDKVTKELEKKSRKIIDENRKILKRIADRGVDKKVLDEIRKVLTEAKKMHDDVLRRDREVLETARKLSEDSKKENEDVLRKVAEELR

SEQ ID NO: 11153 - protein, 177 aa, Artificial Sequence; identical to SEQ ID NO: 11152
  Synthetic

SEQ ID NO: 11154 - protein, 176 aa, Artificial Sequence
  Synthetic
DEERDLERKLEEVIRRAKETSERLNRELERVIEEVRRRHEEAKRRAEEVIRRILKRLGTEREEAKDVVRRLEEILRELDDHVRRSEETAKEILDRSRKKSEELERKLREVLRTLREARLDKDEVDELVERLKRDIDRWAEDVKKLIEDLRRMVERNLREIDKLLKDLKRVVDETKK

SEQ ID NO: 11155 - protein, 176 aa, Artificial Sequence; identical to SEQ ID NO: 11154
  Synthetic

SEQ ID NO: 11156 - protein, 179 aa, Artificial Sequence
  Synthetic
SEADKLLDEVRKRVEDMERRLEELVREDRKLVEDHHRDNKRLLDRVKKLAEDMERLIDRGEVDEEVIKRLEEELKKLLEDNKRHLDELKRRSTELLRELRKLLEELEKTLKDLLREKSGRSEKAEDVRRRLKELAERVRRVVRRVEEESKRTLKELEKSSKELAKKLRDLVETVERRLR

SEQ ID NO: 11157 - protein, 179 aa, Artificial Sequence; identical to SEQ ID NO: 11156
  Synthetic

SEQ ID NO: 11158 - protein, 179 aa, Artificial Sequence
  Synthetic
SRVDDLLREAERLAEEHHRLNKKLVDEDRELVRRHHETNRRVLEEVKRLVEEAEKLIRRGDVDERVIRELKERLRDLLRKNREHLRRLEETSKDLLRRNEEHLKRLEETLEDLLKRFSGRSEEAKRVAERVRRLLERLRESSKRVKETSKETLERLRRSSEKVEEDLRKLIEDVERAAR

SEQ ID NO: 11159 - protein, 179 aa, Artificial Sequence; identical to SEQ ID NO: 11158
  Synthetic

SEQ ID NO: 11160 - protein, 179 aa, Artificial Sequence
  Synthetic
RELEELVKRDREEVRKHHELNKELLDRARKLVRDHHERNKRLVREDEELVREAKELIERGEVTEEKIEELMRRSKDLLRDNRRHLRELEDTLRRLLEENKRHLDDVRRRSEELLRDKSGRSDEARKAKRESERTLKELEESSREVEKELRRLLKELRESSKKVEDDSRKSLERVERALR

SEQ ID NO: 11161 - protein, 179 aa, Artificial Sequence; identical to SEQ ID NO: 11160
  Synthetic

SEQ ID NO: 11162 - protein, 179 aa, Artificial Sequence
  Synthetic
SKADELVKKDREKVEEMERRLRKILREVEELVKEHHERNKRVLDEVKKRVDDAKELIKRGEVTEEVIRKLEEELKDLLRRNEKHLRELEETLKKLLEEATRLVKKLEDDSRRLLKDDSGRSRKAEEVEKDSRRTLERVKDVLRKVEETLRELLDRLRESSERVTEALKRLMEEVREALR

SEQ ID NO: 11163 - protein, 179 aa, Artificial Sequence; identical to SEQ ID NO: 11162
  Synthetic

SEQ ID NO: 11164 - protein, 185 aa, Artificial Sequence
  Synthetic
SKLEALVKEVEELVKKAKKDLDRLVEEDKKLAEEHHDRNRKLVDTVRELVERAKEDIDRRGKTEELEELLRRLAEEIERLKRENEKHLRELERTSRELVRRLEELLKRLAERIKKIIDDAERDVSDKKELEEVVKELRRLLKELEEVVRRVARESEKSLEEVRRSSEEVKKALDKLLKELEDAVR

SEQ ID NO: 11165 - protein, 185 aa, Artificial Sequence; identical to SEQ ID NO: 11164
  Synthetic

SEQ ID NO: 11166 - protein, 183 aa, Artificial Sequence
  Synthetic
SELERIVEEVKKLVEDHKKKLKDIVEEVEELVRRHEKKLEDILRRNEKRVRELKEEVRRRGKLEEELVKDAERESRKNKEEIRRSNEEIHRRLKELKERIKESNDKLHEDLKRLTDDIDRRVRDRKKAEEVKRRLEELLKEANKASEEVKRTLDKLLEDVNRESERVERASDELLKRLRDDAR

SEQ ID NO: 11167 - protein, 183 aa, Artificial Sequence; identical to SEQ ID NO: 11166
  Synthetic

SEQ ID NO: 11168 - protein, 183 aa, Artificial Sequence
  Synthetic
SELEELVKTVKKLVEDHKRRLKELLERARRSTEDLKRKLEKLVRDVRKLVEDAKDAIRKSGKADERLLETIKRALEELKRRARDLLRRHKEEIDRLIKDIRRSNEELHRAAERLRDELRKRVRDKDELKKVEDALRRLLEELNEVSEEVERALRELHREVEEAIRRVEKELDRLLKEVEDAAR

SEQ ID NO: 11169 - protein, 183 aa, Artificial Sequence; identical to SEQ ID NO: 11168
  Synthetic

SEQ ID NO: 11170 - protein, 182 aa, Artificial Sequence
  Synthetic
RELEEILKESEKSVEDIKRELEKIKKKSKTDLEKWKDDLRKIRKEIADLVRKVTREVEDGRSDSRLRDLERRLREVVRRIEEELERMIKTHEDRVRELEERLRKIIDDHRRKVEDLLRKIGSEDEKVKRVLDELKRSLEEVRRALEEVREVLRESLKRLRDLAEDLKRELRELLKELEERAR

SEQ ID NO: 11171 - protein, 182 aa, Artificial Sequence; identical to SEQ ID NO: 11170
  Synthetic

SEQ ID NO: 11172 - protein, 177 aa, Artificial Sequence
  Synthetic
SEKEDVERRIRRLIERLRRMIEELRRRNTDILRKVRELVEEVKKADERSIREVEKLLRDVDEELKKRIKTLIDRSREETEEMDRDVEKLIRESEKRTDELEEELRRLARELEKVVTRDVTDLDELIERAERLVREIERKLRKAIEDSKDLLRRIEERLRRLIEKSEKLLRDIKREVD

SEQ ID NO: 11173 - protein, 177 aa, Artificial Sequence; identical to SEQ ID NO: 11172
  Synthetic

SEQ ID NO: 11174 - protein, 182 aa, Artificial Sequence
  Synthetic
SEIEKLVKEIEDHLRRLKEEIEKSSRELKKHLDELERRADKIVRDLRRLVEEIKDTIRREGPRDELLRRLEEALRRIEETLERLRRDHKRLLDRSEDKLRELEEDHDRLLEEVRERLRKSELPREAVERLRKALKESKERLKKALEDNRRTLKKSEEDLKKVMEEVKETLDRVKKEVERALD

SEQ ID NO: 11175 - protein, 182 aa, Artificial Sequence; identical to SEQ ID NO: 11174
  Synthetic

SEQ ID NO: 11176 - protein, 182 aa, Artificial Sequence
  Synthetic
SEIEKLARDAEEHLRRLLEELRKSSDDLRRHLEELKKKLKEIVDRLKELVDRIKDTIRREGDAREIEKALEKVLREVEETLRRLLEDHKRLLEESKKRLKELLKNHEDLLRKLEDDLRKAELDKKVIDDLRRILEESARRLKRAAERNDETLKESADRLRRAIDRLREVAEKLSRDVRRAAK

SEQ ID NO: 11177 - protein, 182 aa, Artificial Sequence; identical to SEQ ID NO: 11176
  Synthetic

SEQ ID NO: 11178 - protein, 182 aa, Artificial Sequence
  Synthetic
SEIEDIARRLREHLEDLKKKIKDSSDELRKHLEEVKRRIERTSEKLTDDVRKIEEKIRKDGPREKIEEDLKEALTRSRTELKKLLDDHRRLLKRSDELLKKLLENHKRTLDRIKEELDRSELPEERIRDLEKILEDSERELRDMARKNRETAERSERELRKVLRENDRTAKKLTDDVRRTAK

SEQ ID NO: 11179 - protein, 182 aa, Artificial Sequence; identical to SEQ ID NO: 11178
  Synthetic

SEQ ID NO: 11180 - protein, 182 aa, Artificial Sequence
  Synthetic
DEIDKLVEDVERHLEKLLREIERSSEELKKHVEDLREKLRDLVRRLKEVVDEIRKTVRDKGPREEILEDLKRILEEIDDTLRKLLANHDELLKRSDDLLRELIADHERLLKRVEEELKRSELPKEDVDRLREMLERSRRRLKRAADENRRTAEKSRKELKEVAERVRRALERMRREVEEELR

SEQ ID NO: 11181 - protein, 182 aa, Artificial Sequence; identical to SEQ ID NO: 11180
  Synthetic

SEQ ID NO: 11182 - protein, 182 aa, Artificial Sequence
  Synthetic
SEIEEIAKKLEEHVKRVVEEIRKSSEEAKRHVEDVKRKIEELVRELARLVKEIKEAIRRDGPRDELEERLKKVLDEVRKRLEELLRNHEELLKRSDDRLKELLKNHEEELRRVEDELRRIELPKERIDELREIAKRSRDKLKKVADENRRTLEKSLRDLARAVEELRRRAKRLEEEVRRERT

SEQ ID NO: 11183 - protein, 182 aa, Artificial Sequence; identical to SEQ ID NO: 11182
  Synthetic

SEQ ID NO: 11184 - protein, 182 aa, Artificial Sequence
  Synthetic
SDIERLVEEVEKHLKELEDEIRKSSEELKRLAEEISRDIRRTSEELKKLIEDIKDTIRRDGTRDEIERRLEEAIRRSRERLERLKERLDRSVKESRKKLKRLEENHRELLKRLEDRLREIELPKEKIDRLRKILEESEKRLEELARENERTVKEVKKEIDDMVRENEETAKRLLDEVRETLR

SEQ ID NO: 11185 - protein, 182 aa, Artificial Sequence; identical to SEQ ID NO: 11184
  Synthetic

SEQ ID NO: 11186 - protein, 172 aa, Artificial Sequence
  Synthetic
DELEKLLEDLRRKIRKIKEDLRKTSKENRDELRKSKKRLEDLVREVRRLVEEIRKLKEQDRREVEKTLRDLRKKIEDAIRESEERSKKLLDDNKKTADDIRRDLKRTEERLRKEGISEEVEKTLRELIKEIEKVLEDDERTVRELIERNKELLDRLAKEVDRLIEEIKREAD

SEQ ID NO: 11187 - protein, 172 aa, Artificial Sequence; identical to SEQ ID NO: 11186
  Synthetic

SEQ ID NO: 11188 - protein, 175 aa, Artificial Sequence
  Synthetic
SEADKVRKELDDVRRRVKKALDDIRRELEKLVKEVEDALRDHERSNEELVREVREKLKDDKDVERTVEKSHRDSRRLVEEIKREVEKLRERLERVLRKIEEDVKRLKEKLERLIEEGNVDDRVVEEIRDMMRKLKRELERIVEEAKKVVEDLKRRLEEVSRRSADLVRRLKERAR

SEQ ID NO: 11189 - protein, 175 aa, Artificial Sequence; identical to SEQ ID NO: 11188
  Synthetic

SEQ ID NO: 11190 - protein, 175 aa, Artificial Sequence
  Synthetic
SDLERVKKDLEDVVRRVEEVLREHKRTNDEIIREIERLIEELRKENERLAREVRDKLKDVDDVRRAVKKSHEDVREVLRRLKEEADESHEKSKEVIKEIEKRVKKLLEDLDRLIKEGRVDERVVDEIRKVVKELEERLRRLSEESRKLVKDIKEKLDKLAEDSRRLVEKLERDAK

SEQ ID NO: 11191 - protein, 175 aa, Artificial Sequence; identical to SEQ ID NO: 11190
  Synthetic

SEQ ID NO: 11192 - protein, 182 aa, Artificial Sequence
  Synthetic
REFEELVERVKRVVEELTRRLRETSEETKTVLEKLRKELEEASRRIEDVLRRLTEKIRKDGRGGELKEEVERELKRLRDESEELVRRVEEVVDRLRRRHEELKKRAEDVLRKLREELKEMRDRGKGTEELEETLERLVEAIRDALRKDEETMRRVAEAIRRLLEDHRRSLEEVLEKIRDALR

SEQ ID NO: 11193 - protein, 182 aa, Artificial Sequence; identical to SEQ ID NO: 11192
  Synthetic

SEQ ID NO: 11194 - protein, 182 aa, Artificial Sequence
  Synthetic
SEAEKIVEDIRRVIRELKEKLKKTSEDTEDTVRKLSRRLRELAKRSAELVERVTREIRKDGPGGELVRKVRELLKKSSKEIEDLVREVEEKVEELKRRHDKVVKEAEEVLRELEKRVDEVRKKGLGTEELEETLRRVAEEIRRLLEEDRETLRRVERKIREMLKELEEINRRLIKEVDEEVK

SEQ ID NO: 11195 - protein, 182 aa, Artificial Sequence; identical to SEQ ID NO: 11194
  Synthetic

SEQ ID NO: 11196 - protein, 182 aa, Artificial Sequence
  Synthetic
DEVEEIVRRIEEVLKDLRRRLETLARESRDLVRKIKEELRRHSDESRRLLERIKERIRRDGSGGELVRDVERLLKESSDTLEELKRRVRELLERSSKKVEDLVREAEKVLKKLEEDVKRMRDKGKGTDELKKEADRVKKEIRDMLRKLKKINDDLIREIEEALKDNERTNREIIRRIEEELR

SEQ ID NO: 11197 - protein, 182 aa, Artificial Sequence; identical to SEQ ID NO: 11196
  Synthetic

SEQ ID NO: 11198 - protein, 182 aa, Artificial Sequence
  Synthetic
DEAEKIVRDIEETVRRLARELEKHSEDSRRLVERIKEELTRHSKKVADVVRELKKRIKRDGSGGELVEDAKRVLRTLEETIEKLKRDVERLVKESSDSIRELEERVRKVLEDLRREVEEARRRGKGTEELEKRMRRLVKEIERMLEENKRTNEELVREIEEALKKNEETLRRLKREIEEALR

SEQ ID NO: 11199 - protein, 182 aa, Artificial Sequence; identical to SEQ ID NO: 11198
  Synthetic

SEQ ID NO: 11200 - protein, 175 aa, Artificial Sequence
  Synthetic
SEAEELVKDAERVVEELERRLRKVSEDIDREVKKIKRELDEHSKRVKETVDDVRRRNLPEEDVRRIVEELKDSLEKLREKLERKREEIRRRSEKLKREADKVLEELKKKLDEIRKKGLGTEELKKRVEDLIRTIKELIKRHDDSVKEVEKRIREMLERNRKSVEEVIEELKRTSK

SEQ ID NO: 11201 - protein, 175 aa, Artificial Sequence; identical to SEQ ID NO: 11200
  Synthetic

SEQ ID NO: 11202 - protein, 182 aa, Artificial Sequence
  Synthetic
SELEELVKEVKELVDRSKEELKKLSEELKKLLDDLIKRIEDLSRRSKRLVEELRRRVEERGRRKDLLRRAREELRKSDEELDEIEKRAEKRVRDSKRRVREIHKESERRLREIRREIEERVRGEEEMKRVEEELKRLREEDREAVERHDESIRKLREDLRRAVETHKKSNRDLLREVEETVR

SEQ ID NO: 11203 - protein, 182 aa, Artificial Sequence; identical to SEQ ID NO: 11202
  Synthetic

SEQ ID NO: 11204 - protein, 179 aa, Artificial Sequence
  Synthetic
DEVEELIRKIEDLLRRIEEKVTKAIRKSERLLEEIKKKIKEMIDKSERLVEEVERRTRNSDKDKEEVVRRLKKEAEDSHRELEDLIRRVEEELRRSHDELRRLVEAVRKEIKDLEREVEESRASEDVKRVLKKVADDVERLLRDLERRNRKVREDVKRVLEELRKSNERSIRRIDETLR

SEQ ID NO: 11205 - protein, 179 aa, Artificial Sequence; identical to SEQ ID NO: 11204
  Synthetic

SEQ ID NO: 11206 - protein, 179 aa, Artificial Sequence
  Synthetic
REIEEIIKRARELLEEVEEEWRRLIEKSRRLLEELKKRWDKLIEKSKDLLRKIEKTTKDSDKDKEEVVRRLEEEAKKSHEEVKKAVDDSRKETKESHEEVKRVIEESKKRTEELKERLERNNIDDELRKILKRVEDENRRLVEEVERSNRRSMEENERLAEEVRRSNKDVIDKIRERLR

SEQ ID NO: 11207 - protein, 179 aa, Artificial Sequence; identical to SEQ ID NO: 11206
  Synthetic

SEQ ID NO: 11208 - protein, 184 aa, Artificial Sequence
  Synthetic
DELERLSESVKKAERRIERLNEELNERVKEVTKAIDDLNKRLNDESKRVKEELRKVLARSDREEVERKLRKLEEELDRENKRLNDESEKLKRELEERNKKVNERSKRLVERLRRVLEEIRRRKVPEEVIKRVLDDVERAVDEVRKLIEDVLKEHEDILREVKKELDKAIERHKEILKRVREDIK

SEQ ID NO: 11209 - protein, 184 aa, Artificial Sequence; identical to SEQ ID NO: 11208
  Synthetic

SEQ ID NO: 11210 - protein, 184 aa, Artificial Sequence
  Synthetic
SVLEDLARKVERVIREAKKVNEELNRRSEEVRRRADEVVADLNRESKKVDDELKKVLARSTREEVARDLERLRRELEELNKRLNDRIEEIKERLERLNERVNRETDELVRELKKRLKEVEDRQVPEEVARRVVEELKKVLKEIEDEIRRVIERHKEALDEVRRLVKELKDRHDKILREVREKIR

SEQ ID NO: 11211 - protein, 184 aa, Artificial Sequence; identical to SEQ ID NO: 11210
  Synthetic

SEQ ID NO: 11212 - protein, 184 aa, Artificial Sequence
  Synthetic
SSEDRLRETVEDVIRRARDANRELNKASRDVEEESKKLNKELNDRSRKVERDLEEVLRRSTDEELARRLEELRKELRKLNEDANRRSKKLIEELREKNKEINKRTDKVVKELKRKLEEVEKRKVPEEVIERLIRDLRRVLEEIKREIEEALRDHERVLKENEDMVREILRRHEEILKRMTDEIR

SEQ ID NO: 11213 - protein, 184 aa, Artificial Sequence; identical to SEQ ID NO: 11212
  Synthetic

SEQ ID NO: 11214 - protein, 184 aa, Artificial Sequence
  Synthetic
SVLERVADELRKVEEAIDRLNKELNDAVERVERESRRVNKELNDASERVERELDEVLKRTRRKEVADRLEKLKEDLRRTNEDVNRRSKELIDRLREENKRVNEESERIKDKIRRDLEDIKRRKVPEEVAKELIDRIRKLLDDIRRKLEEVLKRHEEVLKRNEDTIRKVLKRHEEILEKVKRDIK

SEQ ID NO: 11215 - protein, 184 aa, Artificial Sequence; identical to SEQ ID NO: 11214
  Synthetic

SEQ ID NO: 11216 - protein, 184 aa, Artificial Sequence
  Synthetic
SSKERLREAVERVERESDKVNKELNDKSRRVTEELRKLAEELNRRSKEVEEELDKLLARSTRKEVADRLEDLKRRLRELNKDLNRRLRELEEELRRLNEKLKRESEELKERLRRLLEEVEKRDVPEEVIRRLIEELDRLLEENDRRIKKAIEDHKRILEKAEREVREILRRHEKILEDVREEIR

SEQ ID NO: 11217 - protein, 184 aa, Artificial Sequence; identical to SEQ ID NO: 11216
  Synthetic

SEQ ID NO: 11218 - protein, 171 aa, Artificial Sequence
  Synthetic
DEEEDLRRAIERVIETVRRLVERVEEESKRVADELRKLTKRLEEVVRKVDEDARKEVKKKDLLDKVRKELEEILRDLRRHTEELERESKKSIDELRELLKTLRRELEEIRKRGERVEDVKRRLEELLKRAKEVLDELIKRHRDLLRRHEEKVRRLIKRIEDLLRELSKKAK

SEQ ID NO: 11219 - protein, 171 aa, Artificial Sequence; identical to SEQ ID NO: 11218
  Synthetic

SEQ ID NO: 11220 - protein, 171 aa, Artificial Sequence
  Synthetic
SKEEELEKIVRKIREDLRRAVKEVEDESKRVLESTKKALDTIRRVSEKVIEDLRRELRDEEVLKDLERRSKETIKKLEEHVKRSEEESRDSIRELRRLLEELERRLEDLKRRGEPVDELVRRLEELLKELRKRLEDLIRRHEDINRRNHELIRRAIEEHRRLLREAREREK

SEQ ID NO: 11221 - protein, 171 aa, Artificial Sequence; identical to SEQ ID NO: 11220
  Synthetic

SEQ ID NO: 11222 - protein, 179 aa, Artificial Sequence
  Synthetic
DEIEELIKKLREDLDRSRREVEKNSEDLKELIKRSEERIEKLIEDLERMVDDARRKNSKDSTLKETIKKLAEELRRELKKLHEDTKRKLDESRERTERIHKRTEEILRDLRDKLKRIDVDEKLLKKLEDVIDDVRRRDEDVVRKNEESLKRIEKRDEELIRKIEEVIRRAERKVDEVMR

SEQ ID NO: 11223 - protein, 179 aa, Artificial Sequence; identical to SEQ ID NO: 11222
  Synthetic

SEQ ID NO: 11224 - protein, 179 aa, Artificial Sequence
  Synthetic
SKIEELIKELEKLSRTNEELVKRVLEELTRLVEESAKRIEDIIRRLKEVVDKARRENSRDERLLREVEKELRRVEEELEELHRRTKKKLDDVRKEAEDSLRKSKDDMRKVEEELRRTDVDKKLLDKIKKAIEDLERENERALKELEKRLRELLRTDRELIRKIEEEIKKLRREVEEVLR

SEQ ID NO: 11225 - protein, 179 aa, Artificial Sequence; identical to SEQ ID NO: 11224
  Synthetic

SEQ ID NO: 11226 - protein, 184 aa, Artificial Sequence
  Synthetic
SIKERLTEVLKRLAEEIRKVIEENKRTVDRAREEVERVIRKNREVLKRIKERADEVIKRISDERLVREIEDRLEKLKKTSEDLVRDVERIVEEMERSSRELEKDIRRILDELAKKVEKVKKDGSDERVVEELIREAKKIVEDIVRRVKRHSREVERIVEEIRRRAEEHIERLKRSLEEVEKKVD

SEQ ID NO: 11227 - protein, 184 aa, Artificial Sequence; identical to SEQ ID NO: 11226
  Synthetic

SEQ ID NO: 11228 - protein, 184 aa, Artificial Sequence
  Synthetic
RIMEKLEEVLKELRKKIKKLNKDNEETVRRIKKEVDKVIKKNRDVNERIRKRLEEVISRISDERLVRDIERLARENSRTSEELEREVRKIVREAEESSKRLIEKNEDLLRRLTEEVKRVKDRGESEEVVEKLIEDMERVVAESAKENKKHSDDVKRILDEIRRKAEDHIRKTEELLRRIEERTR

SEQ ID NO: 11229 - protein, 184 aa, Artificial Sequence; identical to SEQ ID NO: 11228
  Synthetic

SEQ ID NO: 11230 - protein, 184 aa, Artificial Sequence
  Synthetic
SIKEKLTEELERLAKRIREANEDNKRTVEEVEKRIREVIKKNRDSNKEIKDDVERVLSRIDDEEVVRKIKELVERNSETSERLRRKVEEELKRLRESSRKLIEDNKKLLEDLRREVEEAKRRGEDEEVVERLLKKMREAVKKSEDENREHSERVKRIIEKIAREAEEHSKRTKELLDRIREEVR

SEQ ID NO: 11231 - protein, 184 aa, Artificial Sequence; identical to SEQ ID NO: 11230
  Synthetic

SEQ ID NO: 11232 - protein, 184 aa, Artificial Sequence
  Synthetic
RVDEDLKRVLDELKKRVEDLNEENKKTVEDISRRVREVIKRNEDMLREVKKRAREAISRISDERLVRRIEELLKRLEETSRKLARDVEEIVKDIERSSEELIRDNERLVRELAREVEEVSRRGESEEVVRELIKKMRDVVRKSEKDNKDHSERVKRILKRIEERAREHTRRLEEVLRKVEEDVR

SEQ ID NO: 11233 - protein, 184 aa, Artificial Sequence; identical to SEQ ID NO: 11232
  Synthetic

SEQ ID NO: 11234 - protein, 183 aa, Artificial Sequence
  Synthetic
RVKEKLREVLERLEREIRKILKDNKETVKRIEEEARRAVEKNKEALKRLEDRVRELLEDKDQEDRKKVKDVVDELRKSSKKLTDKIRKILEDIKKTSEDLERRVKEVLDKLREDVKRIEEKPVDEEKVERLAEELRKIVRKIIEDVRKHSEDVRKILEDVKKEVDDHVREMEEIVKRLEDEIR

SEQ ID NO: 11235 - protein, 183 aa, Artificial Sequence; identical to SEQ ID NO: 11234
  Synthetic

SEQ ID NO: 11236 - protein, 180 aa, Artificial Sequence
  Synthetic
SELEEIVKEIKRILDEHEKKVRRNSEEMKRIVDRHAERVEKLIREIEELLRRLDELVKRGEVDEETAERIKDRIRKLLEEAKKHSKRIKDELDRSNKELDDHSEKVKREIDKLVKDVRRKGVEGEEDLERMAREIKDRLDKIDEENKKSSEELKRELDRLDEKLRDVARRIMEAIDERTR

SEQ ID NO: 11237 - protein, 180 aa, Artificial Sequence; identical to SEQ ID NO: 11236
  Synthetic

SEQ ID NO: 11238 - protein, 180 aa, Artificial Sequence
  Synthetic
DELREIVRRIEKILEDHARTIEEVIERIRDILRKHEKLVEEVLRRIEKLLKELEEMVRRGELDEETVRRVEREIEDLLRRAKEHSEEVKKRIEELLERLRRHSRDVERAIDELVKKVRERGVEGTEDLERMAERVKRELERLNKKAEDALREVKRALDDLDRDLKRVLEEIKERIRRATT

SEQ ID NO: 11239 - protein, 180 aa, Artificial Sequence; identical to SEQ ID NO: 11238
  Synthetic

SEQ ID NO: 11240 - protein, 180 aa, Artificial Sequence
  Synthetic
SELERILTEIEKRIEEHERRIKENSKRMKEIVDDHERKVEEVLRRIRKLLRDLEEMVKRGELDEDTAEKVKRDIDKLLEEARRHSERVKRELDKSNEDLRRHSKKVIDDIRRLVEEVRRRGVERREDLEKVARDVEKRLEDANRENEKSSRELKRRLDELDKKLEEEARRIKKAIDDKTR

SEQ ID NO: 11241 - protein, 180 aa, Artificial Sequence; identical to SEQ ID NO: 11240
  Synthetic

SEQ ID NO: 11242 - protein, 180 aa, Artificial Sequence
  Synthetic
SEVDEVAKEIRRILEEHEEEIRRNSEEAKRILDEHREKLKRNSDDMRRIVKEIEDMRRRGELDEETAKKIKEELERSNRKLEKHSEDVIRRLRKSNTDLKRHSEEVKKEIEKLVKRLEDKGVEREEDLREVAERVKKDLDRLNRENDESSKEIEKDLKRLDDRNRDVSEKLKKEIDELTK

SEQ ID NO: 11243 - protein, 180 aa, Artificial Sequence; identical to SEQ ID NO: 11242
  Synthetic

SEQ ID NO: 11244 - protein, 180 aa, Artificial Sequence
  Synthetic
DRLREIVKRIRDILKEHEDRIRENSKRARDILREHKRKIEEVLRRIEKLVEDLERLKRRGELDEETAKKVKEDIRRLVRTVEEHSRRVIEELDRSNDELRKHSEDVKREIEKLVEDVEREGVEGEEDLRRAAEEVKKKLDELNEENERSSEDVKRTLKKLNDELREKVRRVMERIDEAVR

SEQ ID NO: 11245 - protein, 180 aa, Artificial Sequence; identical to SEQ ID NO: 11244
  Synthetic

SEQ ID NO: 11246 - protein, 180 aa, Artificial Sequence
  Synthetic
DEVEDVLRKIEKILDDHRKRIEKNSRDMARIIDEHRRKVEENSREMKKLVDDLKKAVDRGEADEETAEDVKRKLEKSNRELEKHSEEVKRRLDESNEDLRRHSEEVKERIERLVKKLREDGVEREEELKEVADRVKEKLDRLNRENEKSSEELKRELDKINDENRETSERLKREIDETTR

SEQ ID NO: 11247 - protein, 180 aa, Artificial Sequence; identical to SEQ ID NO: 11246
  Synthetic

SEQ ID NO: 11248 - protein, 180 aa, Artificial Sequence
  Synthetic
DELREVVKTIEEILRDHERKVRDNSRRMKEIIKRVKEELERVIKEAKELVERLKEAVRRGEVDEDTARKIKKELRDLLRELKKRLEEIKKRLDESNDRLRRHSEEVKERIDRLVDKVRRDGVEREEDLRKMAEDVKRALDKINRDNEESSRRLKKELDDVLRKVEEVIRRLEEEIDRLTT

SEQ ID NO: 11249 - protein, 180 aa, Artificial Sequence; identical to SEQ ID NO: 11248
  Synthetic

SEQ ID NO: 11250 - protein, 180 aa, Artificial Sequence
  Synthetic
SELEKIEEDIRRILKEHKDTVRKNSEDIDRSVKEVKERIDKILKEIDDLLKELRELVERGELDERTVEEVKRRIEELLREVEKLSEKHKRDLDRSNDELRKHSEEVKKEIDDLLEEVERRGVEKREDLERVVREVKKELDDINRENRKSSEEAKKKNDDVLAELEKRIREIKRRIDEDAT

SEQ ID NO: 11251 - protein, 180 aa, Artificial Sequence; identical to SEQ ID NO: 11250
  Synthetic

SEQ ID NO: 11252 - protein, 180 aa, Artificial Sequence
  Synthetic
SDLEKLVEEIKRLLKELKERVTKNSEDMKREVERHKELVKKLKKRIEDLLRELEDAVRKGELDEKKVKELKDEIRKLVKELRDHSREVKKRLDDSNRKVEEEVRKLKEDIDKLVKEVRDKGVEKREDLERVVEEVKKEIDKIVEENRDSSRKLKERLDEANEELERRVEEIERRIDEKAR

SEQ ID NO: 11253 - protein, 180 aa, Artificial Sequence; identical to SEQ ID NO: 11252
  Synthetic

SEQ ID NO: 11254 - protein, 180 aa, Artificial Sequence
  Synthetic
DELREIVTRADETLKRVADKIEENSRRMEEIVREHERKVRELLKRIEKLVRDLSAMVRRGELDEESLKRLKDEIEKLLEEAERHSRDVKRKLDESNKRLEDDSRRHEEDLDRLVTEVEKRGVEGEEDLRRVVKRVKETNRRLLEKNKDSSRKLKKRLDEANKTLADALEEVKRRIDERRK

SEQ ID NO: 11255 - protein, 180 aa, Artificial Sequence; identical to SEQ ID NO: 11254
  Synthetic

SEQ ID NO: 11256 - protein, 180 aa, Artificial Sequence
  Synthetic
DELDEIVKRAKETVEKVKREVDANSKDIERILREHRKKVDKNSKDMEDLVRKLEELVRRGELDEETAKDVKRRLDESNDRVRRHSDEVKKKLDKSNEELRRKSDEHKKDLDRLLDEVRRRGVEREDELREAVERLERENRKVLEENRRSSEKVKRDLDRVNRENEEVSERLKKRIDEAAT

SEQ ID NO: 11257 - protein, 180 aa, Artificial Sequence; identical to SEQ ID NO: 11256
  Synthetic

SEQ ID NO: 11258 - protein, 174 aa, Artificial Sequence
  Synthetic
SEIEKIIKELDDLVKEDEDTIRRLEEELRELLKEIDREAKKSDEELEKTLEELAKIARDGKLDEELLERVERTLEKSERRMRRLKEELKRELDRIREDLERSKRDLDRKIKKLLDEIDDEELRRVLERVAEDSKRTLDRLERVLKEVERRVDEALKRNKTVLDKVREDVKRLKD

SEQ ID NO: 11259 - protein, 174 aa, Artificial Sequence; identical to SEQ ID NO: 11258
  Synthetic

SEQ ID NO: 11260 - protein, 180 aa, Artificial Sequence
  Synthetic
REIEEMIKRNEKLLEDDKRKVKRIIEKLDKVLEDDRKRAEDLIRKLEKVAEEIARLRDKVEERDVARKIKELKDEVEKLVRESKKLNEELREEVRRMKEESKELIKESHKEVRDVERKLKVEELLDTLRKVNERVARESEKTIRELEKVLERVNRESKKTIEEVEKALKEVADRVTEVRR

SEQ ID NO: 11261 - protein, 180 aa, Artificial Sequence; identical to SEQ ID NO: 11260
  Synthetic

SEQ ID NO: 11262 - protein, 180 aa, Artificial Sequence
  Synthetic
SEIEKLIKENKDLLEEDKRRVEEVIEKLERVIEEDKRRVDEAIKRLDDVAREIERLRKDSDDKDVERDIRRLEKEVREVVEKSKDLIRRLKEEVERVERTSRELIKESHKKVREAKERLKDEDLLRRLERVNEEVARRSEDTIRRLREVLKKIEDDSRRTIDELREVLKRVKTRVTEVRR

SEQ ID NO: 11263 - protein, 180 aa, Artificial Sequence; identical to SEQ ID NO: 11262
  Synthetic

SEQ ID NO: 11264 - protein, 180 aa, Artificial Sequence
  Synthetic
DDIERLIKRNKDLLDRIREEARKLIERLKKVLEDDRRKVERAIERLEEVVDEVRKLKKDTDDKDVERLLERLKEEVKKIEEESKKLIDDLRKEVEDLVKRIEESIKTSHDEVREVERRLRNEEVLRKLKKANEDVEREVRKMIEEVRRVLRKVEEDSKRTIKKLKDVLKKVAEEMEKVRR

SEQ ID NO: 11265 - protein, 180 aa, Artificial Sequence; identical to SEQ ID NO: 11264
  Synthetic

SEQ ID NO: 11266 - protein, 180 aa, Artificial Sequence
  Synthetic
DEVEEAIKELEDALRKDREAVERMIRDLERLADEDRREVEDHVKKIEELIAAVERMSRDVDEKDLRRTLKELEDSSRELVERSKDINRRLTEKVKELLERSKELNERLKRKIEDIERKLDKREVLEKLKEVLKRVEKASRKTNEDVKRVLDEVRRISEETNRRNERVVEEAKERVERVAK

SEQ ID NO: 11267 - protein, 180 aa, Artificial Sequence; identical to SEQ ID NO: 11266
  Synthetic

SEQ ID NO: 11268 - protein, 179 aa, Artificial Sequence
  Synthetic
SEVDEVIKRLEELVERHRRKVEEVIRRLEKLAEDHERKVRELEKRLRELIKRIEELARRDGPREEKVRDVRRKLRTLLKELRDTTEELKKTIRELEKELNETTKKIVDEIRRLRERVNVTSRDFDRLEDVARRVKEDLERTDEEVRRVAEEVRKRVEKTTRDVERVVREVERAIEERRR

SEQ ID NO: 11269 - protein, 179 aa, Artificial Sequence; identical to SEQ ID NO: 11268
  Synthetic

SEQ ID NO: 11270 - protein, 179 aa, Artificial Sequence
  Synthetic
DEAREVIKTLEKLLEEHERRVREVIKRLEELIKRHEDRVREVIETLKRLLEEAEKIVRRDGPSDKTVKKLRDDLEEIRKELNKTTKTIKEDLDRTIKELDEITEDIKRKLDDLRRRINVTSEDMRRLEEVIRKVKEALKRTNDRLREVVDEVKKRLDKTDEDATRVVEEVKKRIDEAAK

SEQ ID NO: 11271 - protein, 179 aa, Artificial Sequence; identical to SEQ ID NO: 11270
  Synthetic

SEQ ID NO: 11272 - protein, 179 aa, Artificial Sequence
  Synthetic
DEVETVIRRLEELIREHKEKVDRIIKELEKLLRKHEEKVKKVIEELRRLAKEAADIVRRDGPSEEVVDRLRRRLEEILKDLERHSEDVKRRLREVLKELNDETKRLKDDLRRTRKDANVRSRDMERLERVIRKVEEDLDRTNREVEEVIRRVEEEVERLDREAEEVVRDVKEKIDRLKK

SEQ ID NO: 11273 - protein, 179 aa, Artificial Sequence; identical to SEQ ID NO: 11272
  Synthetic

SEQ ID NO: 11274 - protein, 179 aa, Artificial Sequence
  Synthetic
SEAEKVIKELRDIVKRNDEVVKEIIRRLEELVKEHKRLVEEIIKRLRELLKRIEEVVRRDGPSEDKVEKVERDIERLLEELERHSRRVEEELKRLLEELEKHARESKREIKEREDKINVTSEDLKRLKDVLDEVIKKTDELLREVERKAREVTKRLRDLDRRVKEVADEVRRRIREATK

SEQ ID NO: 11275 - protein, 179 aa, Artificial Sequence; identical to SEQ ID NO: 11274
  Synthetic

SEQ ID NO: 11276 - protein, 180 aa, Artificial Sequence
  Synthetic
EEEERVKEFLDRVDTEDKKLVEELRKVVERVKRENEKLIKESEDMSKKVEDDARRLIAELRREVDETVMREIEEEVRRLKEKNERLIEKSRRDSRRLEEEVRKVIDKSRKDITKIKREVEEEPADKEVVRKLEEYLRRSRKLVDELKKKLRELLERSREKVERSKEELKRILEEVRKKAK

SEQ ID NO: 11277 - protein, 180 aa, Artificial Sequence; identical to SEQ ID NO: 11276
  Synthetic

SEQ ID NO: 11278 - protein, 185 aa, Artificial Sequence
  Synthetic
SVSERLRRVLERVAREVKRLIDEDRKVNEEAEREVRKLIKKDEDALKRVAEEVERLIREASDDDKLIREIEEILKKLAEDSRKVVEESKKVLDDINKESEDVVKESEDTLRRAAEELKEVERRGESEEIIEELIRRLEEIVKRLEEKHRTTVKKIEDIIRELKKTHDKTIEDLRRIIEEIEERVR

SEQ ID NO: 11279 - protein, 185 aa, Artificial Sequence; identical to SEQ ID NO: 11278
  Synthetic

SEQ ID NO: 11280 - protein, 181 aa, Artificial Sequence
  Synthetic
RVREELRKVLKRAAEAVERVLRKNEEVLRRAEERIRRLLEENEKSLEKVERDVTRILEGGIDSREVTELLRRLRKSSDDLKRRLRKVLEDIERSSRDLVRRVRKLLEELERRVREIEKKPVDEEKVKKLIREIEEVIDRLRRESEKHIEEIKEIITRLDKEVKDHDERLKREVDKLEERAR

SEQ ID NO: 11281 - protein, 181 aa, Artificial Sequence; identical to SEQ ID NO: 11280
  Synthetic

SEQ ID NO: 11282 - protein, 181 aa, Artificial Sequence
  Synthetic
SVEERLRKVLEEVRRLLEKIIKDNREVLKRAEEKVRELIKRDKDVLDRIAEEVERLKEKGIDKKKVDDLLEDLRRESKEVIEETEDVLRRIKDSSEKLVRELEKLLEDIERKVRDLERKPVDEEKVDRLIEELKKLIDDAREKNERHIEEIERIIDDLRRKHEETARRLKEAIDRLREEAQ

SEQ ID NO: 11283 - protein, 181 aa, Artificial Sequence; identical to SEQ ID NO: 11282
  Synthetic

SEQ ID NO: 11284 - protein, 181 aa, Artificial Sequence
  Synthetic
DKEERIERVLKRVEEELKKLKERIEEVLKKVEDMVRKNLEEIRKVSEDHERTVREIRKRGDITDELVDKLREENERVEEAVRRSVEEAKRELEKVETDVKRLEEEVKRTLDEVRKRVKDTGDEKVVEEIIKELERLLEDLKRRADELIKRLEKLVEEHHRKVEELVRRLEESLDKVRRDAK

SEQ ID NO: 11285 - protein, 181 aa, Artificial Sequence; identical to SEQ ID NO: 11284
  Synthetic

SEQ ID NO: 11286 - protein, 177 aa, Artificial Sequence
  Synthetic
SEDEKVKRVVEKVKEESDRLNEELKRVVDEVRKELERLIEKIKRSVERMDRTVRELLKRISDRKTLEEIREEVERAKRRNEEVIERMRRTLEKLERDVRDVLRRDRETLERLRKEVERDGADDRVVEKLKKALDESRKTHKKLIDDLRRALEELEKRVEDLNRENERLLDEIKKRVD

SEQ ID NO: 11287 - protein, 177 aa, Artificial Sequence; identical to SEQ ID NO: 11286
  Synthetic

SEQ ID NO: 11288 - protein, 181 aa, Artificial Sequence
  Synthetic
DVERKIEEVVRDVKRELDRLLEENRRSVERVERALDKLLEDSRRVVEEVKKALDDLRRRGLDERTIRELKKEIEELHKRNEKLVRELKKEIRDLLRENEERIRKLKREIDKILEELKRDKVPETDVKKIIEDLRRLVREVEEHSRRTNRRLEELVKDLARHAKRSIDRLKELVDRARERAR

SEQ ID NO: 11289 - protein, 181 aa, Artificial Sequence; identical to SEQ ID NO: 11288
  Synthetic

SEQ ID NO: 11290 - protein, 181 aa, Artificial Sequence
  Synthetic
DVEKDIERVVEDVKRELRRLLKEDRDVSKKVKDDLDKLLKESEEVVRRVKKELDRLREEGLDEKKIRELKKEIDELHKENEDLVRDLKRKIDRLNEENEEVVKRLEDEIKKLLDEARRDRIPKSAVDEIIRRLKELVKEMKRHVDKSIKDLEELVRRLEEHIRRSIERLKKLVEEAREDAR

SEQ ID NO: 11291 - protein, 181 aa, Artificial Sequence; identical to SEQ ID NO: 11290
  Synthetic

SEQ ID NO: 11292 - protein, 181 aa, Artificial Sequence
  Synthetic
SVEEEVDKVVKKLEEDLDRLLEESKEVVERVEKALDDLLKRDEDVSEEVRRELERLKEEGLDDKKVRDLEKEIEDLNRENKELLERLKRRIRKLHEDNERMLRELKKEVRKRLEDVRRRRIPESMVKKLLDELRKLVEDAREHVERSIRELEKLVKEADDHVRKSIEDLKRLVEEVRETAR

SEQ ID NO: 11293 - protein, 181 aa, Artificial Sequence; identical to SEQ ID NO: 11292
  Synthetic

SEQ ID NO: 11294 - protein, 181 aa, Artificial Sequence
  Synthetic
DVEKEIKDVVDKAKRELDRLLREDREVSREVKEALDKLLEDNRRSVERVERELDDLRRRGLDEDEIRKLKDRIKKLLDENKKRVEDLKREIDRLNKENEDELRRLKRELDKILREVERDKIPESVVKEILKRLEKLVEDAKRHVEDSIRKLKKLVDDMRKHSERSNRDLERLVREAREKAR

SEQ ID NO: 11295 - protein, 181 aa, Artificial Sequence; identical to SEQ ID NO: 11294
  Synthetic

SEQ ID NO: 11296 - protein, 181 aa, Artificial Sequence
  Synthetic
SVEEEIRKVVEEVKRELDRLLEKNDRSVKEAKKELDRLLEENRRAVEEVKKALDELEKNGLDKDRVRKLKEDIDARLEENERLVRKLKRDLDERLRENEKRLRELKKEVDDLLRRLATEKVPESEAKRLIDRLRELVKRVAEHSERSDRELKKLVDDLREHSKRSNDDLRRLVEEAEREVR

SEQ ID NO: 11297 - protein, 181 aa, Artificial Sequence; identical to SEQ ID NO: 11296
  Synthetic

SEQ ID NO: 11298 - protein, 181 aa, Artificial Sequence
  Synthetic
SVEDKVREAVRRAKEALKKLVEDDRRVVKEVEEMLDTLLDKNRDSVRRAKEKLEDLKRKGLDDDTVRKLLEDLKRLLDRNEEEVRRLKEEIRRENKKNEEVVERLEREVKKLLDELERDKVPESDAERLIETLERLVKELEDHVRRSIRKLRELVEEMRDHSRRSDEELKKRLKEVEDRVR

SEQ ID NO: 11299 - protein, 181 aa, Artificial Sequence; identical to SEQ ID NO: 11298
  Synthetic

SEQ ID NO: 11300 - protein, 181 aa, Artificial Sequence
  Synthetic
DVEEEIKRVVKKVEEELDKLLEDDERVVREVEEMLDRLLKKNEKVVRDAKRKLDDLRRKGLDEKRIRDLKRELDELLKENERRIRELKKRIRKLHEETRRRLEELKKEARDRLKEVEDRKIPKDVVDKIIETLRRLVKEVAKEVKRSIDELKKTVEEVRKHSEETDRRIEKLAKEAEEEVR

SEQ ID NO: 11301 - protein, 181 aa, Artificial Sequence; identical to SEQ ID NO: 11300
  Synthetic

SEQ ID NO: 11302 - protein, 181 aa, Artificial Sequence
  Synthetic
SVEEKIREVVERVRRMLEKLLEDNDRSVKEASKALDDLLRESRRVVEEVKKALDDLRRKGLDDRTVEKLKTEIRKILKDNEDLVRELKKELKRLLEENEKEVRRLEDEIRRIMEEAERRKIPESEVRRIIRELEELVKRATDHVRRSDKRLRELVDELRKHIRKSIEDLKRLVDEARRRKD

SEQ ID NO: 11303 - protein, 181 aa, Artificial Sequence; identical to SEQ ID NO: 11302
  Synthetic

SEQ ID NO: 11304 - protein, 182 aa, Artificial Sequence
  Synthetic
DEVEEIRKELEKLLEEVRRKLEKIIKDIRDLLREDKRKSERIDRELEKLLRRLEEIVRDRGPDERVLRDLEEKIKELLDDSRRHADESEKRLRKLLEDARRTLERAKKDIDKLEEEVRRRGLPEEMLREVKRVLEEVRRDIERLLEEIRKVVEEWRKRLEDLKKKNEDSAREVKRRIDELRK

SEQ ID NO: 11305 - protein, 182 aa, Artificial Sequence; identical to SEQ ID NO: 11304
  Synthetic

SEQ ID NO: 11306 - protein, 182 aa, Artificial Sequence
  Synthetic
SEVEDIIRRLRELLERHREVSKRINDELRKLLREVEEDSRRLDKEIEDLLRRIREKVTRDGPDDDTLRRVKETLEKLLRESERTIREVKRRIEELLKRSREHSKRVKEEIDKLREEVDRRGLPEDARRRVERVLREVEDTLRKLDKENEDSARRVKEALDRLLKKNEESIRRAEREIDELRR

SEQ ID NO: 11307 - protein, 182 aa, Artificial Sequence; identical to SEQ ID NO: 11306
  Synthetic

SEQ ID NO: 11308 - protein, 182 aa, Artificial Sequence
  Synthetic
DDVEELKKEIKKLLDDHKKLSKELNEDIERLLREHRKLSEEIDRRLEKLLKELEELVRREGPVEESLRKAKEDIDRLLEESKRHSEDLRRRLKELLDRSKKHSEEVKERLERLLREVERKGLPKELLDEVERVVREAKKTLDRVDEENKKSIEDAERELERMDRKNEKSVEDVRRTAKELLR

SEQ ID NO: 11309 - protein, 182 aa, Artificial Sequence; identical to SEQ ID NO: 11308
  Synthetic

SEQ ID NO: 11310 - protein, 182 aa, Artificial Sequence
  Synthetic
SEAEEIIRRLEELLKKLKKDSDRLDEEIKRLLDENRRNSKDINRRLKKLLDDLRRLVRERGPRRELIKELREKLKKLEDDSRKDIKRVEDELRRLEEESEELIRELKRRLETLKEDVERRGLPEDVLRRVEEALRRAEEDLKRLKEKNDRSLKEWRDTIRELKRENEESLRRVKEEADRLSK

SEQ ID NO: 11311 - protein, 182 aa, Artificial Sequence; identical to SEQ ID NO: 11310
  Synthetic

SEQ ID NO: 11312 - protein, 182 aa, Artificial Sequence
  Synthetic
SDVERIIEELERLLEDLERRSKRIDEELKRAADRNRRNVEEIIRRLEDLLRRLEELVRRDGPAREVIRELEEALKRLEKRVDEDVRDVERKATDLARRSDDLARKADKRIKEIEKEVDEAGLDKDVLREVRRVAEKVRRSIKELKERNEKSLRDWKREVDKLLKDIKKVLDEVRKAADDLRK

SEQ ID NO: 11313 - protein, 182 aa, Artificial Sequence; identical to SEQ ID NO: 11312
  Synthetic

SEQ ID NO: 11314 - protein, 182 aa, Artificial Sequence
  Synthetic
REVDEIRRRLEKEVERNRRNSKRIDDELKEMADRNRENVKRSIEEIKELLKRLKELVDRDGPDERVIRELEERLRRLDRRLEEDAKRAEEVIDRLRRRSEKDVRDVKEKIKDDEDRVRKRGLPEDVRREVERVLKEWEDDVRRLLRKNEDSLREWREKLKKLVREHREVTKKAEEVLRELLR

SEQ ID NO: 11315 - protein, 182 aa, Artificial Sequence; identical to SEQ ID NO: 11314
  Synthetic

SEQ ID NO: 11316 - protein, 182 aa, Artificial Sequence
  Synthetic
KDAEDIIRKLDELLDELAKAAREIIERLRDAARENEENSREINRRLEELLKRLEDAVRRDGPRDEVIKRLEEELKKIKEESERDVRRVEDAAEKLARTVEKLIEDLRRRLKKLDEDVERRGLPEDVKRKVEEVARRVRKAIDDLLRDIKRVLDDWKRKVDKLLEDNRKSLEDVKREAERLRK

SEQ ID NO: 11317 - protein, 182 aa, Artificial Sequence; identical to SEQ ID NO: 11316
  Synthetic

SEQ ID NO: 11318 - protein, 183 aa, Artificial Sequence
  Synthetic
SEVERLIKELEDVSRDIKREVTELKRDLKRLAEESKRLVEELEETIRKIVKDIEDTKRRGDDEKTLTELRRKVEEVVRRIEDRVKKSHEKVREVIERIRRRVEELEKRSREKLEEIRKEVKNGDKELVDRVEEALRDHERTLRKVVKEVDKALKDLERDNTELVKRVKKVLDELRRDVEEKAK

SEQ ID NO: 11319 - protein, 183 aa, Artificial Sequence; identical to SEQ ID NO: 11318
  Synthetic

SEQ ID NO: 11320 - protein, 186 aa, Artificial Sequence
  Synthetic
DMERKLDTVLEEVRRVVTRAKEANDRVLKDAKRVVEELSDRNRRVLEDAKRVVDELKEKRKDVDELLRRIEETVKELERTARELNKRIEDSLREIAKKHEDLKRRLEEIVKRLAEEIERLKRDLREEDEVVDKLLKKLKETLRRMEKESEELLRETEKILRELEKEVEDHLRTVEKTLEDLRREVE

SEQ ID NO: 11321 - protein, 186 aa, Artificial Sequence; identical to SEQ ID NO: 11320
  Synthetic

SEQ ID NO: 11322 - protein, 178 aa, Artificial Sequence
  Synthetic
SEVDKILEDSKRKLEEVEEMVRRLLKKSRDLLEKLERDVERLIRDSERRLEEVARAKRPDELLDKVLKEDKEKVDDLRRKLEEVYRDNEREIRRAEKELEKLLRDDERDLREAERRVKDKDLRRKLKEVHDRSRRVIEKLREELEKVHDEARKVVEKITEKIERAHDKSRRLLEEIKR

SEQ ID NO: 11323 - protein, 178 aa, Artificial Sequence; identical to SEQ ID NO: 11322
  Synthetic

SEQ ID NO: 11324 - protein, 178 aa, Artificial Sequence
  Synthetic
SEVDEFVKRSEDLLKKLEEDVRRIVRESERLLEEVERRVRKILRDLEKKLEDAERERREDRDLDRMLREVEEEIRKIEKELDDLLREDKRKLDDAVRKLEEVYRRNEEELRKIEKKVKDKELRDKLEEAHRKVKEKVERLMEDLKRAHDESEKKIRDLKRKLREVLERLRKRVEEIKK

SEQ ID NO: 11325 - protein, 178 aa, Artificial Sequence; identical to SEQ ID NO: 11324
  Synthetic

SEQ ID NO: 11326 - protein, 181 aa, Artificial Sequence
  Synthetic
DLEKRLEEAIRENRDTIRRLAKELERVIEDNKRRLEELKKEIKKVIEELERELRRVRKDGRVKERIEEKVEKMVRDVERTLAELEKRSRELVREIEEIIKRLKDSSEKLVREVEKVVEDGTTREIVDELVRRLKKHSDEARKTVEDLRRKSKKSLREAEETVKRLVEEIERLLEEIKETMR

SEQ ID NO: 11327 - protein, 181 aa, Artificial Sequence; identical to SEQ ID NO: 11326
  Synthetic

SEQ ID NO: 11328 - protein, 183 aa, Artificial Sequence
  Synthetic
SEVDELVKKIEDSERRIEEKVKRIEDELKESEERIRTKVRELHKENEKLLEEIRRKKKDSDKDKKKVIEEVRRRVEEVRKKNERVLKEMDKHSKEVVKKLREMLDRLRDHSRRLKEEIERLDNKDELRKTLKDALKRHEEVLKRVEERIRRVLKRHEEVLREAEERIRRSLEKLKRDADRVAK

SEQ ID NO: 11329 - protein, 183 aa, Artificial Sequence; identical to SEQ ID NO: 11328
  Synthetic

SEQ ID NO: 11330 - protein, 183 aa, Artificial Sequence
  Synthetic
DEVEELVKELRDSLKRIREVAKELHDRNKELLDRIKRLVDELLKEIEKVLKEIEETKKDSDKDKDKVSKEVRERVKEIVKRVRDALRELEKRVRDVIEENKDMLKKLEDHSRRLKEKVDRTDDKEEVRRKLEEAVREHERELERMAREIRKSLEDLKRVLEEVAERIKEVLRRLEKRVKEVED

SEQ ID NO: 11331 - protein, 183 aa, Artificial Sequence; identical to SEQ ID NO: 11330
  Synthetic

SEQ ID NO: 11332 - protein, 183 aa, Artificial Sequence
  Synthetic
DEVEELVERLRRSLEKIRDRVRRLLERIKRLAEKIKRDIERLHKKNEDLAREMRKSERKSDKDRKEVLDRLRRRVEEVKKENKEVLEKAERDVKRIADEIKKVLDDLRKHSRDLEEEVRRLDGKEELRKKLRKVVEDHKRVLEEVKDRLTKVLRELEEVLEKVKRDIKKSLEDLEKVLRELEK

SEQ ID NO: 11333 - protein, 183 aa, Artificial Sequence; identical to SEQ ID NO: 11332
  Synthetic

SEQ ID NO: 11334 - protein, 183 aa, Artificial Sequence
  Synthetic
SDVERLLTKLKEVAKDLARIVKRLDEENEKLSEKAEREIRKLDRDNERLLEELEERKRRSDKDKEEVTRRAREEVKRVEEENKEMTDRLRRESDELRKKNEEALKRMEERVRRLEEEVERRNGEDRLRKKLKEVLDDLRRVLEELKDHIRRSLDKNRRSLEELEEHIRRSLTELRRRLEELAK

SEQ ID NO: 11335 - protein, 183 aa, Artificial Sequence; identical to SEQ ID NO: 11334
  Synthetic

SEQ ID NO: 11336 - protein, 183 aa, Artificial Sequence
  Synthetic
DEVRELLERIEDEIRRIREEIKKLDEDNKKLAEDIRRKIEELDKENKELLKRIEDKKRESDKDKEEVTRRVRKEVEEVEKKNKDVLRDLKRKVEDAERRNEEVLRRLEERVRELEERIARLDGDDEVRDRLRTILKKLREMLKEVKDRIDDSLRRLREVLDEVAKHIERSLKELKDRVREVEK

SEQ ID NO: 11337 - protein, 183 aa, Artificial Sequence; identical to SEQ ID NO: 11336
  Synthetic

SEQ ID NO: 11338 - protein, 178 aa, Artificial Sequence
  Synthetic
SDKEEIKKVVDDVRRDIRRLEKELRDLNERFRKRVEELKKRLEEVNDRARREVERLKSRITDERLRRRLDEVLKRDEDKSDKLRKELDELLEEVNRRTRTLEKRLRDLLDEIEKVSRRDLEDVDTLKRRLEDVLRKAREEVEKWKEDLERLLREAERRVREYEEDTRRLLKELEDETR

SEQ ID NO: 11339 - protein, 178 aa, Artificial Sequence; identical to SEQ ID NO: 11338
  Synthetic

SEQ ID NO: 11340 - protein, 182 aa, Artificial Sequence
  Synthetic
NVEDEVRRVVTELEKTLREVLKRSKEALDRLRETLERLLKELEDVHREANEDLTRLEREDERLLRRLKELKEESKKILDDLEEILRRILERVKEIHRRNREFLERIREEVRELLRELRRNNVPESVVKRLVRELERLLREVEKHLEDSKRELEDLLRRLRERLEELKKRHEDLLREAREETR

SEQ ID NO: 11341 - protein, 182 aa, Artificial Sequence; identical to SEQ ID NO: 11340
  Synthetic

SEQ ID NO: 11342 - protein, 182 aa, Artificial Sequence
  Synthetic
SLEETIEEVVRRNKETLDRARKKSEDVLRELERVLRELKRRTDEVARKLKEELDKLDREDEDLKRKIKRIEERLRELLETNRRMLERILEEAEKIHRRNERRLRELKKRTEKLLRDLKRDQVPEDVVRRLLEELERLSRDLERHVKRSEEEARDLLRKAREHVERSVKEIEDLLEDLKREAT

SEQ ID NO: 11343 - protein, 182 aa, Artificial Sequence; identical to SEQ ID NO: 11342
  Synthetic

SEQ ID NO: 11344 - protein, 182 aa, Artificial Sequence
  Synthetic
SLEETVRKAVRRNRETLRRLKRESEEAVKEAKEVLDRLREETERVLRKLEKRLRELRREDEELERLIEEIRRRLEELLKENEDLLKKIDDEVKKLLRENEDALRKLLEETERLVREAETKKLPKSMVDELLRTLEKLSDEIRRHVEKSKEDLERLLRELKKHVKRSVEEIEKLLEKLDKEAN

SEQ ID NO: 11345 - protein, 182 aa, Artificial Sequence; identical to SEQ ID NO: 11344
  Synthetic

SEQ ID NO: 11346 - protein, 180 aa, Artificial Sequence
  Synthetic
SEVDEILKRIKEVLKRNKENVERIKKRIKEELDRNRKNVERILRTIEKLLKELEDIARREGPRREVAERLRRELEKLLRDVEEDLRRVDERAEELKREVDEDLRRSEEEIRKLEEDVRGNDEELRKKVKEVMDRWRETLDRLREEVERVLEDWRRKLEELRRRVEKVLRDAERVIKKVEE

SEQ ID NO: 11347 - protein, 180 aa, Artificial Sequence; identical to SEQ ID NO: 11346
  Synthetic

SEQ ID NO: 11348 - protein, 174 aa, Artificial Sequence
  Synthetic
SEREEIERVLDENRRSLEELEREVEDALRTWEEELKKVEEAVRKVLEDVRRELEKDLKDAKELVKRVEKILRELEEEVREDKRRSKEAADKLRREVEKASEDNKRELDRLREALDRAEVEKIKTEVDDLSRKLRETVERLKTELKKVIDRNRKTLEDLERRARKLIKEARDAAK

SEQ ID NO: 11349 - protein, 174 aa, Artificial Sequence; identical to SEQ ID NO: 11348
  Synthetic

SEQ ID NO: 11350 - protein, 174 aa, Artificial Sequence
  Synthetic
REREKIEDLLRRNEKSLRDVARAVERILEEWRKVVEDLTERNKELLKEVEKVVRELLKDDKDLLRRIKEMLDRSREKTKRDKERSKEVADKLRDELRRLVKENRDRLRDLRRLLERLDVDEIAKELKRLSDKLREMLKRLTDKAKRLIERNEKTSRDNERELRKLIKEAEDAAT

SEQ ID NO: 11351 - protein, 174 aa, Artificial Sequence; identical to SEQ ID NO: 11350
  Synthetic

SEQ ID NO: 11352 - protein, 176 aa, Artificial Sequence
  Synthetic
SKEERLERLIEENKKSLDELSKRVEEVIKENKDVLKRLKEKIERLIEKNRRELERLKKDVDEDKARRLEESSERLETRARKIVEDMKKTSDELSEELKRVVEEMERSSRDLEREAKEREAREELERELRDHSRRLKEIVERIERKVREHIRELEKIVKEVEREVEEHIEKLERTVR

SEQ ID NO: 11353 - protein, 176 aa, Artificial Sequence; identical to SEQ ID NO: 11352
  Synthetic

SEQ ID NO: 11354 - protein, 176 aa, Artificial Sequence
  Synthetic
SDEDRLRELLKKNRESLKRLSDEIRRLIEENRDALRRVKETIKELLRKLKEVVERVRKDVDDDKVREIKKEVDKIEDKVRKILEEMERTSRELEKRLRKLLKEMDESSRRLADELRKRKADEEVRKTLEEHSRDLRRKVEELAREVKRHIRELEKILKEVKDEIEEVIRRIEETAR

SEQ ID NO: 11355 - protein, 176 aa, Artificial Sequence; identical to SEQ ID NO: 11354
  Synthetic

SEQ ID NO: 11356 - protein, 185 aa, Artificial Sequence
  Synthetic
SEIEDAAEKVRRNSEEAKRILDEHRERVKRVLEEIERLVKRAEERIEELIRTIERLRKDGRPTEDLAREIKRIVDEVRKALEEIKKRIEDLLREAEEHSKKVKKDLDRSNEELARTAEELKKRITDEEVRKKLEDILRKNEETSREIKKRLDRIDDDLRRVLEKAAKRLRDLLEKLREAVRRVET

SEQ ID NO: 11357 - protein, 185 aa, Artificial Sequence; identical to SEQ ID NO: 11356
  Synthetic

SEQ ID NO: 11358 - protein, 185 aa, Artificial Sequence
  Synthetic
SEIEKVKKEVEENSREAKRIVDEHKRLVEENSKEMEKLLKEAEDTIRKLLKEIKELKDRGLPKEELAREIRDILRRVEEKLRDIERRLDESNERLRRHSEKVKRDLDRSNEELEKRVRELEKRITDERMREKLRRALEENRRTSERLKRKLDDIDRDNERTSREVKEKLKRILEELKRTLEEVER

SEQ ID NO: 11359 - protein, 185 aa, Artificial Sequence; identical to SEQ ID NO: 11358
  Synthetic

SEQ ID NO: 11360 - protein, 185 aa, Artificial Sequence
  Synthetic
SEIDKARDEVRKNSDEMRKIIERHREKVEDNSRRMKETVRRVEEEIERIIREIEELKKRGLPKEELRRRIEELVKEVEDRSEEHKRDLDRSNEELRRHSEEVKRRLDESNKRLDDKLRELERRITDRRLREELRRIAEENKKTSDDLKKRLDRIDKENERTSEELKEENDRLLEKLRRAADRVKR

SEQ ID NO: 11361 - protein, 185 aa, Artificial Sequence; identical to SEQ ID NO: 11360
  Synthetic

SEQ ID NO: 11362 - protein, 185 aa, Artificial Sequence
  Synthetic
REIEEFEKDVRRNSEDMERIAREHEKLVRDLLRELKRLVDDLKRRLEELAEEIKSLREQGLPREELTKRIKEIVDKVRRELEELKKRIDDLLREARKHSEDVKRRLDKSNEDLERKLRELEKRITDERLRERLKRILDKNKETSDRIKKRLEDLNRELERVARELKKTIDELLRELEEVVERVRK

SEQ ID NO: 11363 - protein, 185 aa, Artificial Sequence; identical to SEQ ID NO: 11362
  Synthetic

SEQ ID NO: 11364 - protein, 185 aa, Artificial Sequence
  Synthetic
SLEEEVKKLLEELKKVADKLTKEVREADKKLEEVLRRVKRRLDEVDRRLEEEIKKVKSRITDERLRRRLDELLERVREHSKRLKERLDKILEDVNRRTKEMEERLRRIVKEVEELVEEVKRRKSDREELLERLKRRIDRLIEEARRLVEKWRDELKKLIDEVRKLVEDHERKVRDIEKKVRDESR

SEQ ID NO: 11365 - protein, 185 aa, Artificial Sequence; identical to SEQ ID NO: 11364
  Synthetic

SEQ ID NO: 11366 - protein, 181 aa, Artificial Sequence
  Synthetic
DAEEKARRVLEELDEALKRLAKKIKESIDKLKDVLRKLAEIIKRSLDELDEVLKRLASKLDKKDLDRIREELEKLKEDNKRDLDKIARELEELVRRNEDKLREIARDLERLKEELKRVLDRDGGVGEEILEELRRALEELKREVDELDRRNEEALERLKERVKRLNEDNRRTLERLEREVD

SEQ ID NO: 11367 - protein, 181 aa, Artificial Sequence; identical to SEQ ID NO: 11366
  Synthetic

SEQ ID NO: 11368 - protein, 184 aa, Artificial Sequence
  Synthetic
DVEELLRRLLEELRRVVKEVEDINRRSLEEARRVLKRLEDDHRRVLKELEDVLERLRRQGLPEDVVRTLTREIREMAEKHKKLLERIREAVKRSEEEHKRHTDDVRRTLETIERELEKVERRGVSRETIEELLRKVDRDLKRIRTTSEDLVRKNEELLEKLERESRRVVEESRKRLKEAEERTR

SEQ ID NO: 11369 - protein, 184 aa, Artificial Sequence; identical to SEQ ID NO: 11368
  Synthetic

SEQ ID NO: 11370 - protein, 184 aa, Artificial Sequence
  Synthetic
SVEEKLKDLEKENKDSLDEIRKLNEDSLEEAKRVLKKLEDTHRTVLRKLEKVLDELRKRGVPREDVERLKKIMEDAARKHKELLDDLRRKVKESEDRHRDHTRRVEEKSKELRRELEDVRRRGEDDDAIRKLRKKVEDTSRDLKRTSDDLVRRNRKLLKELEEESRKVVKESDEILRKMKEEVR

SEQ ID NO: 11371 - protein, 184 aa, Artificial Sequence; identical to SEQ ID NO: 11370
  Synthetic

SEQ ID NO: 11372 - protein, 184 aa, Artificial Sequence
  Synthetic
SVEEKLDELEKRIKEVLERIERINEESLRRAEEVLRDLEETNRRALERVRDVLRRLEERGVPEKDVDKLRRIVEKLERDHRDLIRRLRELVKRSKERHEEHTERVRRTIKRIREELEDIKRKGVDDDAIRKLLETVDRRLKELTETSKRLVEENRDLLRRAKEESKRLVDESEKVLEEMDRETR

SEQ ID NO: 11373 - protein, 184 aa, Artificial Sequence; identical to SEQ ID NO: 11372
  Synthetic

SEQ ID NO: 11374 - protein, 184 aa, Artificial Sequence
  Synthetic
SADETLEELEKELRRVVDEVRRTNEEANKRLREVLRKLEKKNDDVLRDLERVLKELEDRGVPEEVVRRLRKIVEDLKREHEKLIKKLREEIKRIIDDSRRHIRDVERILEKIRKELKDIRDKGVSEETIKKLREDVKRELDRIKTSSKKLVDDIERRLRRMEEESRKLAEDSRRILEEMRKEVT

SEQ ID NO: 11375 - protein, 184 aa, Artificial Sequence; identical to SEQ ID NO: 11374
  Synthetic

SEQ ID NO: 11376 - protein, 175 aa, Artificial Sequence
  Synthetic
SEVEKLVDEIKKELKRLRETSKKLLDEIRELLERLKRSSKKLVDDIKRILEELKRRNLPREDVERLLREIRKRVEEHKKRLREALERVERRVRDHNRELRRVLEEVERKVREIEKRGVDKDKLEKALRDARKVVEDIERTNREILKRVRDMVERIREDNDTVLEEVERMAEEVRK

SEQ ID NO: 11377 - protein, 175 aa, Artificial Sequence; identical to SEQ ID NO: 11376
  Synthetic

SEQ ID NO: 11378 - protein, 185 aa, Artificial Sequence
  Synthetic
REIEELKKKVEKVLRELRKSSEEMKRRVEDLIRRLKKSSKDLERKVKDLLKKAEEKVRRDGTTDELKRRLEKEARDLERELRKHDEDVERKVRKLKEELKRHNEEVEDIIRRVEEELKRVADKIDDEEARRRLEEVVRRLRKVLDDVRKINKEVVDRLKKALDEVKRTNEDVVRDLRKVLEELKT

SEQ ID NO: 11379 - protein, 185 aa, Artificial Sequence; identical to SEQ ID NO: 11378
  Synthetic

SEQ ID NO: 11380 - protein, 177 aa, Artificial Sequence
  Synthetic
SEIEKLKEEIRRLLEEIKRHAEENKRRVETALRDIERHVEENTRRVAKVEEEIKKLKDRVRREELDEILKRVKDHLEEAKRRIKEILRRVEEHVKRSKRRIDELLRRLKEKVARIKEAGVDKDELDKVEEEAKRVAEEVKEIHDRVLEEVRRVVDRVLKAHDEVLRRLERVVREVKR

SEQ ID NO: 11381 - protein, 177 aa, Artificial Sequence; identical to SEQ ID NO: 11380
  Synthetic

SEQ ID NO: 11382 - protein, 177 aa, Artificial Sequence
  Synthetic
EEEKRLRELEKRNEDVIRKAAEDVREILRKNEEVLKEAEDRIKRLIDEDRRVLEEVKRDDSRDDKLRKVTEESKKLVRETERVLEELKDSSRKLKEELKKLLDELRDSSEKLKDDLRKRRVDEELEREVRKHDKEVKEVIDRLREKSERHIREIERIVDELRKKHEATVRKLKKDVK

SEQ ID NO: 11383 - protein, 177 aa, Artificial Sequence; identical to SEQ ID NO: 11382
  Synthetic

SEQ ID NO: 11384 - protein, 177 aa, Artificial Sequence
  Synthetic
DEDETLRELEKKNDKALDDARRTIEEVIRRNEEVLKRAAEEIEKLERKNKRVLEEVKRRDSRDDVLRKIEDSSRKLKEDLRRVLEDLKRTSEELKRKLREVLKRLEDSSRRLKDELRKRRVTEELAEEVKRHDDRVRKEIEKLKREVEKHDREVKETIDRLAKKVDDHLKELRDTTR

SEQ ID NO: 11385 - protein, 177 aa, Artificial Sequence; identical to SEQ ID NO: 11384
  Synthetic

SEQ ID NO: 11386 - protein, 189 aa, Artificial Sequence
  Synthetic
DEIKEIEETVERLVEELKRIVEEWREESKRNVDELEKRIRDIKRRIDEAIKTLEELKRRGLPKEELSERIKRILEKLKREIDKVKEEVRRSHKDLDRKSKEIETRIRKLLEDLERKIREAKKRMKDDSRVEELRRALDELLEKARKVVEEVEKMIKEVNDRNKKVVDELKRTLDKILKDLEEVAREVDR

SEQ ID NO: 11387 - protein, 189 aa, Artificial Sequence; identical to SEQ ID NO: 11386
  Synthetic

SEQ ID NO: 11388 - protein, 189 aa, Artificial Sequence
  Synthetic
SEIEKMKRDSDENIKRMEEIARKWEKESRDNIREIEKRVEDLKRRIEKVIREIEKLRRDGRPDEDLKRKLDDDLRKLKEEVEKLKEDLRRSHEDLDRRSKEIKREIRESHRKVEEDIRRIEEELRDDKDLEEAKRKLEEVLDKNRRVVEKVERRIDRINDRNREVLERAEKELDDILRKLEEVVRRAEK

SEQ ID NO: 11389 - protein, 189 aa, Artificial Sequence; identical to SEQ ID NO: 11388
  Synthetic

SEQ ID NO: 11390 - protein, 182 aa, Artificial Sequence
  Synthetic
DEIREAKKRLDDIVTELRDHIRRSKERHERLVKELERHIRELEKKVRELIKRLDDAVRRDGKVDEELLRRLRETAKRDAENVEDVNRRLEEELKKNKEDVDRMNDTLRKRLEEIAKEVSRMDKEEVKREITRLLEDLKRVSREHREEIRKLLETTREVSKRHREKVEDLLRKLEEVLERVRT

SEQ ID NO: 11391 - protein, 182 aa, Artificial Sequence; identical to SEQ ID NO: 11390
  Synthetic

SEQ ID NO: 11392 - protein, 182 aa, Artificial Sequence
  Synthetic
SELEEIARLAEEIERKLRESLRESDKMHKKLNKENEDLLEKIRKEVEDIIKKLRDLKGTSEKILKDLAKEVEDVIRKIEELVKDAERRNREALERDRRKNEELRREVRKVIEDIKERVRRVRDERVEEAVRRVVEKIKDVVEKHSDASRRLNEELKESVDRLRREVEKLVEKIRKVVEDLRK

SEQ ID NO: 11393 - protein, 182 aa, Artificial Sequence; identical to SEQ ID NO: 11392
  Synthetic

SEQ ID NO: 11394 - protein, 185 aa, Artificial Sequence
  Synthetic
SDLERVEKESRDHIDTLRRIVERVEEHVRRSIKTLDELVDRARRSVERLIEELEEMKRKDKDKEKMTRKIEKLLKDAEDEIRKLKKEIRELHKRNEDEVRRVKEEIRKSLKEVEDRIKEIRDKTTDRRVEEELRRLLEENRRVVEEVEKELDRLLKESEDAVRRVEEALDRLLKELERVAKEVKD

SEQ ID NO: 11395 - protein, 185 aa, Artificial Sequence; identical to SEQ ID NO: 11394
  Synthetic

SEQ ID NO: 11396 - protein, 185 aa, Artificial Sequence
  Synthetic
SDLEKVKKDSDDHIRELERLVRRAEEHVRDSVRRLREIVEELDRDVRRLIEELKDLKRKIRDKEKLIRTIRRLLEELERKVREIKKRIREENEKNEREIRKLKEEIRRSLEEVERRLREIKKKTTDEDVKKKLDDLLRENREAVKRVERALDKLLTDDRRVVEEVERALDELLKRIEKVAREVEK

SEQ ID NO: 11397 - protein, 185 aa, Artificial Sequence; identical to SEQ ID NO: 11396
  Synthetic

SEQ ID NO: 11398 - protein, 185 aa, Artificial Sequence
  Synthetic
RDVDELRKESEDHIRELRKLVEDVRRHVKRTNDDLERLVKEVDDTLKELIKEVKELKRRVTDKEELVRRLEKLLRDLEKKARELKEEVKRLLERNRETLEKLERELKKSLDELEKRADDIRRKTTDEDVKKKIKDLLDTNREVVERVLRTLRDLLRRNKEVIDRILETLDELLERVKREIEKDAK

SEQ ID NO: 11399 - protein, 185 aa, Artificial Sequence; identical to SEQ ID NO: 11398
  Synthetic

SEQ ID NO: 11400 - protein, 185 aa, Artificial Sequence
  Synthetic
DDAERAKEESERHIKRLKDLVEELRKHSERTDEEIKELLRRLEKTVRDLIRELERLKEEIKDKDTVTRRIDKLLRDLEEKVRDLKRRLKKLLEDNKARVDELREDIKRSLEELERRVREIKEKTTDEDVKRKLDKLLKENEDVVREVDRALKELLRKNAEMLERAKERLDRLLEEVKKVADEVRR

SEQ ID NO: 11401 - protein, 185 aa, Artificial Sequence; identical to SEQ ID NO: 11400
  Synthetic

SEQ ID NO: 11402 - protein, 182 aa, Artificial Sequence
  Synthetic
SIEEELERLLRKNEDSLRRVRDEIRRLEEEIRRVLKKWRDEARKLLREIERVLKEVAERKGKREELDEILERVERDIEKSERDLRRLEEEVKKLVTDIEKAIKDIEDESRKAIEEVRRKRSTDETLLRDLERKSKEVDERLEELLRRAKERVEELIREIEALLDRNRRNVERLIRELERRTD

SEQ ID NO: 11403 - protein, 182 aa, Artificial Sequence; identical to SEQ ID NO: 11402
  Synthetic

SEQ ID NO: 11404 - protein, 179 aa, Artificial Sequence
  Synthetic
EELERLLEDVKRTLKELRDRAKEVLDRVRKTLEELKRELKRVLDEVTELLERLRRIVKREGKVEETLKRVEEELRRLAEEVKRLNEEHRRKLERLAREVRKLNEEHRRRLEELTKRAEDKGLDKRIIKEARERVETVNRETKKILEEIARTVEKVDEESRRILEKVKRDAERVLREIKK

SEQ ID NO: 11405 - protein, 179 aa, Artificial Sequence; identical to SEQ ID NO: 11404
  Synthetic

SEQ ID NO: 11406 - protein, 180 aa, Artificial Sequence
  Synthetic
DELEEVEKEVKRILEESRRLLEELEREVRELLERSKRILEELEEEVRRLLEKLKRVRTRGEKDLEELIKTEVRRLEKKIKDLLDKDREMLKRATERLEKVYRENRELIERVKRKLDDLARRKRKDEELERLKRELDKVHEEVREKVERAKRELERVHKRSEEEARRLKEEVDKVLDELRK

SEQ ID NO: 11407 - protein, 180 aa, Artificial Sequence; identical to SEQ ID NO: 11406
  Synthetic

SEQ ID NO: 11408 - protein, 186 aa, Artificial Sequence
  Synthetic
SELDELRKRVEEIVEENDRVLRELEKRVRELSERNKKTLKELTKRVREILERLKELKDRGEDKDTLDKAIRRVEEEVKELVERVTRHDEESKKEVRKLVDEARKHLEESKKRVDDLKRKVEKRLGQLEEVKEVVRRLEEKVKESLDRAEKVLRRLEREARESNRRHEEEVRRLKEEIDRVVTELRR

SEQ ID NO: 11409 - protein, 186 aa, Artificial Sequence; identical to SEQ ID NO: 11408
  Synthetic

SEQ ID NO: 11410 - protein, 186 aa, Artificial Sequence
  Synthetic
SLEDVLREVEERIRKSLEEHRKVTDEAEKELRRIVEDHKRVLEEVKKEIEDVIKELKKESVDEEEVRKLVRELREALKRLEKHSKDLEEEVKRVVEEMRKRSKELKERNDKVLDELRKKVKDSDDEKEKVAREIRETVKKLHEDNRRMSEEIKKTVERLLDKLRRSLERIRREAKDLVRKIEDLRR

SEQ ID NO: 11411 - protein, 186 aa, Artificial Sequence; identical to SEQ ID NO: 11410
  Synthetic

SEQ ID NO: 11412 - protein, 186 aa, Artificial Sequence
  Synthetic
KLEEVLRKVAEDIKRSLEDLKRVLKEVADHIRRSLEELRRVLERVKKEIEDVLRELENSELDKRAVDKIVKEVKEALDELEEAVRRVAKENEDALRKLAKDVEDVARRNKEAVDRARERVDKSDDDADKVAEDIRRDVRRLDEENRELAERIKRAIEELDRKNKDLARRIEDAVRRLLEKIKEAVR

SEQ ID NO: 11413 - protein, 186 aa, Artificial Sequence; identical to SEQ ID NO: 11412
  Synthetic

SEQ ID NO: 11414 - protein, 186 aa, Artificial Sequence
  Synthetic
DLEEVLKEVEKRIRDSLKDLKRVLDEVLDHIRRSLKENRDSLRKLEEDLRRVLEELRRTDLDERVVKKIEDEIDKVVKRMEKVSRDLEEDNRRVLEELEEEVRRVMKENKDVLDRLRDEVTRSDDDEKKVAEKIRKEVKELDEKNKELARRIRDVAKKLDERNKDVSRRLAEEVERLLRKIKEKVR

SEQ ID NO: 11415 - protein, 186 aa, Artificial Sequence; identical to SEQ ID NO: 11414
  Synthetic

SEQ ID NO: 11416 - protein, 186 aa, Artificial Sequence
  Synthetic
DLERVLEKVARDIEESLRRNKESLKRLKEHVEESLKENRKSLEDLRKKLKDVLDELKKTELDESEVKEIEERVKKVEEDLERKSKKLEDENRKAVDELRKLSEDLERKNRKVLKELKDEVKDSDDEKKKVADKIREEAKRLDKENREASDRARDVVRRLDEKNKKLSEEMKRTVERLLETLDRKMR

SEQ ID NO: 11417 - protein, 186 aa, Artificial Sequence; identical to SEQ ID NO: 11416
  Synthetic

SEQ ID NO: 11418 - protein, 186 aa, Artificial Sequence
  Synthetic
DLERFLEEVARKIEKSLEELRRVLEEVRDRIRRSLEENTKSLERLTEEVRRVLERLKDTDLDKKEVEDIEREVRRVERTMRELSKKARRDNTEMLRDLARKVDEVEKENKRVLERLREKVKDSDDDEDKVAKEIEDEVRRLDEKNRKLAKEIRDEIRKLDKENKDLSKELRDRVEELLRKIEETVR

SEQ ID NO: 11419 - protein, 186 aa, Artificial Sequence; identical to SEQ ID NO: 11418
  Synthetic

SEQ ID NO: 11420 - protein, 178 aa, Artificial Sequence
  Synthetic
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKAREVADELKKRLKRANEESERVLRELAERNKTALEEAERVLRRLKEEIEKVLRKLKK

SEQ ID NO: 11421 - protein, 178 aa, Artificial Sequence; identical to SEQ ID NO: 11420
  Synthetic

SEQ ID NO: 11422 - protein, 182 aa, Artificial Sequence
  Synthetic
SEVEDLRRRVEEIKRRVEEILRENKEVSEKSIRELERLLEELKRLVDELLKRLEELKREGRDKKEELKKLLEDAERLLRKVEEEIERLKRESEDHLRRSNEEVDELVKRMEELLKEIEKRSRDDDLRRALKDVVDEVKKVVDELREENDRLRKENKRAVDEVRKELERLLRDVERVIRRAEK

SEQ ID NO: 11423 - protein, 182 aa, Artificial Sequence; identical to SEQ ID NO: 11422
  Synthetic

SEQ ID NO: 11424 - protein, 182 aa, Artificial Sequence
  Synthetic
EELDRLRRHADESRKRAEEILKRNEEEIRRLVEELKRILKTNEDVLRDLEKKLEDLKRRGERREEDLRKLLEDAKKHLTDSNKRLEELKERIERHLRRSNKELEDILETNRETLKELEKRSRDDKLRTTIDEVRRRSKKVLDDLRDRNRRLLEEVDRAIKEVRETNEELLRRLKRVIDEVRR

SEQ ID NO: 11425 - protein, 182 aa, Artificial Sequence; identical to SEQ ID NO: 11424
  Synthetic

SEQ ID NO: 11426 - protein, 185 aa, Artificial Sequence
  Synthetic
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKEEVVKKLVEDVERELERSLREAEDLLRRVEEVIRTSKKESKDVLEKIERLLRDLERRTR

SEQ ID NO: 11427 - protein, 185 aa, Artificial Sequence; identical to SEQ ID NO: 11426
  Synthetic

SEQ ID NO: 11428 - protein, 180 aa, Artificial Sequence
  Synthetic
SVAEELKKEVDDLLRDLKKKLDDVRRDHERLLRELEEHLERSRERVERLLRTLEDVARKGRVEEELLKELKKRIDEIAKENRDLLKELEERSRDTLRKLRETLKKLKKRVDDLIRKVEEEKKIDRKVIEKIERDIRKILKEVEEVLRTLKKKSDEILERAKRVTEKIERDVTEILERIKK

SEQ ID NO: 11429 - protein, 180 aa, Artificial Sequence; identical to SEQ ID NO: 11428
  Synthetic

SEQ ID NO: 11430 - protein, 180 aa, Artificial Sequence
  Synthetic
SVADELRKTAEELLKRLREHLDTSRRRVEDLLRRNEKKLRDVLREVKKLLDELRELKERGRVDDEVLKELKKRVDDLIRELEETNRKTREDIRRILEENRKLLEDLRDEIRKLEEKVRRDNKAPEDVIREIKDRVRRILDEARRVSEKLRRDVEKINRESREVLERIKELIKRILKEAKD

SEQ ID NO: 11431 - protein, 180 aa, Artificial Sequence; identical to SEQ ID NO: 11430
  Synthetic

SEQ ID NO: 11432 - protein, 178 aa, Artificial Sequence
  Synthetic
SELEELLREVDDSLKKLETEAKKLLDEVRDSLRKLEETLRRVLREVEEELKELEKENSKDDRTLERVKEMLDRVAKRIKDMNREHRKKVKELEDRVRELNKRHRDKLEELAREVSKNSDKRVEDVLREIRRRAREINERLKKILKEAKEVAEKVNEETRRVLKEIKELIERVLRELRK

SEQ ID NO: 11433 - protein, 178 aa, Artificial Sequence; identical to SEQ ID NO: 11432
  Synthetic

SEQ ID NO: 11434 - protein, 176 aa, Artificial Sequence
  Synthetic
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 11435 - protein, 176 aa, Artificial Sequence; identical to SEQ ID NO: 11434
  Synthetic

SEQ ID NO: 11436 - protein, 179 aa, Artificial Sequence
  Synthetic
DEAEKAKRDSEKVVEDNRKMLEDSTRRAERLNEENKKELKKSTEEAEKILREIDETKRRGTDDEVVKDLIRRVEELLERSRKKLEDLTRDNERVLDESRRRLEKLIRDNERIVKDLTDRVVRVDEVLKRLKEEHRRLIEELEEVLRRNEEIIRRSIEDLERVLDRNRRELEDVIRRLKE

SEQ ID NO: 11437 - protein, 179 aa, Artificial Sequence; identical to SEQ ID NO: 11436
  Synthetic

SEQ ID NO: 11438 - protein, 179 aa, Artificial Sequence
  Synthetic
REAEEVERKVEELNRRNRKVLDDARKESEEVVRRNREFLRRLEERVRTILRELDKRKRDGTSEEVIKRLIDRVRKILEDIRRLVDELIKRNERIVEKLTRIVEELIRRNKKLLEDIRRELVKVDEVLRRLAEDIERSIRELEKVLRELERIHRELIKELKEVLKRLEKDAKEVIERLRT

SEQ ID NO: 11439 - protein, 179 aa, Artificial Sequence; identical to SEQ ID NO: 11438
  Synthetic

SEQ ID NO: 11440 - protein, 186 aa, Artificial Sequence
  Synthetic
SLAEEIDKTIRELAKRHEKTVEDIKKIITELEKKHRDTAEELERIVREIEKKIRELKKRLKDDKDKLRELKDELRRILEDAARKSKRVVEETEEVNREINKRSEEVVRDTERVLRKIADDLRRRIRREELERVLREAEETLRRLIEKDEKVNREADEKSERLIREDEKVLEDVAREVERLLRELDK

SEQ ID NO: 11441 - protein, 186 aa, Artificial Sequence; identical to SEQ ID NO: 11440
  Synthetic

SEQ ID NO: 11442 - protein, 186 aa, Artificial Sequence
  Synthetic
DEDREARELVERLREEHRRTAEEIKKIIEDLERKHRETMERLKRIIEKIERDIRRLKRDLKDDKEMVERLKKKIKDILKKLAEESKKVVEETEKVNEDINRKSKEVIDRSRKLLEDLRRKLEERSRDKELERVLEKVARDLKKLVDDDRRVNETANRRSRKLIEDDKRVLEEAAKEVKRLLDELDK

SEQ ID NO: 11443 - protein, 186 aa, Artificial Sequence; identical to SEQ ID NO: 11442
  Synthetic

SEQ ID NO: 11444 - protein, 171 aa, Artificial Sequence
  Synthetic
DTERTVKEKIRKWKEDVERVERRLEELVDRARKLSKENVDRMRELVRRLEDRVRKDPDKDKLRKEVERLERRIEESHREVKELVERIKKEIKELVDELHRRSEDIKRDLEEKVRVREVLEDARRKIDELNERVERVAETVRRKLDKILEDNKRVVERVKEEIRRVLEELER

SEQ ID NO: 11445 - protein, 171 aa, Artificial Sequence; identical to SEQ ID NO: 11444
  Synthetic

SEQ ID NO: 11446 - protein, 174 aa, Artificial Sequence
  Synthetic
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 11447 - protein, 174 aa, Artificial Sequence; identical to SEQ ID NO: 11446
  Synthetic

SEQ ID NO: 11448 - protein, 185 aa, Artificial Sequence
  Synthetic
DLEEVAKEVKKALDELLKRNEDSARRVKEAIRELLKRINDVTREVEETLDRLLKEVEDGGVPEEDLKRAEDEVRRLKEDLKRRDERLERAARTLEREIDKLLDENRRKVERLKEEIDDLARKGQPAERVVKRLEELLREAAEHSKRSNDELERLLDRLRREVERYERELEKRKKEAKELADKLRK

SEQ ID NO: 11449 - protein, 185 aa, Artificial Sequence; identical to SEQ ID NO: 11448
  Synthetic

SEQ ID NO: 11450 - protein, 182 aa, Artificial Sequence
  Synthetic
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLREAGIDERVIKKAEEDVRRLLREIEEVSERHKREVDRLEREIEEVSREHKERVEKLLREIER

SEQ ID NO: 11451 - protein, 182 aa, Artificial Sequence; identical to SEQ ID NO: 11450
  Synthetic

SEQ ID NO: 11452 - protein, 182 aa, Artificial Sequence
  Synthetic
KLEEDLKRILDELRRMAKEIIDRLEDHLRKIKKDVDKLSKENKDHLKEIEDTVRELKRNNLRREDVKRKAKELEKNVKRANEETERKLRELEKNVKEMNTDVKRRIDELVKRAKDILDRLREEGIDERVIKRVDEEVKKLAEEIRKVSEEHEKRVKKLLKEIEKSSEDHRRRVEELLREIDR

SEQ ID NO: 11453 - protein, 182 aa, Artificial Sequence; identical to SEQ ID NO: 11452
  Synthetic

SEQ ID NO: 11454 - protein, 177 aa, Artificial Sequence
  Synthetic
SEEEEVEEELERHHRDVEEYVKRLKELLDKLRRKNETTVRDIARLAKKHHDDVDELKKRNIDEETKDRLREKTEELKRRLEEVKRRLEEEHKRAEDKAREDNERKKRESDRKEEELRRRNVSREVLKRFKDKVKENRDESERVHREIKERLEELKRKNEDVLRKVKKILDDNEERLR

SEQ ID NO: 11455 - protein, 177 aa, Artificial Sequence; identical to SEQ ID NO: 11454
  Synthetic

SEQ ID NO: 11456 - protein, 180 aa, Artificial Sequence
  Synthetic
KDLEKLVEDIRRLLEELKKTVEDNKREIKELLDRLREKVKENLKRHKELNKRLRDTGAVSEDELRETEKKSRELEKRSRDLLKKLEERVEEIERRSDEELKRLEDRVRKIEDDLRREGDRGKEVKDRIEEVLRELREAVRRHHEKVKEVLRELKEALDKHHKDVTDSLRDVERLVEEARR

SEQ ID NO: 11457 - protein, 180 aa, Artificial Sequence; identical to SEQ ID NO: 11456
  Synthetic

SEQ ID NO: 11458 - protein, 174 aa, Artificial Sequence
  Synthetic
SEKEILDEIRDRIRKLLEEIKDYLEKSKKKIRDLLEKIKKVLEDNKERVDRLLDVIRKNRIRDEDLKKAIEEDERRLEKIRRELEKAKRDIEKANEELEEKLRRAATKIKEDLDRKNIDDDVRREAKRLLEEVAEAVRRIHETSKRLLERVDEEMKRVEETIRKTNKEVEDAKR

SEQ ID NO: 11459 - protein, 174 aa, Artificial Sequence; identical to SEQ ID NO: 11458
  Synthetic

SEQ ID NO: 11460 - protein, 176 aa, Artificial Sequence
  Synthetic
SDVEKLIRDAEKKMDDFRKDSERLVRELEEKLKRHEERVRDLLRELKELLEEVRRKDSRDEELRRLEEEIDKKLEEVDRRTEELKRRIDKELEDHRRKLEKLREELDRTLEDLVRKKGRSSEKIKEAVDRIKKALRDSHKELAEVVERIKRKLDETNRELKDEARKIKEELRRVEK

SEQ ID NO: 11461 - protein, 176 aa, Artificial Sequence; identical to SEQ ID NO: 11460
  Synthetic

SEQ ID NO: 11462 - protein, 182 aa, Artificial Sequence
  Synthetic
SEVETVKKRLEDSTKESEDTVRKVKRELERLIERSEDTLRRIKKRLDDLIRTIEDLKRRGNSDDRMEKRLEDELKKIEDELRKYHEEVKRKLDELRKELRREDERVTREHDTLREELTRREGGKELLDTLRRLLEENKRRHKETVDEIERLIKEVERANREILTRIKKALDDVRRAVEEIKR

SEQ ID NO: 11463 - protein, 182 aa, Artificial Sequence; identical to SEQ ID NO: 11462
  Synthetic

SEQ ID NO: 11464 - protein, 174 aa, Artificial Sequence
  Synthetic
REVEEVLRKVREDSKRNKDELKRLLDEARKESEDNKRDLEKLLKEVREEVRRVEEILRKTRIDDEELERLKKRVREAEKRVEDRTRELEKRVREVEKEVKKRNRDMEETVKDIRRKLKDEDVLREIETLLDKNHKDNKKVLDDIRELLKENADRNRRVLEEIKKLVEDVERKVK

SEQ ID NO: 11465 - protein, 174 aa, Artificial Sequence; identical to SEQ ID NO: 11464
  Synthetic

SEQ ID NO: 11466 - protein, 179 aa, Artificial Sequence
  Synthetic
DEDEKALREIKKLIEDNERLNREVNERIERLIDRARRLMERVNREIERLIKEVRERLGEEDKRAREILRRLKEELKKHKKESDDLLEKLKRRLDEHRKDSKRSKDDLKRELDRVAAKRLRGEELEKTLRDIRKRSKEDADKVKKSLEEVEEEIRRIEKRLRESLKKVEDDIERIRREAT

SEQ ID NO: 11467 - protein, 179 aa, Artificial Sequence; identical to SEQ ID NO: 11466
  Synthetic

SEQ ID NO: 11468 - protein, 176 aa, Artificial Sequence
  Synthetic
SEIEKLTKEIRDLIRTSREEIKKLMEELERNVREAEESIKRLLEKAEELIRRIAEENKDVRELLKKLEDDLRELAKELKKVVEDSRKKLKELIDELKKYIEDLDEELRRLEDVLRRNQTRKEDVKRELERIKKSSDDVRKKVEDESRKHREEVERLERELDRKLEDIRRKVEETKT

SEQ ID NO: 11469 - protein, 176 aa, Artificial Sequence; identical to SEQ ID NO: 11468
  Synthetic

SEQ ID NO: 11470 - protein, 186 aa, Artificial Sequence
  Synthetic
SEIEKLAEDVERIAKKIEDVVRELRKANEDIIKEVRDINKELRDKVEEILRRIEKIVRDRLKDDKDEIDKVERDIERIRDEIRKSSKRVEDTIRRSERETDKLAREVEDTIERIREELEEVKRRQVDKEILDRIRKKLRETLERVRDRLRKYLEDLERRLEELRREHRKTLEELKEKLKRLADRVK

SEQ ID NO: 11471 - protein, 186 aa, Artificial Sequence; identical to SEQ ID NO: 11470
  Synthetic

SEQ ID NO: 11472 - protein, 178 aa, Artificial Sequence
  Synthetic
SEVEDLERRAREVNKRIKDLIDRLRERVRKIEEDIRRLNKELKEEVDKIIEEIRKDGGENREEVRRLEEEIKKKIEESNRDVERVIKEIREKIRELKKRADDLSEESKRKIEEVRRVRDGKLIEELLREHEKMLKEIEDRIRKIERELDELLKTLEDKHREILDELEKELRKAKERRR

SEQ ID NO: 11473 - protein, 178 aa, Artificial Sequence; identical to SEQ ID NO: 11472
  Synthetic

SEQ ID NO: 11474 - protein, 182 aa, Artificial Sequence
  Synthetic
SDIERILEENEKTNRENRKRIEDIRRELEERLDRNRRRIEEILRRAEKMLEEIEDIFRRSDISEDIVREAEKTLRDIKRELDENLRRNEETARRIEEELRENLRRNEEKHRRIEKRLDEKVRDEDKLRDLKKKLRDSLRTLEELHRKLKKDLDEILRRLEELHRKLKEDLDRILKAVRDTAK

SEQ ID NO: 11475 - protein, 182 aa, Artificial Sequence; identical to SEQ ID NO: 11474
  Synthetic

SEQ ID NO: 11476 - protein, 182 aa, Artificial Sequence
  Synthetic
SEIEDIKRRNEENNRRNKKRIDDILEELKRRVEENRRRLEDIERKLREDKERLKDIFRRSRIDDKAVEEAKRRLERIKEELEKNLTRNKDDAERIKRELDENLKRNEELHRRIREDLRRRVTDEDKLRKLEEDLRRSLETLREIHRKLKEELDRILEELKRLHERLKRRLDEIADEVARTAR

SEQ ID NO: 11477 - protein, 182 aa, Artificial Sequence; identical to SEQ ID NO: 11476
  Synthetic

SEQ ID NO: 11478 - protein, 182 aa, Artificial Sequence
  Synthetic
SDIEEIERRNRENNERNKRRIEEIEKRNREENKENEKDIERILRRAEELLKRAKEILRESDISEEVLKEMEERIKRIKERLERNLRRNAERHKEIKKELRENLERNRELHKRIADELRRRVRDEKKLRELKKKLDDSLRTLEELHRELMKRLDESLKTLKELHDELKERLDRILKEIRDDAK

SEQ ID NO: 11479 - protein, 182 aa, Artificial Sequence; identical to SEQ ID NO: 11478
  Synthetic

SEQ ID NO: 11480 - protein, 182 aa, Artificial Sequence
  Synthetic
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 11481 - protein, 182 aa, Artificial Sequence; identical to SEQ ID NO: 11480
  Synthetic

SEQ ID NO: 11482 - protein, 175 aa, Artificial Sequence
  Synthetic
SSVERFEKAVKESIENIRRLLEELEREIRESMKHLRELVKELKEALDRIVERLRRTVRDEDELRELIKELEDIVRRAEEKLERYRKRLEDLIDEARRTVEDVERRHREKIEEVRRRNRVEEEDLKRLDKENKDIEKKIRDLVKEARDENRKLKRDIERTLRELEERLKEVEDRET

SEQ ID NO: 11483 - protein, 175 aa, Artificial Sequence; identical to SEQ ID NO: 11482
  Synthetic

SEQ ID NO: 11484 - protein, 179 aa, Artificial Sequence
  Synthetic
SDIEKRLEENERHNERSEERIRELLKELEDHLRRTKREIEKKLEDLKRLLDRLREEDVKREEALRDLAEKVKKIKRELREHHERNRRKVEEIKEELRKHHEDNKETHERIKRDLDRKIRGNEELKRVKDELDKSLKHSRELIERAKERLEEIKKRSKELVDRAEKRLDEILKEVKDDFD

SEQ ID NO: 11485 - protein, 179 aa, Artificial Sequence; identical to SEQ ID NO: 11484
  Synthetic

SEQ ID NO: 11486 - protein, 179 aa, Artificial Sequence
  Synthetic
DEIKEREDDVKRHLDRTREEIEKLLKEMEEHTERSRRKIKKVAEDAEERLRKVEEENSKDRRVLTKLKEDVERLKEELKEHLRRNKKTVEDIKRELREHLKRNKKRVEDIKRELDRDIRGNKELEEVKRKLDRILEESEKLVREAEKRLDELLKDNKRLVEELEKELDRILEELRKRVD

SEQ ID NO: 11487 - protein, 179 aa, Artificial Sequence; identical to SEQ ID NO: 11486
  Synthetic

SEQ ID NO: 11488 - protein, 176 aa, Artificial Sequence
  Synthetic
DSIEDLERRAKESDDHLEKLIRELRDELRRSLETVRRNIEDLRRTLEEVLRRLEEDGADKDLLKDLADKVDTIRKELERSLEEHRKRIEEIEERLKDLHRRHRERIEKIKKDLKDVGEEMLREIKKELEETNKRAEDDVRKIREELREHNERHKERSKRIKEELKRTLDELKKKRK

SEQ ID NO: 11489 - protein, 176 aa, Artificial Sequence; identical to SEQ ID NO: 11488
  Synthetic

SEQ ID NO: 11490 - protein, 186 aa, Artificial Sequence
  Synthetic
SRIETLVRRMKELLKEVEDKSEKSKRRWEDRLKKVAEDSKRRVEEMDRELDEVRRKRERGDRDRKEFSDELRKIKEELDKKLREHHERIKEIEKELEDENRKHHEEIKKIKKELDDIVKEAAEEGADERLLRELKRIVDEVKKELDRLDTEHNKAIEDVKRELRKLDEEVRRIVERVKRELDRLEK

SEQ ID NO: 11491 - protein, 186 aa, Artificial Sequence; identical to SEQ ID NO: 11490
  Synthetic

SEQ ID NO: 11492 - protein, 186 aa, Artificial Sequence
  Synthetic
SEIEDLIRRIRETLKRVEEDSRRSKEEAKRKLDKVKEDSERLVEKMRRDLEKVKRETDKGDRPDEDLRRKLERIKKELERELKEHHDRIERVKRDLRRLNREHHEKIRKIKEDLKRILDDAARKGADEELLKRLKEVVEDVIRKLDRLDKEHTEIVEEVERRLDKLDKDVERIVEEVKKALDETEK

SEQ ID NO: 11493 - protein, 186 aa, Artificial Sequence; identical to SEQ ID NO: 11492
  Synthetic

SEQ ID NO: 11494 - protein, 186 aa, Artificial Sequence
  Synthetic
SEIEKLIEDIRRRLKKLEDESRKSVKDARDMLRRVEERSRDSVRKMREELERVEDESRRGDRPKEALEEIIRRIKKKLDENHKRHHDEIEKIKEELERLNREHHDRVRRAKEDLDRILEKAAREGLDDELLKRLEDVVRDVKRKLDELDERHTRIVEDVKRRLDDLDREHRKIVEEVKKELDKLLK

SEQ ID NO: 11495 - protein, 186 aa, Artificial Sequence; identical to SEQ ID NO: 11494
  Synthetic

SEQ ID NO: 11496 - protein, 186 aa, Artificial Sequence
  Synthetic
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 11497 - protein, 186 aa, Artificial Sequence; identical to SEQ ID NO: 11496
  Synthetic

SEQ ID NO: 11498 - protein, 186 aa, Artificial Sequence
  Synthetic
SEVEEEEKTAEKILEEVAEEIKESIKRIREEVKKNEDDSERSVREMERRLREVEERIRRGDKPKEAVEKEVREIKDELRRNHEEHHRHLRRNERRLDRENEELRRRLEKIKKELEDRLRRLAEEGQDEELLRRLKRVVERVKERLDRLLEEHTRVVEEAKERHRELDERHEKIVRDVVRELDRRVK

SEQ ID NO: 11499 - protein, 186 aa, Artificial Sequence; identical to SEQ ID NO: 11498
  Synthetic

SEQ ID NO: 11500 - protein, 186 aa, Artificial Sequence
  Synthetic
SEVEKVVKELEDELRRVAEDSERSIREMEKRLDDFRKRVRETAEKMKEDLRRVEERARRGDQPEEALTRELERIKRELEKKLREAREDVKRIKDELEKLNREHHKKIKEIKDELRRTLDKLRKDGLEERILKRVEDIVRRVEEELDKLDEKHTRVVKKVSDALDRIVEELEKIVREVAKRLEDLRK

SEQ ID NO: 11501 - protein, 186 aa, Artificial Sequence; identical to SEQ ID NO: 11500
  Synthetic

SEQ ID NO: 11502 - protein, 186 aa, Artificial Sequence
  Synthetic
SEVEKKIEEMRRTLDEARRRSEESKREIKKELDEARKRVEESLKRLRETLKKVEDERRRGDTDKEELKRRIERIKRELDENHKRLKKELEEIKERLRRKNEEHHKEIERIKRELEKKLKDLERKGLEERLLRRVAKVVEDVKRELDRLDEDHTRAVEEVERALDDLLKKHEDVVREVKTELEKLLK

SEQ ID NO: 11503 - protein, 186 aa, Artificial Sequence; identical to SEQ ID NO: 11502
  Synthetic

SEQ ID NO: 11504 - protein, 176 aa, Artificial Sequence
  Synthetic
SELEELIRDIERKLEKVKRDSERSMREIEEDLKRVRKKTEESERRIRDLLDKVRKRKVDKDKLKRIKEELRKLNKDHRDDIERIKRRLDKLNKEHREEIERIKKELRELVKRVEDAGLDRTEDLRRVAKRVEEELDRSNEEHSKIVDKAKRDLDKSNKEHSKVVEDAERTLDRVED

SEQ ID NO: 11505 - protein, 176 aa, Artificial Sequence; identical to SEQ ID NO: 11504
  Synthetic

SEQ ID NO: 11506 - protein, 176 aa, Artificial Sequence
  Synthetic
SELEELEERIERLLEKVRRESEKLLRELEKKLKDVERKIEDSIRKIRDDLRKVRERKVDREKLEEIKRKLEKLNDEVRDDLRRIKREIAELVKTHEKRIREIKEELDRTLERVERTGLDRTEDLRRVLDRVKKDLDRSNEEVRREADRIMKELDKLLKKHSDVVKEVLEALDDTDR

SEQ ID NO: 11507 - protein, 176 aa, Artificial Sequence; identical to SEQ ID NO: 11506
  Synthetic

SEQ ID NO: 11508 - protein, 182 aa, Artificial Sequence
  Synthetic
SEIEEIKRRLEETNKRVREKNKRSVDRIKEHLERSRRRVEEIIRRIEKLLEELEEKARRTDISDDVIRELKKRLEDILKELEEHHKRNKEDSDRNRKELEETLRRLKKKHEDIKRELEKMDVDEKLLRDLEKALRDSIRTLKRSVEENDRINKEANEDSERLLRELKKVLEKAKKDVDELRR

SEQ ID NO: 11509 - protein, 182 aa, Artificial Sequence; identical to SEQ ID NO: 11508
  Synthetic

SEQ ID NO: 11510 - protein, 184 aa, Artificial Sequence
  Synthetic
SLEEELRELARRLKEEVRKLEETLEKVLEDSARNIKRLIDDLKRVNDELRKRVDDLIREVGDKETVDRMKKEIDDSSKEVEKLVRELEKEVDDLRKEHEKLVRDIRRKIKELEDEIRDLERKRIEKEALDRVRKKLEDALKKLRDEVREMKKKNDKTNKEVKDKADELRKKHEDTLEELKKRVK

SEQ ID NO: 11511 - protein, 184 aa, Artificial Sequence; identical to SEQ ID NO: 11510
  Synthetic

SEQ ID NO: 11512 - protein, 178 aa, Artificial Sequence
  Synthetic
SEVDEIIKRIEDLLKEVRDESKRNEDRIREKLKRLKKKSEDNAEKIKDELKKIRDRKVDDEEIKKIKEELRENLKRVEEDVRRIKEDLDRNLDEVRRRLEDIKRKLEEMLKDAERRGEPKEVLDTLRDAIRRVKEELDRNLEKNTELIKRVKETLDDLLRRNKELIRKAEETLDEERR

SEQ ID NO: 11513 - protein, 178 aa, Artificial Sequence; identical to SEQ ID NO: 11512
  Synthetic

SEQ ID NO: 11514 - protein, 182 aa, Artificial Sequence
  Synthetic
DELEKIRKELEDLSRENKEKLERIARELKRLSEENTETLEKLKEEIRRLLEKLKRIVEKDGTRDELIKEIEDELRRLLDEVRKNVEDNKRKLDEIRKEAEKDLRDNERKLEEIERRARKRGLPKEMLDRIKELLDTHRRILEDIKREIDKLLEDHRRRLEELLRDLKRALDRVREEVDRLRR

SEQ ID NO: 11515 - protein, 182 aa, Artificial Sequence; identical to SEQ ID NO: 11514
  Synthetic

SEQ ID NO: 11516 - protein, 176 aa, Artificial Sequence
  Synthetic
DDVRRIEEEIRRTLRELRETLKRVERRNREENEDLKDKMRRMKKENEDTNERVKKEGGGGEELKRRVEELARRHEKLVREIRKRLRDLAEEHKKLVEEIKRKLDEIRRRIEEAKRRGTEDKERLDKLLEDLAKEARKVIEDLKEILRRTKESIDEVEKTLREILKKSKETADRVET

SEQ ID NO: 11517 - protein, 176 aa, Artificial Sequence; identical to SEQ ID NO: 11516
  Synthetic

SEQ ID NO: 11518 - protein, 176 aa, Artificial Sequence
  Synthetic
SDLERLKKRNDDANRKLKETLDRVEKENRDVNRKLEKELKEVEEKNRRENKKVRDRGGGGKELEDRVRELKEEHERLVEEIKKELEELEKRHRKLVRDIEEIVRTLAKEHEDMKRKGTDDKEELDKILTRSEEVARRIIEELKKILEETRKSAERVIRRLEEILKESEREVREVET

SEQ ID NO: 11519 - protein, 176 aa, Artificial Sequence; identical to SEQ ID NO: 11518
  Synthetic

SEQ ID NO: 11520 - protein, 178 aa, Artificial Sequence
  Synthetic
SEVEETIKRVRDTLKKHNEESEKAIRELEEELKRLDDKNREAVEDVKRTLDELRRTKSSEDTLRKVLDKLRRDVERLVREHEAVLKKLEDRIRELKEKTKKVLEEVARIVTEVERKVKDKDLRKRLEELLREVEEDLKRNIEKLDKALKEAKEVIERSIEHLRRVLEEVERVLRELAR

SEQ ID NO: 11521 - protein, 178 aa, Artificial Sequence; identical to SEQ ID NO: 11520
  Synthetic

SEQ ID NO: 11522 - protein, 182 aa, Artificial Sequence
  Synthetic
RKEDEMRKLLDEIEKDLKRNDERVRRVLKRSKENLRRLEERAEKLLETVEREIKRLEEEGKIREDEARELRKRLEDRRREVKRELEEWERKLKEILDEVRESLKRVRERLEEIRERMEKEDRDEREVKRTIDELKDELRKHNDKTEKLIRRARETDKELNDRVAKREEEARRELEEVDRRVR

SEQ ID NO: 11523 - protein, 182 aa, Artificial Sequence; identical to SEQ ID NO: 11522
  Synthetic

SEQ ID NO: 11524 - protein, 182 aa, Artificial Sequence
  Synthetic
SLEEAVEKLLRDSEENLKKNEEDVRRLLKKSKENADRLRDEVRKLLETAEREIKRLEDEGKISEEEAKKLREELKRILDDVDKKLREWERALEEIERKVKRSLEEWRRELREIKDRVKKEDLDERLIRETEKDVKRRDEEHNTRTEREIREAKKEDEKLNKEVRDTEKRLRDELRRVEERVR

SEQ ID NO: 11525 - protein, 182 aa, Artificial Sequence; identical to SEQ ID NO: 11524
  Synthetic

SEQ ID NO: 11526 - protein, 182 aa, Artificial Sequence
  Synthetic
SKEDKVRELLRRSKENLDRVREEVRKLLKKSRDTLEELRERAKRLLEEVEEVIKRLEEEGVISEDTARRLRKALEDIKRDVERSLKEWEDRLREILEDVRKELEDWARALDEIRKRVEEEDRDEKEIEETIRRVEDMDRRLNERLRKKIEDAERMDEALRERVERLIRRVRKELEDVERRVR

SEQ ID NO: 11527 - protein, 182 aa, Artificial Sequence; identical to SEQ ID NO: 11526
  Synthetic

SEQ ID NO: 11528 - protein, 174 aa, Artificial Sequence
  Synthetic
SELEEVARRIEKMIRDLEKDLRELERKVRESDERLKRDLERNEKEHRDTIEAMRRREPDSRVDEEVKRLEDKNRKKNKEVKDESRDLKRELETTLRRIEKEIKKIEDDVRRREGDKDVRDALKKLLDELKKAVEDVRREIERLIREHKRVTEEVERADKELNDRTRKAADELRR

SEQ ID NO: 11529 - protein, 174 aa, Artificial Sequence; identical to SEQ ID NO: 11528
  Synthetic

SEQ ID NO: 11530 - protein, 175 aa, Artificial Sequence
  Synthetic
EEVERLEEEVRRRKKEWEDRLEEVKRRNEKAKRESERENEKIAREVREVVKELRERGGGGEELRKRLEDLARKLEKYKEELRRRSRKMAEEVERVKKELRERNEELARRVEELERAGADKRRLEELLRDHSRMIRRVEAELDKSLEDHKRALDENEKRIDEWLERLRKIVEEVEK

SEQ ID NO: 11531 - protein, 175 aa, Artificial Sequence; identical to SEQ ID NO: 11530
  Synthetic

SEQ ID NO: 11532 - protein, 175 aa, Artificial Sequence
  Synthetic
SKIEEIERRVRELEETWRRKLEEVEKDSRRSVKKMEEDLERAARETEEIKRRLREEDIREEELKETVDRHHKKIEEIKRELEKENKDHHKKIRDVERELDKANKELADDMERVKKDNGDERKLEELLRKHNEVIKRVKEELKRLDKEHTDIVEEVKKELDKLDEDLKRVADEKRK

SEQ ID NO: 11533 - protein, 175 aa, Artificial Sequence; identical to SEQ ID NO: 11532
  Synthetic

SEQ ID NO: 11534 - protein, 175 aa, Artificial Sequence
  Synthetic
DEDEDLERLLRKLKRVLDEIRKRIRENIEENREVVERAAREVKKSIDENRKVVDDVQLPDEELRKLREDSERKVREIERRIEEIKKDSDRLARELEKTLEDLARKVEKTERELRREGGKGEEVRKKIEDLERELRRTLEEIHKENEKSKRKIEKALRDIREENKKHIREIEETKR

SEQ ID NO: 11535 - protein, 175 aa, Artificial Sequence; identical to SEQ ID NO: 11534
  Synthetic

SEQ ID NO: 11536 - protein, 182 aa, Artificial Sequence
  Synthetic
SDIETLTRDVERSIKELEDHLKKHHEEVKERIRRLEEHADELRRRAEKLKEELKRMKDRGDSDEEVLKDILRRVKEEVDRVKKTNEDLEREVRDSEEKVKEKNRRHKEEIKKRVKEMKDRDTKTKVEEDVKRLVKKLDEVNERHRREIERNRKELEDVSRRHKEKVDRILEDIKEALDRVRK

SEQ ID NO: 11537 - protein, 182 aa, Artificial Sequence; identical to SEQ ID NO: 11536
  Synthetic

SEQ ID NO: 11538 - protein, 178 aa, Artificial Sequence
  Synthetic
SESETVKKENEDHIRKLEDDLRKLEEDNKRHVDDIERRLRDLKRENERFAEEVKKRGGGGEELKERLKELERRHEEELKDLRRSHEEYAKRVEEVLRRARRSSEEVERKLDRIRKEIDDEEVKKTLETLVRTNRRAIREVERRLKESLDHNREVLKRAEEDLRRSIRHLREVVREADR

SEQ ID NO: 11539 - protein, 178 aa, Artificial Sequence; identical to SEQ ID NO: 11538
  Synthetic

SEQ ID NO: 11540 - protein, 185 aa, Artificial Sequence
  Synthetic
SIEDELRELKERLERVVEELRRLHEKTIEDLKRVVEKSEKTLRDIRRELERVVEEVRRRRKDLEELLRRLDKKLTELEKELKKLLEDHRRVLRRLTEENRKALEKWEELLRRLTKELKEVKDRRVDKEVLDRLRKKVEDTIRKMKDEAKKLDDEHKKAVRRLEERNEETARRVRKAVEDIERETK

SEQ ID NO: 11541 - protein, 185 aa, Artificial Sequence; identical to SEQ ID NO: 11540
  Synthetic

SEQ ID NO: 11542 - protein, 185 aa, Artificial Sequence
  Synthetic
SIEDILRKLTKDLEDVIRRSRKTSEDLKEELKRVLDKHKEKLDRILEDVERVVREVEERRKDLEELKKRIRDELRKIKKRLEESLKRTEETLRELERRNRELNERHERTAREVRKRLEEVREKRVDKEILDRLEEEVRRLIEELDKENDEARKEHREVAKRNEEEIKKLEEEAKDSIRRLREESR

SEQ ID NO: 11543 - protein, 185 aa, Artificial Sequence; identical to SEQ ID NO: 11542
  Synthetic

SEQ ID NO: 11544 - protein, 178 aa, Artificial Sequence
  Synthetic
RESEELDKRLKEIAKDIRDKLDEIRRENEKTAKEIEDTIREIERDNERIDREMERRGGGGEEVERRMREAKRRHDKILKDIEDRIRTLERKHDEILKEIRREIKRVEEELREREKERDDKRFKDVIRRLEEELKKLLKRAEEEIRDSKRHLRELLKKVEKVIRESKANLDRTLKKLRD

SEQ ID NO: 11545 - protein, 178 aa, Artificial Sequence; identical to SEQ ID NO: 11544
  Synthetic

SEQ ID NO: 11546 - protein, 185 aa, Artificial Sequence
  Synthetic
SEEEDLRRKVEELEERVERYKEELKKEIERIETENKRHVEELERRLRKIAREVDDAKRRQLSREEVEEMLRRLEDALRRIEKNVRDVNRRSKKELEELERTSKEVLDRIEESLRRLAEEVKRSPRTEDLDRLLDEMRREAERLLDELRKVTERIAREVKRSNEENKKVLDEIRKAIKDLLDKLRK

SEQ ID NO: 11547 - protein, 185 aa, Artificial Sequence; identical to SEQ ID NO: 11546
  Synthetic

SEQ ID NO: 11548 - protein, 179 aa, Artificial Sequence
  Synthetic
STEEKVEEDLRRLEEKNRRHVREIEERLERMKEENRDHVRKLEEKLRRLDEEVRKVKEGGETKDEELRRLEEELRRTLEELRRSVDKSRKDHRREEETITRSHEKLEEEHRRVLDDLRKKIRNRETLKRAERKLRESLRHNREVLERARRELKKSLDHNDKALEDAERRIREIREELEK

SEQ ID NO: 11549 - protein, 179 aa, Artificial Sequence; identical to SEQ ID NO: 11548
  Synthetic

SEQ ID NO: 11550 - protein, 180 aa, Artificial Sequence
  Synthetic
DLKEVLDKLRELVREVTERIKRTIEEIERLLRKVEREMRETIRTDEELLKTVVDELRRKNADERLLRTVTEASKTSIKLNEDLMREVERAVREVIRINEELLRRVREVAKRVLEIIKNSTDRRKIKKVLDDLRKIIEDIERESRESLERLREIIERLKRRSDKTLKDSKKVIDDIRRRTK

SEQ ID NO: 11551 - protein, 180 aa, Artificial Sequence; identical to SEQ ID NO: 11550
  Synthetic

SEQ ID NO: 11552 - protein, 180 aa, Artificial Sequence
  Synthetic
DLEEVLEDLRRLMEEVKRRIERTIEEDKRLLDEVERRIRETIRRDRELLKEAERDLREKRVDERLMDTVRRVSEESVRRNEKLLREVKRVSEESIKINEDLLKEVTRVAKEVLKIIRRSDKRDKIRKVRKELREIIDRIRRESERSLEESRRVIEKIDEKSKRTLEESRRVIEEIKEKAR

SEQ ID NO: 11553 - protein, 180 aa, Artificial Sequence; identical to SEQ ID NO: 11552
  Synthetic

SEQ ID NO: 11554 - protein, 169 aa, Artificial Sequence
  Synthetic
SSEEMLRTVEELIKEARKRLDESLEEVRKRIEDAKRRHEESNDENRRLVEDAKRRVNTEEAKKRIDEVLKKSEEVNRKAKKDLDEVLKEHERVIRRIKKELDEVLEKVRRLGEDKDVLEELREIIDRLRRESEDSLRRLEKIIKDSEDRSRESSEELKEIIKRLLEEDK

SEQ ID NO: 11555 - protein, 169 aa, Artificial Sequence; identical to SEQ ID NO: 11554
  Synthetic

SEQ ID NO: 11556 - protein, 169 aa, Artificial Sequence
  Synthetic
SKDEVLEEVERRIRTAERDLERMVRRNEELIRDAKREHERSNRENERLVTEAKREIDIEEVKRELDEVLKKSKRVNDKAKEELDRVLEKSKRVADEIRRLLREVLDKVRKLGNDKDVLDELRDIIRRLREELKKSSDDLERIIRRSVKESRDSSEELRKIIEDLKREAT

SEQ ID NO: 11557 - protein, 169 aa, Artificial Sequence; identical to SEQ ID NO: 11556
  Synthetic

SEQ ID NO: 11558 - protein, 169 aa, Artificial Sequence
  Synthetic
SEKEVLDEVKELIERAKERLRRMLERNERLVRDAERKLKRLLDEDRESIERVKKRLDIEEVKRLLDKVHEKSKRVAERLLDELRKVLKKSEKVIRDITRTLDEVLKKVEELGRDERVLEELKKEIRRLEEEVKKSSEELERIIEKLLEELKRSLEESEDIIRRLEEETR

SEQ ID NO: 11559 - protein, 169 aa, Artificial Sequence; identical to SEQ ID NO: 11558
  Synthetic

SEQ ID NO: 11560 - protein, 169 aa, Artificial Sequence
  Synthetic
RKDELLRRVEEEIKKVKKRLKEMLDTDRKLIEDAERKLEEAERRDSDLIRRAKERVRDERVKEDLDRVNDKSREVVDRIKKKLREVHEKSREVVERIEEELDKVLKEVRDLGEDDRVLEELERIIEELKREIEKSLRETEKIIKELEDELRKSLEETERIIRKLEEESK

SEQ ID NO: 11561 - protein, 169 aa, Artificial Sequence; identical to SEQ ID NO: 11560
  Synthetic

SEQ ID NO: 11562 - protein, 169 aa, Artificial Sequence
  Synthetic
RSEEVLREVEKAIRRAKEELKRAVETDRRRNTEAARALEEILDTDRRLIEEAKRRLRIDDVKRLLDEAHDKSRKVVEDAKRLSNEASKRSEDVAREIEKLLDDVLREVEKLGDDEKVLRDLKKIIDDLRRRIEESLRDSERIIEKLRRDLEASLEESRRIIERLKEKAD

SEQ ID NO: 11563 - protein, 169 aa, Artificial Sequence; identical to SEQ ID NO: 11562
  Synthetic

SEQ ID NO: 11564 - protein, 169 aa, Artificial Sequence
  Synthetic
REKELLDKVKELVERAKRELERLVREDDKLNEDLKRRLTKILKEDSDRIKEVKERLKDEEVKKKLEEVNKKSEDVIRRIVEESDEASRKSKEVAKKLLDDLDRVLDEVRKLGGDDKVLEDLRKIIEDLLREIEESLRESREIIKKLEKRAKDSLKETEEIIEELERRDT

SEQ ID NO: 11565 - protein, 169 aa, Artificial Sequence; identical to SEQ ID NO: 11564
  Synthetic

SEQ ID NO: 11566 - protein, 182 aa, Artificial Sequence
  Synthetic
SEVEELLDRVKKVADESRREAKRLLDESKRVIDKSLDEVRRLLKESREVIEEVKKRVDEKRDLREMVKRLLEELKKISRESIERNKRLLEDLRRISRESLEANKELLRTLKEIVDKVIRDIRRRNADEVLKRLEDLLRKVAEEHRRITREDEELLKRAEEEHERFSKEDEDLLRKAEKEVED

SEQ ID NO: 11567 - protein, 182 aa, Artificial Sequence; identical to SEQ ID NO: 11566
  Synthetic

SEQ ID NO: 11568 - protein, 182 aa, Artificial Sequence
  Synthetic
SRVDELVKRVRDVAREVKRINDELLKRVEEVIKESRDRVRELLKKVEDVIRRAAEEIDRIRRDREVVKDLLRRLKEDVDEVIKDNERLLEEVKRIVEDVVRKAEKTLEDLRKIVEDVIRDLDRDRAKEVVREIEKLLEDVRRTSEDTVRKIRELVAEVDDDHRRASETIRRLLKEAEDRARK

SEQ ID NO: 11569 - protein, 182 aa, Artificial Sequence; identical to SEQ ID NO: 11568
  Synthetic

SEQ ID NO: 11570 - protein, 182 aa, Artificial Sequence
  Synthetic
SEVEELLKDVERVIKRSEDEVRRLEREVEKSSEDVERINRKLLRDSREVIKKVIEDVRRVKDDKDVVRKLLEDLRRISEKSVEDMKRTLDRDREIVDKVLKENERLLEELEEIVREVERRLDERRAKEVLDRIRELLETARRRHKEATKKIKRILEESEKKSRRSIEEDKRLLDEAKEEVRR

SEQ ID NO: 11571 - protein, 182 aa, Artificial Sequence; identical to SEQ ID NO: 11570
  Synthetic

SEQ ID NO: 11572 - protein, 181 aa, Artificial Sequence
  Synthetic
SVEEVVRDNERRLEEDAERTRRVARRIEKLLDELRKKVEDVIREAKERLERLLEEIGEESDVIREVEERVKKLLKRVTDLLDKVRREVEKLLRELEESLRKSEEDVRRSIEDVKRKMSDERAEDLLREVNKRNEEVIRRNKELLDEVEKRIREVIKRLEELLEKVKRELERVADELRKAKK

SEQ ID NO: 11573 - protein, 181 aa, Artificial Sequence; identical to SEQ ID NO: 11572
  Synthetic

SEQ ID NO: 11574 - protein, 181 aa, Artificial Sequence
  Synthetic
DVERVLKENKETLDEDRKRTKEVIDRNKKKLEDLAREVRKVIEEIKKRLKELLDKTGEESEEIRDVERRVRKLLREVEEALRRVEELARRTSEEAKESLRRSEETVKRSIDEVRRKMSREEAEELLRRVNKDNEKVVRENEKLLKEVLDDSERVIKELRDLLEEVRRRIEKVIRDLEERRR

SEQ ID NO: 11575 - protein, 181 aa, Artificial Sequence; identical to SEQ ID NO: 11574
  Synthetic

SEQ ID NO: 11576 - protein, 177 aa, Artificial Sequence
  Synthetic
STDEFIERLKKILRENEEKVKEVLKRNEDLLKEDEDRTRKAIKELEDKLRRVKERVERQRADERVLRELKRVVERILEELKKSLEKSKRISEEDIRAIDEWLKRSETMVRRLLKLLRDGVDVKEIEKELRRVSEESERELRKHDENTKRVSEENKERIDRLRKTLDEVIERAEERAK

SEQ ID NO: 11577 - protein, 177 aa, Artificial Sequence; identical to SEQ ID NO: 11576
  Synthetic

SEQ ID NO: 11578 - protein, 177 aa, Artificial Sequence
  Synthetic
SLDEVIRRLEETLRKDEEDTRDVIRKVRRILEENRKEVKRVIDELRRRLEEVKKRVEDSKMDERVLRELEKVVRDILRRIDEVAKESERVVRRVEEEARRSLKESKEMVERLLKLLRDGVDADTIREELRKVLEDNKRILRRLLEELKRVSEESRDRLRRLKEELERVIEEVERRAK

SEQ ID NO: 11579 - protein, 177 aa, Artificial Sequence; identical to SEQ ID NO: 11578
  Synthetic

SEQ ID NO: 11580 - protein, 186 aa, Artificial Sequence
  Synthetic
SIARKVLTDLRKIVEDLERDVERSDRDSERVVREVLERNEEVLKRLRDIVEEIKKVIREVRKDREVLKELVDRAKEVVERVKKITEELLEEVADVVRKSKKRLEDLLEELRKAVEEVKKILDRDVEDRDDVERIKRDLERILKEVARKATESVKRNERILEEVKRHAEKSTEDVERLLRELEDTVR

SEQ ID NO: 11581 - protein, 186 aa, Artificial Sequence; identical to SEQ ID NO: 11580
  Synthetic

SEQ ID NO: 11582 - protein, 186 aa, Artificial Sequence
  Synthetic
DEIEDALREARRVTEEVRREIEKSDKESEDVVREVLRRNEEVLRRLREIVKEILDELRKRREEREVLKKLVDDLARVVKEAKRITDELVEEVERVVRESKRRLEELVKEDRRVVTEVKEILKRDVEDEKRVREVLRDLERLHEESKRTVERSVERNKTILKEVRKHAETSKRELERILEDVKRATK

SEQ ID NO: 11583 - protein, 186 aa, Artificial Sequence; identical to SEQ ID NO: 11582
  Synthetic

SEQ ID NO: 11584 - protein, 186 aa, Artificial Sequence
  Synthetic
SEIDKVKKDLEKITRDVERAIKKSDDDSRKNSKEVLETNERVLEELRRIVKEVLDEIRRVRKDKEVLKRLVEEVERVAREVEEITRRLVRHNEESVRTSERILRELVKRDRDVVKEVSEIIERDVEDRDRARDVDKKIKDLHKKSEDEVRKSVKRNRDLLEESKRHAEESREDIRRLLDEVREEAK

SEQ ID NO: 11585 - protein, 186 aa, Artificial Sequence; identical to SEQ ID NO: 11584
  Synthetic

SEQ ID NO: 11586 - protein, 186 aa, Artificial Sequence
  Synthetic
SSAETVLTELRKIVRDILEKSKKSNDDLRKIVEEILKDNEDVLRELREILRRIKEKIDERREDKEELDRLVKEAEDVVREVRKRTRELVEELRRVIREVEEINRDLVRKIDKVVKEVEEILKREVEDKEKVDRIRDDIRRLLKKLRDDVERSVRDVRRILKEVKEHAERSEEEVKRLLKELRDRAK

SEQ ID NO: 11587 - protein, 186 aa, Artificial Sequence; identical to SEQ ID NO: 11586
  Synthetic

SEQ ID NO: 11588 - protein, 186 aa, Artificial Sequence
  Synthetic
DEMDKVLKDAEDVTRRVKEELRKVDEESRRVVKRILDENRRVLKELEDRVRDLRRLIREIREDKDALAELVKEVEKVVRRVDEITKKLLDDVAEVVKRSKERLEKLVEDDRRVVETVKRILDRDVSSEEDVRKIKEDLERLHRESKRDVERSARDNERILEEVKRHADESRREVKRLLDEAKEEVD

SEQ ID NO: 11589 - protein, 186 aa, Artificial Sequence; identical to SEQ ID NO: 11588
  Synthetic

SEQ ID NO: 11590 - protein, 182 aa, Artificial Sequence
  Synthetic
DDLERVLRELERLVDEIRKEIEKVDRESEELDRRVKETIKELDERSKRLVEEVEDMIRRNRDSKELLERLIRLIRKSVEDVKRTLEKLIEDSERSVKEVKDRLEKLIEDLRKVVEDLKKLADERKAPEEVVRRVEKIVRELRKTVEDSIRRNEKSVEETRREAEKSEKRNRELVKRLEEKAK

SEQ ID NO: 11591 - protein, 182 aa, Artificial Sequence; identical to SEQ ID NO: 11590
  Synthetic

SEQ ID NO: 11592 - protein, 182 aa, Artificial Sequence
  Synthetic
SEAEKVLKELEDLVRRIEEDIRRTNEEVRKLDEDVLEDIKRVDEESKKLVREIEERIRSRRDKKDELKKLLERLRRSVEEVRRRLRELIELSREVVKRNEDRLKKLIDDLRRRVKELEKVIDERKFPEEFVRRLEELVKRLADKVKESVDTSRTSVKRTEDEARKSVRRNEDLVRRLEEDAK

SEQ ID NO: 11593 - protein, 182 aa, Artificial Sequence; identical to SEQ ID NO: 11592
  Synthetic

SEQ ID NO: 11594 - protein, 182 aa, Artificial Sequence
  Synthetic
SELEKVLEELERLVKRIEEEIKRTNKEVRDLDEEIRKAIERSNRETERLAREVLERIREERDSKELAKKLIEDVRRVVEESKKELKRLIEESRRVVEKNERDLRRLIEELRRVVKELEELADRKKAPEEVVRRLEDLVRRLEESVERSVRTSRKSVKETEDRIREVERHDERLVEELERAAK

SEQ ID NO: 11595 - protein, 182 aa, Artificial Sequence; identical to SEQ ID NO: 11594
  Synthetic

SEQ ID NO: 11596 - protein, 182 aa, Artificial Sequence
  Synthetic
SDLEDVLRKVEDLDRKIAEDIRRTNEDVKRLDEEIEEKIRRSNEKLRELVRRVLKAIRDRRDDKDLIKKLIEELEEALRRNEELLRKLIEESRDVVRKNEKVLKDLEDESRTVVDELRELADRKKAPEEVVRRLEESVRRTKERIDRSLKTSRDSVRETERKIKESKDTSEKLVKDLRDAAK

SEQ ID NO: 11597 - protein, 182 aa, Artificial Sequence; identical to SEQ ID NO: 11596
  Synthetic

SEQ ID NO: 11598 - protein, 178 aa, Artificial Sequence
  Synthetic
SEVDDILRRLREIDEKLLRENEESLKRLKDEVDRLKRKNEKSLDDLRKLVEKLIDDLRKRKEVEELARRVDDEARRVLKRNKEVVERIREELERVLRRNKEVVETIRKLSEDVVDELRSGGVDEKVLEEVKRSVDRTRDHLRKSEEDVRRLLDELRRHLEDSERRVRELLRKLREKVR

SEQ ID NO: 11599 - protein, 178 aa, Artificial Sequence; identical to SEQ ID NO: 11598
  Synthetic

SEQ ID NO: 11600 - protein, 178 aa, Artificial Sequence
  Synthetic
SKVDEILRELKRLVDELLRRIEKTLKELEDLVRELLKENTRSLEELRELVERLLEELRRRKESEELVRRAIKAVRDVLEKNRDVVRRIKEELRRVLEENREVSREVIELARKVLDELRRGGVDREFVERVRELLKRLEDELRKSNRTIEKLLRDLARHLEDSIRRVEELLRELEEKAT

SEQ ID NO: 11601 - protein, 178 aa, Artificial Sequence; identical to SEQ ID NO: 11600
  Synthetic

SEQ ID NO: 11602 - protein, 178 aa, Artificial Sequence
  Synthetic
KEVEDILRELEKIAKDLRDEIRESDDESRRLVEELLKRSEDTLKELRDLVKKLLDRLRERKESEDLVREIRKRVKEVLDKNREVNDEIIKRVAEALKKTRKVLEKVKELVKRALEKLRRSGVSEEVVKRVEELIRRVEEEVRRSTRRNEKLLEDLRRELERSDRELEKLMDDLRRKLK

SEQ ID NO: 11603 - protein, 178 aa, Artificial Sequence; identical to SEQ ID NO: 11602
  Synthetic

SEQ ID NO: 11604 - protein, 178 aa, Artificial Sequence
  Synthetic
DDVEKILEDLKRIDTELTKRTRDSNKELEDEVRRLMERSRRTLKELEDEVRKLLDRLRKRKESEELAREVERRAEEVLEKNRRVNKEIIKRARDVVEKNTRVNKKIKDDSREVVKRLEDRGVDRKVLEDVRRSLERTERELRESDKSVKKLLDELKEELDRSDREVERLLEELRDAVR

SEQ ID NO: 11605 - protein, 178 aa, Artificial Sequence; identical to SEQ ID NO: 11604
  Synthetic

SEQ ID NO: 11606 - protein, 178 aa, Artificial Sequence
  Synthetic
SEVDEILRKLRELVKELIRRTEESNEKLRKLVEDLRDESRKSLEELRELVERLADELRKRSESEELARRVIRRVEEVVRKNSDVNRRIIEAVKRVVDENTEVNKEIIEEAKRVVEELRRSGVEERVVREVEELLKELKRRLEESDKSVAELLRRLEKDLRESDRRVEELLKRLEDEVK

SEQ ID NO: 11607 - protein, 178 aa, Artificial Sequence; identical to SEQ ID NO: 11606
  Synthetic

SEQ ID NO: 11608 - protein, 178 aa, Artificial Sequence
  Synthetic
SEAEKILTELEEIDRRLVKRTEDSNRKLRDTVRKLEEESKKSLEELRELVDRLLKRLDERKESKELAEEVIRRVEEVVRRNSEVNKRIEDEVKRVVEENTRVNEEIRETSREVVKRLEDSGVDREILERVRESLERTDKRLRESDESVKKLLEDLKRKLEESDRRAERLLEELRKRAT

SEQ ID NO: 11609 - protein, 178 aa, Artificial Sequence; identical to SEQ ID NO: 11608
  Synthetic

SEQ ID NO: 11610 - protein, 181 aa, Artificial Sequence
  Synthetic
SELEEVLKRVEETVRRLTKRLEESLEETRRIVDKLREDLRRSLERTERIVRELTEKLGGTDEARELLKRANEHDKRVVDEIRKRLEEALEKDRRLVDEIRERLKELLEEVKDVVDKIRSKGREEELREVEKKAEKLVRELEERLKRVIEDSERLVTDLKEKLERVLETSKKLLADLEERAR

SEQ ID NO: 11611 - protein, 181 aa, Artificial Sequence; identical to SEQ ID NO: 11610
  Synthetic

SEQ ID NO: 11612 - protein, 181 aa, Artificial Sequence
  Synthetic
KELDEVLEKVKRIVDELERKLERSLRETKRIVDELREELKKSLKETEDIVRELERDLGGTKEADKLLEELLRRDKEVVRRIKEELERMNEHDRRVVEEIKELLERALEEVKDVVRRISKEGRDERLTEVEERAKRLVDTLAEKLKEVERRSEELVKTLEEELRRVLDTSRRLVEELREKAR

SEQ ID NO: 11613 - protein, 181 aa, Artificial Sequence; identical to SEQ ID NO: 11612
  Synthetic

SEQ ID NO: 11614 - protein, 181 aa, Artificial Sequence
  Synthetic
SELEEVLKEVEEIVRRLEEELRKSLKETREIVTKLLKKLKESLEDSERIVRELSRKLGGTDEARKLLEEANDHDRRVIEEIKRELKRLLDKDREVVKKIEDELRKLLKKVREVVERLKDKGRDEEARKVLETAKKLVDDLKRKLERVKEESAKLVDELRKELRRVNERSKELVEKLEREAK

SEQ ID NO: 11615 - protein, 181 aa, Artificial Sequence; identical to SEQ ID NO: 11614
  Synthetic

SEQ ID NO: 11616 - protein, 181 aa, Artificial Sequence
  Synthetic
SELEKVLREVEEEVRRLKKKLKESLDRTKEIVDRLKKDLKRSLDETKKIVDELREKLGGRKEADELLKRANEHDKRVIDKIRELLERALREDERVVREIRKRLKELLERVREVVERLKDEGRDKDLKDVERKAEKLVEDLDRELKEVEKTSRKLVKELEAELREVDKTSKKLVDDLRKDAK

SEQ ID NO: 11617 - protein, 181 aa, Artificial Sequence; identical to SEQ ID NO: 11616
  Synthetic

SEQ ID NO: 11618 - protein, 189 aa, Artificial Sequence
  Synthetic
REVEELLKEVEESTRTSKKIIEDLLRRVKESSDKSKKDIRRLLEEVRRIVDTVRKILERRGKKDKDAEKIIEDVERRVREVLERARRLSEENEKLVREVLRRLEESTRRDEKLVREVLKRARDSVREEELEKRVREVEETLKRLVDENRETLERVARKAKRLVEDDKRDLEEVVRELEELLKRLKEELD

SEQ ID NO: 11619 - protein, 189 aa, Artificial Sequence; identical to SEQ ID NO: 11618
  Synthetic

SEQ ID NO: 11620 - protein, 189 aa, Artificial Sequence
  Synthetic
SSVDRLLERVKRTTDESKERVERLLERVKESSERSEREIKRLLEEVERIVREVKKEVERRGKDAEDVRRIIKEVEDRVKRVLEDVRRSTDEDRKLLDRVREEVRKISEDNAREVEEVLDEVRKQSREEEVEKRVREVERTVEELVKEDREAVKRVEETIRRLLKKNEDTVKKVEDDLRKLLEDLKRDVK

SEQ ID NO: 11621 - protein, 189 aa, Artificial Sequence; identical to SEQ ID NO: 11620
  Synthetic

SEQ ID NO: 11622 - protein, 188 aa, Artificial Sequence
  Synthetic
SEIEELLRRVKKVNDESRERIKELDKRSREVNERSRRKNEELLKRVEEVVREVEERIDRTRDKETVRRLIEELEEIMREAVRRSRKSSEELRKRVEESVKELKRSSDELRRIVKEVIEEAKRNSREKELEDRVRDAVRRLERSLKENEDRVRESIERNKDSVRRNEEHVDESIKRLEKEVDRVRKRAE

SEQ ID NO: 11623 - protein, 188 aa, Artificial Sequence; identical to SEQ ID NO: 11622
  Synthetic

SEQ ID NO: 11624 - protein, 188 aa, Artificial Sequence
  Synthetic
SEIEKLLEDVRKVAEEVKRAIDRLNEENKRVNEKSKERIDRLLEEVRKVVEEVLRRVKTSKDKKTLDELLKELRKDVKRVVDEARKSSEELEKISREVNETLKELLERLRRIVEEVIKEAERRTREEEVEKRVRRVVEKLREIVKEVEEKVRRALDENRRSLEENRRRVKRVIEELEKILKEVEDEVR

SEQ ID NO: 11625 - protein, 188 aa, Artificial Sequence; identical to SEQ ID NO: 11624
  Synthetic

SEQ ID NO: 11626 - protein, 181 aa, Artificial Sequence
  Synthetic
DEVEEMEKELKKLLDDSKRRSDELIEEMRKLNEESKKRSRELEKRLRDINKEIRDRLDRDKAREVLRKSERVTEESRRLAEESDKKSEDVTRRSADRLRRVNKKVADVVERIKELLDEKRDDSKLLDDLRKTIEKVIRESRELLEELRKENERVIEESEKLLRDLLRENEKVAEEVRRTAT

SEQ ID NO: 11627 - protein, 181 aa, Artificial Sequence; identical to SEQ ID NO: 11626
  Synthetic

SEQ ID NO: 11628 - protein, 181 aa, Artificial Sequence
  Synthetic
SEVEELIRRLEKLLREVEKRARRLIEEAKRLNDESNKESRRLIEELERLVEDVAREARRDKVKELLRKLREVVKRIVEALERSDRKSKEVTERSVRLVEKAVRDLERVIREIVKRADEARDDEKLLRDLERAIRDVVRKLEELLRRLREENERVIKESEELLERVRKEIEDVLREAREAAR

SEQ ID NO: 11629 - protein, 181 aa, Artificial Sequence; identical to SEQ ID NO: 11628
  Synthetic

SEQ ID NO: 11630 - protein, 181 aa, Artificial Sequence
  Synthetic
SKVEKLITELEKLLKDSNKKTEDVERELERLNKKSNDDSRRIIEEHKKIVEEIARRVTKDKARDALREARRNVEENRELVERSDKKSKDVTEKSRKAAKESDDRLEEVIREIKRRLDEFRDDEELLKRLKDRIKKVVEESEKLLRDLVKENREVIKESEEILRRLAENLKRVKEEVDRRTT

SEQ ID NO: 11631 - protein, 181 aa, Artificial Sequence; identical to SEQ ID NO: 11630
  Synthetic

SEQ ID NO: 11632 - protein, 181 aa, Artificial Sequence
  Synthetic
EEVERLIKELDDLLRRSNARTRDLIRKADEELRRSNEESRRIVERMEEINKRIADEVQRDKAKDVLEKSKEVTKKSKRLVEESDRKVEEVIREIRKRAKESDEKVKRVIEEIRERLDRKRDDKKLLDDLKRKIETVIKESEDILRKLEEDLKRVIEESKELLDRLLEENKRVMEEARRRTK

SEQ ID NO: 11633 - protein, 181 aa, Artificial Sequence; identical to SEQ ID NO: 11632
  Synthetic

SEQ ID NO: 11634 - protein, 177 aa, Artificial Sequence
  Synthetic
DEVEEIKKEAKRIVEDLKRRNEELKRRLERLVEEVKKRNEESKKRLEDIVRKIKEDIKDGRSEVVKEVEEIIDRLVKESEKSLRDLEKTVEDLVRDSRRSLEDARRIVDELLKILDRGDKDLKEVRKTLEKARKENEDVIRKIEEDAKEVLRRDEESNRDINRKVDEVRKRVEERRK

SEQ ID NO: 11635 - protein, 177 aa, Artificial Sequence; identical to SEQ ID NO: 11634
  Synthetic

SEQ ID NO: 11636 - protein, 177 aa, Artificial Sequence
  Synthetic
REVEEVKKDLERIVEEVKKRNEELKRRLEELLKENKRRNEKSDEDLKRIVDRIDERVREGRKEVVDEATRIVEKLRKDSEKSLRDAKRRIDELMRRSDESLKRLEDIIRRLLEILDRGDKDLKDVKRVVEKVRRENEKVLREILTDAEKVSRDDETSNRDLNRKLEEARERVERKAK

SEQ ID NO: 11637 - protein, 177 aa, Artificial Sequence; identical to SEQ ID NO: 11636
  Synthetic

SEQ ID NO: 11638 - protein, 177 aa, Artificial Sequence
  Synthetic
SEVEEIKERLKRLVEEVERRNRKVIRESEETVKENEKENRKSKKRLKEILDEIVERIKDGRSEVVEELERIIRELARRSEKSLRDVERISRKLVKESRDSLRELKRRIEELLEILDRGDKDLKDVKRDVERVLKENKEVLDRLRKEDEEVSRRDKKSNEDINRVVEDVKRKLEEKAK

SEQ ID NO: 11639 - protein, 177 aa, Artificial Sequence; identical to SEQ ID NO: 11638
  Synthetic

SEQ ID NO: 11640 - protein, 177 aa, Artificial Sequence
  Synthetic
SEVEKVKEDLKKLVKEVEDRNRESKRRSEETVKENTKKNEDSKRRLKEIVDRIREEVKEGRDEVVKKAERIVEDLARRSEESLRRMEKISKDLVRESKRSLDELKRIIEELMEILDRGDKDLKDVRREVKRVLDEDKDTNDKLNDRDRKASEEDERSNRELNKTIARAEEEVKEARR

SEQ ID NO: 11641 - protein, 177 aa, Artificial Sequence; identical to SEQ ID NO: 11640
  Synthetic

SEQ ID NO: 11642 - protein, 177 aa, Artificial Sequence
  Synthetic
KEVEDVKEKLKELVERNRDENRKTKEELRRLVEKNRKENEESKKRLKEIVEEIRERVKEGRSEAVERVRKTIEDIMEDLDRSLRRVEDIVTKLAKESDDSLRRVEEIIRELLKILDRGDKDLREVEKTAEKVSKEDKETNDRIRKDLKKVSDEDKRSNEEVNKRVDKVRKEIEEERK

SEQ ID NO: 11643 - protein, 177 aa, Artificial Sequence; identical to SEQ ID NO: 11642
  Synthetic

SEQ ID NO: 11644 - protein, 170 aa, Artificial Sequence
  Synthetic
EESERLDELIKEVVERVKKLNEEARELIKDVLRRNEEVNTRLEELNRKVEKEVREEKDKDRLVRRAEAVSKTTEDLVRETIEEAKEVVKEVRDLVRRSNEDLRRVVEEVRERGVDRKVLEKIRRALEKVHEDNRRSIRDVERMLEKVEDDNRKTIERSRRLVKRVEEELR

SEQ ID NO: 11645 - protein, 170 aa, Artificial Sequence; identical to SEQ ID NO: 11644
  Synthetic

SEQ ID NO: 11646 - protein, 185 aa, Artificial Sequence
  Synthetic
RSLEELKKEVERVARAVRKVSEDNKRLLDRVREEVKRVSKENRDLVREVERRVEEVKRRVEDRKELKERVTKLLKELEDSSREVIKRVEELIDRMRRSSKEVEDRVRELLRELERVVRDVKRKVKDLERVDRLKEEIEEILRDLERKVRENKERSKKIAEDLRKHAEDNAREVKKALRDLEEKVR

SEQ ID NO: 11647 - protein, 185 aa, Artificial Sequence; identical to SEQ ID NO: 11646
  Synthetic

SEQ ID NO: 11648 - protein, 182 aa, Artificial Sequence
  Synthetic
SELERVLREIREVSRETRERSERSLEEIRRVVEDVRRKNKESLDRNREVLEEIRKALEKGPEELMRELLKEIKESSRESNRTSDESVEEVRDVARKVERRNEELLERSRRVAKRVEEEARRAPEDRVERVKRELERLVEENERIVRESRKTLEKLVRDVDRTSKRVKDENRKLLRRVEEEAR

SEQ ID NO: 11649 - protein, 182 aa, Artificial Sequence; identical to SEQ ID NO: 11648
  Synthetic

SEQ ID NO: 11650 - protein, 182 aa, Artificial Sequence
  Synthetic
SEVEDLLRRIRKVVEEVERRSRDSLRRNEEVVKEVEERSEKSLRDDKKVIDDVKRRLREGPEEEVRRLLDEVRKSSEDVVEENRRLLKRVEESSREVVKINDRLLEEVRRVVREVLEELRRAPKDEVRKAEEELRKLVRKAEEVVKKSKEDLERTTRKVEKVVRKSEEDSRRLLREVAEEAR

SEQ ID NO: 11651 - protein, 182 aa, Artificial Sequence; identical to SEQ ID NO: 11650
  Synthetic

SEQ ID NO: 11652 - protein, 182 aa, Artificial Sequence
  Synthetic
SKLDKILEELRRIVEEVKRRSEESLEEIERVVEEVKRRSRRSNEELKRIVDKIKKDLRDGPKELIRELLKEIERVAREVKKINRDLLEDVKRVVDKVRRENEKLLEDVRRVVEDVKRRISEVQEDDVDRVRREADKIVEDVRRVVERSKRRLDELRRDAEKVVRDSERRIDRIVDDVRRTAK

SEQ ID NO: 11653 - protein, 182 aa, Artificial Sequence; identical to SEQ ID NO: 11652
  Synthetic

SEQ ID NO: 11654 - protein, 182 aa, Artificial Sequence
  Synthetic
SDLEEVLKKLEDILRKIKETNDKALREIEEVLRRVKERSRRSNKEAEKVLREVEKMLEKGPKELARKLLEEVERVVRKVTEDNDRLLKEVEDVVRRVEELSRESLKTIEKVVRDVARDVERVEEDEVRRIKERLERLLRTAERVSREIKKRLEELVDDVRREVKRSKDRLKRLVDEVAERVR

SEQ ID NO: 11655 - protein, 182 aa, Artificial Sequence; identical to SEQ ID NO: 11654
  Synthetic

SEQ ID NO: 11656 - protein, 182 aa, Artificial Sequence
  Synthetic
SKVDEILKDIERVVREVEKKSRKSNEELKRISEESKRRNEDALRRLKEIADRVRERLDKGDKEEVRELLKTVRDVVKKVKEESDRSVKRSEEVAEEVKRRNEALLKEVEDVARDVEEKLREAPEDKVRDARRRLKELVDRVKRVVEESEKRIRKLVKENRDVSRRIEEELKRIVREIEEEAK

SEQ ID NO: 11657 - protein, 182 aa, Artificial Sequence; identical to SEQ ID NO: 11656
  Synthetic

SEQ ID NO: 11658 - protein, 182 aa, Artificial Sequence
  Synthetic
SKLEEILKKVEKVSEDTKRKSEDSNRRIKKVSDESKELNKKALRDITEMAKEVDRVLKEGREDEVKKLLDEVREVVERVRKISEDSVRRSEEVVRRVEEINRELLKDSKRVVDEAAERIREAPEDRVDEARRRLERLVEDNARVVKRSEDELRKLVEDNRRVSEEIERKLKELLKRVAESVT

SEQ ID NO: 11659 - protein, 182 aa, Artificial Sequence; identical to SEQ ID NO: 11658
  Synthetic

SEQ ID NO: 11660 - protein, 182 aa, Artificial Sequence
  Synthetic
SKAEEALKELERVADEARRASEKSNREAKKAADDAKRASEKSLREAERAAREAEKALREGPEEDARRLLKEVEEVARRAAKINKELADRVRKVAEDAARINDKLLEEVRDAARRAKEAAREAPKDDAKRIKDEADKIVKRAEDAARESKKRLKRLVEDAERAAKESKEELDRLVREAEEKAR

SEQ ID NO: 11661 - protein, 182 aa, Artificial Sequence; identical to SEQ ID NO: 11660
  Synthetic

SEQ ID NO: 11662 - protein, 178 aa, Artificial Sequence
  Synthetic
SEVERVLKELEDLIRKLEEEIERSLRELEKLIEELKKEIKESLDELEKLIRDLIRRLDERKESEELAREVRELVRRVLEKDREVLERVIREVRKALEKNKRVLDRVRKLVEEVLEKLRRGDVSEEADKRAKELLDKLRKVIEKSKEDSRKILKDLERTVKRSEEESRKVLEKLERRVQ

SEQ ID NO: 11663 - protein, 178 aa, Artificial Sequence; identical to SEQ ID NO: 11662
  Synthetic

SEQ ID NO: 11664 - protein, 178 aa, Artificial Sequence
  Synthetic
DEVERVLRELRELIKRLEEEIRKSLKELEDLIRRLIEEIEETLKKVEKIIRELKARLEERKESEELARKVEEDVRRALKENKRVLEEVIRRVRKVLEDDRRVLEEVIRRVEKMLEDLKKAGVSDELREEAKKLLRRLEKTVEKSKRDSEKVLRDLEEVVRESERASKELLKDLKRKVD

SEQ ID NO: 11665 - protein, 178 aa, Artificial Sequence; identical to SEQ ID NO: 11664
  Synthetic

SEQ ID NO: 11666 - protein, 189 aa, Artificial Sequence
  Synthetic
SELERLLREVEKSSRESVETSRKLNEEVEKTTRESKRRIEELLRRVEKIVDEVKKVIDRDGKDSEEVRRIVEEVKKFIETILEEIKRSSEEDERRIRDVLRKSEKSSEDDRRLLDEVLKEVARRTRTDEARERLRRVAEEIKRLAKENKRVAEESKRRAKELLDDNKDTVRRVSERLKELLEDLDRKLK

SEQ ID NO: 11667 - protein, 189 aa, Artificial Sequence; identical to SEQ ID NO: 11666
  Synthetic

SEQ ID NO: 11668 - protein, 189 aa, Artificial Sequence
  Synthetic
DEIEDLLRRVRKTTEESKKRSEDLNKEVKDSTREVKKRIKELLEEVERRVKEVKERMERDGLKSEEVKRIVDEVERELERVVDTVRKIVEDDKRLIEDVVRRSKDLSRRDVELIKTILKEIEDRSRTEEAEKRVRRAKEEAERLIRDNERKLKESEEELRRLIKETEDVLRKAEEDIRRILADLRRRLK

SEQ ID NO: 11669 - protein, 189 aa, Artificial Sequence; identical to SEQ ID NO: 11668
  Synthetic

SEQ ID NO: 11670 - protein, 189 aa, Artificial Sequence
  Synthetic
SEVEKLLEDVRESTKRVKELSKRLNEEVERTTKESEDRTRRLLEEVKRIVEDVKDKLRKRGKDSEDARRIVEEVKKRIREIVETSTRLSEDDKRLIEEVLKESERIVREDEELLRRVLEEVERRSRTEEAKKRVKEISDEIRKLAEETREVLERSEKRLRELIRRNEKVNKEVAERLEEILRDLDRKLR

SEQ ID NO: 11671 - protein, 189 aa, Artificial Sequence; identical to SEQ ID NO: 11670
  Synthetic

SEQ ID NO: 11672 - protein, 174 aa, Artificial Sequence
  Synthetic
REKEDAKRRLEEILREVKKDLDRVHRENEKLVEDTARTVERIKRELKKLLDRAREVPVEEELIKEIEKIVEDIVRRVEELLRRDKKVSDDVSREVRRLVEDLRRIVETVVELVKAGMDIEELRKRVEDVVRRVKEELERLLKENEDSTREVKKEAERLLDEIRKVLEKVERDAK

SEQ ID NO: 11673 - protein, 174 aa, Artificial Sequence; identical to SEQ ID NO: 11672
  Synthetic

SEQ ID NO: 11674 - protein, 174 aa, Artificial Sequence
  Synthetic
REKEEAEDRMRRILEEVRRTLEEVHKENRRLLEDTRRTVERIERENRKIVEEVRRVPVDEKLVKKAEDISRRVTEEVRRLLDEDRRVSEEVSRRAEELVRRLEEIVRRLLELVREGMDIETLERRVREVVERVKKELERLLRENKKSTEEVKRTAEDLLRKNREVVEEVKKAAK

SEQ ID NO: 11675 - protein, 174 aa, Artificial Sequence; identical to SEQ ID NO: 11674
  Synthetic

SEQ ID NO: 11676 - protein, 184 aa, Artificial Sequence
  Synthetic
DEVEELERRLEELLKKSRDEVTKLADELDRVLERSREVVKKDRESLKEILKEVERLVREKNDERLKEAVDELRKVVEEIERRNEKAVRENEEVVRDVKRRVKEVVEENERVVRKIKDVLRDKDKSKELLDRLEKELRESVKRSEERLKELADRIRKSLEDSERLSRRTNERIKRVLEEVTERVK

SEQ ID NO: 11677 - protein, 184 aa, Artificial Sequence; identical to SEQ ID NO: 11676
  Synthetic

SEQ ID NO: 11678 - protein, 184 aa, Artificial Sequence
  Synthetic
DEVEDVSRKLDEALERSRRITEDLEKKLREVIETSKREVDKLAERLDEVIREIEERIRKKNRKELEELLREAREVVKEVKKRLEDLLRRNEKVVREIRETVERLNEELREVAKRVRDVARKEDKNKELIEKLEEDIRRVLEKIKREHERLLRKIEESLKDSKRRLDKLRRDIERILERIREALR

SEQ ID NO: 11679 - protein, 184 aa, Artificial Sequence; identical to SEQ ID NO: 11678
  Synthetic

SEQ ID NO: 11680 - protein, 178 aa, Artificial Sequence
  Synthetic
REIEEALRELEEVLRKVKEDNKRLEEEIRRVLEEVKRINEKLLRDAKKELDRVKEILKDTRDEKAVREVLKEVEDVVRRVKRMSEESVKEVERVVRELVERSRRSLEEVRRVVRRLLERVKDVEEAKKELRRLVKEVEDVVRTSTRRLEELVKEVRRVSEETKRALDELVKEVREEVR

SEQ ID NO: 11681 - protein, 178 aa, Artificial Sequence; identical to SEQ ID NO: 11680
  Synthetic

SEQ ID NO: 11682 - protein, 178 aa, Artificial Sequence
  Synthetic
DEIEDVERKIKEVVDRVRDINRRLRDTIRRVLEKVTRINEELRDTVRKVLKEVERILREIKEESKVEEVLKRVREVIEKLARDSRDSLREVERVARELKERSKKSVEDVKKVADDLVREIRESEEIKEKLERLVREVKRISEESAKDLERLVREVEKVVEDSERELRRLVEEVERRRK

SEQ ID NO: 11683 - protein, 178 aa, Artificial Sequence; identical to SEQ ID NO: 11682
  Synthetic

SEQ ID NO: 11684 - protein, 178 aa, Artificial Sequence
  Synthetic
SEIEKVRKEIDEVLKRVRKINEDLLRELEEVSKRSKDINDDDLRTNTEVLKEARRILKDSTDERLVEEALKRVEEVTERNVRSSRKSLEESERVVRRLLEASRKSLEEVRKVAKEIKEKIKDSKDVTKELDELVREVEEEVRRSKDTLRRIVEENREVVERSERKLKKSSDDVREERR

SEQ ID NO: 11685 - protein, 178 aa, Artificial Sequence; identical to SEQ ID NO: 11684
  Synthetic

SEQ ID NO: 11686 - protein, 189 aa, Artificial Sequence
  Synthetic
SELEKVLRELEENSRRNEEELRRSNDKVRRVLDEIRRKLEEVLRKVEEVLRRIEEELSDKKDDRVAKEVIKRVEDVLRDLDRILKEVIKKVETVLREDERIVEELLDNIRKVLDRLRDILEEVKRRREDVKDKVKKAEDDVRRLLERNRRLVEESKKSSEEFLRRVEKLVDDARKKVEDALRKVRETAR

SEQ ID NO: 11687 - protein, 189 aa, Artificial Sequence; identical to SEQ ID NO: 11686
  Synthetic

SEQ ID NO: 11688 - protein, 189 aa, Artificial Sequence
  Synthetic
SELEKVLRDLEKNSRENEELLRRSNKKLKDVVDKIKKKLERALEELREVLEKIRRELSRSTDRKVAKEVIERVERVLRKLEEILRRVIREIEEVLREDREILERVIRNIEKVLEELKEIVREVRRRREDMDDKVRKAEEDVKRILDENRDLVRRSEENSKRLLERVRELVERVKDAADKLLREVREEAR

SEQ ID NO: 11689 - protein, 189 aa, Artificial Sequence; identical to SEQ ID NO: 11688
  Synthetic

SEQ ID NO: 11690 - protein, 189 aa, Artificial Sequence
  Synthetic
SELETVLRELEENSRRNEELLRRSLDRVRRVLEDVTKKLREVLEEVRTVLEDVKRKLSRVTDKKEADKLIERIERVLKKLEDILRELIRKAERALEEDKRILDDVIRNIEEVLKKLDKILEEVKRRSDDVRDKVKEAKDRVRKILEDNRRLVEKSEEDSKRILETLRKLVEEMKRELERIETELREAAR

SEQ ID NO: 11691 - protein, 189 aa, Artificial Sequence; identical to SEQ ID NO: 11690
  Synthetic

SEQ ID NO: 11692 - protein, 189 aa, Artificial Sequence
  Synthetic
SELETVLRKLEENSRRNKKLLRDVLEEDKTVLRDVERKLREVLDELRKVLEDIRDKLSRKTDDRVAKEVERRVREVLKKLKKILEDLIRKMEDSLRKLKEILKRLIENAERVLRELEKILKDVKDRREDVKDKAETMKKAVEEILDRNRKLVTEAEKRSEDSLRKLRKSVKEVEEKVKRVLEEVKKEAD

SEQ ID NO: 11693 - protein, 189 aa, Artificial Sequence; identical to SEQ ID NO: 11692
  Synthetic

SEQ ID NO: 11694 - protein, 189 aa, Artificial Sequence
  Synthetic
DELERLLEELERNSRENKKRLDESRKRVKEVLDRIEKKLRDVLREVEDVLRKIREKLERKRDDRVAKEVKRLIEDVARKLEKILKEVTDAVKKVLDENKKILEDLIRNIEEVLKKIERILEEVKRRAEDVKDKVKELRDRVKELLDRNREEVRKSEEDSKRVLDEVKRLVDELRERLREIRKRVEEEAK

SEQ ID NO: 11695 - protein, 189 aa, Artificial Sequence; identical to SEQ ID NO: 11694
  Synthetic

SEQ ID NO: 11696 - protein, 189 aa, Artificial Sequence
  Synthetic
SELEDVRRELEENSRRNEETLRRSLAELEENSERNRRELERVLAEVEKVLKKATETLSRVDDKEVARRLEDEARKVLEDLERILRRLIENIRRVLEKNKKIAEDLIRNLERVLEKLKEILRDVDRRRKDVRKEVKKVEDDVRRILEENRRLVEESERRSRRILEENEELVEDIKRKLREIEKELRERVR

SEQ ID NO: 11697 - protein, 189 aa, Artificial Sequence; identical to SEQ ID NO: 11696
  Synthetic

SEQ ID NO: 11698 - protein, 183 aa, Artificial Sequence
  Synthetic
SEVEELEREIRELVERNRELVRRLEEEARRLSRRNEELVRELKERAERLVKELKERLDRVDREELKKIADRVRREAERLVEDVRRSSRKVSEENKELVKEVRKSSTEVIKRLEDLVEKVRRDNDKDTLDEVRKEVRKLSKENEERLREVLEESRRLSKRNEEILKEIAERVKRLVDKLTDDIR

SEQ ID NO: 11699 - protein, 183 aa, Artificial Sequence; identical to SEQ ID NO: 11698
  Synthetic

SEQ ID NO: 11700 - protein, 175 aa, Artificial Sequence
  Synthetic
SEVEDVERRVRKLLEENDRLLEENEKSARELMKRDKKVSDENEKSVRDLLDRLRKEIRDEDVVRKVEEILKDLLRKDREVSKENIKILKELLDRSRDSSRRVRETLKRLLDKARKDKDVLEELLKKLRKLSEDNERLLRESNERAKRSTDESERLSRETNERVKDVVTRLKEASK

SEQ ID NO: 11701 - protein, 175 aa, Artificial Sequence; identical to SEQ ID NO: 11700
  Synthetic

SEQ ID NO: 11702 - protein, 175 aa, Artificial Sequence
  Synthetic
DEVDEARKEVDKLAKENTELVKRNKDSVKELVREDEDELRKNRESVDELLRRLEEEIRDERVVEDVIRKLEKLLEDSTRASEENKKRLEDLLRESEKSSRDVKKLLDDLLKKLKDVEGVLEEVLKTLREVSDRNKKLLEESNERVRKSTKESKDKLRKSNEEVKRVLKELRDTDT

SEQ ID NO: 11703 - protein, 175 aa, Artificial Sequence; identical to SEQ ID NO: 11702
  Synthetic

SEQ ID NO: 11704 - protein, 180 aa, Artificial Sequence
  Synthetic
DELDRLLEEVKRSLEDVEEKLKKLEEEVKRVNDELRKRLTRLLREVERSLKRVEDLIRNGEPKEDILREHERSVKEVLKEVRKVVTEVEEAHKRVMREVERVLREHEETVKRVLEDVTRRNGEKLEEVRERLKESLDRLRKRVEDLKRRLRESLESVRKLVEDLERALRKSLEELRERVR

SEQ ID NO: 11705 - protein, 180 aa, Artificial Sequence; identical to SEQ ID NO: 11704
  Synthetic

SEQ ID NO: 11706 - protein, 180 aa, Artificial Sequence
  Synthetic
EELDRLLKRVEESLRRVERILKELLDRVRKVNEDVKRTLDDLLRRSKESLDRVRKLREEGKDKDTVLKEHEKSLRKSTEDAKKVIREVEKVHKEVLDRVRKVLREHEKTVREVLEAVRRRNGEKLEEVEERLKRSLRELERLVRELEEELKKSVKSVRDLLEELKRRNEDSLRRLAEEIK

SEQ ID NO: 11707 - protein, 180 aa, Artificial Sequence; identical to SEQ ID NO: 11706
  Synthetic

SEQ ID NO: 11708 - protein, 180 aa, Artificial Sequence
  Synthetic
KELDDLLREVERSLDRVRKRLEDLLREVERVNEEVKKRLRDLLEELKRVADELRKLREDGKPKEKVLEELERAVKRLIDEVRRVIKEIEKFHKDVLDDVRRVLREHEETVKEVEERVRRRNGEKLEDLERELKRSLKELRDEVRELEERLRRSVESVRRVLKELEERARRLLKEVRDEIK

SEQ ID NO: 11709 - protein, 180 aa, Artificial Sequence; identical to SEQ ID NO: 11708
  Synthetic

SEQ ID NO: 11710 - protein, 180 aa, Artificial Sequence
  Synthetic
SELDKLLEDVKRSLDEVKRLLKELLDRVKKVNKELEEVLKRLEEDSRRVVEEVEKATRDGKDKDTVLKKLEDALRRSTEEVRRVLREVEEVHERVRKEVRRVIEEHRKTVKDVLDKARKRNGEKLEDLERKLEDSLRRLEELLRRLEDELRKSLTSVRKRVKELEEKNRELLKRVEEKIR

SEQ ID NO: 11711 - protein, 180 aa, Artificial Sequence; identical to SEQ ID NO: 11710
  Synthetic

SEQ ID NO: 11712 - protein, 180 aa, Artificial Sequence
  Synthetic
KELDELLKRIEDVVRRLEEELKRLLDEARKVNEDLERRLRKLREDVERSLREVDKMIRNGKPKEEVARRHEESVKEVDKDVKKVLKEVADRHREIVKRVEEVLRRAERVVEEIKREVRRRNGEKLKDLEKALEELLDRVRRLVKELRDRLRDSLRSVEEEVKKLKDELDRSRKAVRDKVK

SEQ ID NO: 11713 - protein, 180 aa, Artificial Sequence; identical to SEQ ID NO: 11712
  Synthetic

SEQ ID NO: 11714 - protein, 180 aa, Artificial Sequence
  Synthetic
SELDRLLERVRKSSTDSEKTLKELRDEIRRVNDEVRKVLEELLKESRRVAEEVKKVIDNGEPKEELLKTLEEVIKKSTKDVRDVIRELRRIHEEVLDRVRKSSRKNEESVRKIEEDARRRNGEKLEDLERELRRLLRRDRELVKKLEEDLRRSLKSVEEEARRLERANRELLREVEEKAK

SEQ ID NO: 11715 - protein, 180 aa, Artificial Sequence; identical to SEQ ID NO: 11714
  Synthetic

SEQ ID NO: 11716 - protein, 180 aa, Artificial Sequence
  Synthetic
SELDKLLRDVEESSRRSEETLRKLEKEVRDSSTESERILRELRDRIKKVADDVEKVIRDGKPKEKLVEDAKEFVREVEERVRKSSEDNRKTVEDIERRVRESSERNKDSVRRVLEEARKRNGEKLEELEKRLEDLLRRDKKLVDDLRKKLRDLEKRDRDLVEELRRELEELLKRVEDAAR

SEQ ID NO: 11717 - protein, 180 aa, Artificial Sequence; identical to SEQ ID NO: 11716
  Synthetic

SEQ ID NO: 11718 - protein, 180 aa, Artificial Sequence
  Synthetic
SELDRLLREVEKSSKRSEETLRDLRREVEDSSRRSEEILRRLLEESEKVAREVRKLIEDGQPKEEILKELARVIEESTRRAERSSRENEDTVRRIVKRVEDSSKRNAESVRDVMRKARERNGEKLEELEKRLRELLKRDKELVDELRKRLEELLKRDRELLKRLEEENRRLLEEVERRAR

SEQ ID NO: 11719 - protein, 180 aa, Artificial Sequence; identical to SEQ ID NO: 11718
  Synthetic

SEQ ID NO: 11720 - protein, 180 aa, Artificial Sequence
  Synthetic
KELDELLDEVRRSSETSERILRKLLREAEESTDRSKRTLKELLRELEEVVERVKKMIRDGKPKEKVLKELEDAVRRVLEDVRRSSEENKKSLEEIVRRVRRSSEENERTVRRVVEDARRRNGEKLKDLEKALRDLLDRDRKLVEELEDRLRKLAEEDEKVLRELEEELKRLLEEVAEETR

SEQ ID NO: 11721 - protein, 180 aa, Artificial Sequence; identical to SEQ ID NO: 11720
  Synthetic

SEQ ID NO: 11722 - protein, 188 aa, Artificial Sequence
  Synthetic
SLLEKLERDLERVHKESEDLARELRKELKRVHEESRELMKEIDKELRRVLEEVKSLLRRGDGEVLEELIRRAEEVLRTVERLLRRLIRISEEVLKKVEKDLERLERISREVVREVRRVLEEVKREREDVKDKVRRVEEKVEELLDRNRKLVEEVRREVEKVLRDDRRLVREVERKLKEALDEVRERVR

SEQ ID NO: 11723 - protein, 188 aa, Artificial Sequence; identical to SEQ ID NO: 11722
  Synthetic

SEQ ID NO: 11724 - protein, 180 aa, Artificial Sequence
  Synthetic
SEVEEVERRVDEVLKELKRKVDRSREESERIARELERLVEESEKKVRDVVRELEDLLRKVDREEVKKLVKEIIDELKRSSDRVRELVRRLIKEAEDSSDEVRRRIEDLLERLKELVEKAAREGRGEDLKEKIKEVEDRVDKVIKENKDLLDDVERRVRKVIKENEDLIKELRKRVEEVAR

SEQ ID NO: 11725 - protein, 180 aa, Artificial Sequence; identical to SEQ ID NO: 11724
  Synthetic

SEQ ID NO: 11726 - protein, 180 aa, Artificial Sequence
  Synthetic
SKVEELEKRVRKVMEKLKKLLKDSEKESDDVARRLEELLEESEREVREVLRELEDLLRKVDREEVKDAVRKLLERAKRSSDEVRKRIRDLIEESKRSSEEVKRLIDKLIKELEDVIRKAAKDGRGDDVDETIKRVEEEVKKVVDDNRRLNEEILRKVKKVIDDNRRLIEKVREDVDRMAK

SEQ ID NO: 11727 - protein, 180 aa, Artificial Sequence; identical to SEQ ID NO: 11726
  Synthetic

SEQ ID NO: 11728 - protein, 183 aa, Artificial Sequence
  Synthetic
SVVETVDKRLKRLLEKVEKSTEDSRRTAEESKKRVDRSTERVKEVLDRLRREVERLKDDDRADDIVREVVKRADELVKENEKVIKKVIEDNKKSVKENEEVIREVVKRIREVVEEAKRALKGGKKEKVRTVEKRAEDVIREARKLLEESKRRHDKVVEELERLLKKSKEDVDRVIKELEERRK

SEQ ID NO: 11729 - protein, 183 aa, Artificial Sequence; identical to SEQ ID NO: 11728
  Synthetic

SEQ ID NO: 11730 - protein, 183 aa, Artificial Sequence
  Synthetic
DEVEEVKKRLDELRKEVERSTREVREVLKKLLKEVKDSTDDVRRTIEKLLRDVERLKDEEEAKRIVDDVKRRIRELLDRNREVIKRVVEEARKVVDKNRRSVERVVDEARKLVEELIRRLKGGKKEELKKVEDRVREVIKDLEELLRDSKRTVEKVERELEDLVRKSEEEAERVERELEERAR

SEQ ID NO: 11731 - protein, 183 aa, Artificial Sequence; identical to SEQ ID NO: 11730
  Synthetic

SEQ ID NO: 11732 - protein, 183 aa, Artificial Sequence
  Synthetic
SVVEEVDRLLEELLRKVKKSTDESKETAKESRKEVKRSTEDNDRTVEKLRDEVRRLKDDERVEEVVEELIRRIERSAEENERVIREVIEKNERSMRENKRSVDDVVEKLRTVVDELRKALSKGVDDRVREVETRVKKVIDDVRRLVTESKKDHERVVKELRELVEESKRRNDRVVEEAKETAR

SEQ ID NO: 11733 - protein, 183 aa, Artificial Sequence; identical to SEQ ID NO: 11732
  Synthetic

SEQ ID NO: 11734 - protein, 183 aa, Artificial Sequence
  Synthetic
SMVEEVKKVLEKLKRDVDKSTDEVRDMLRRLLEEVRESSREVERRLRELKEEVDRFKDDERAKEIVKRVVEEAKKLVEENERSVRRVVEEIKKLLTRNKEVIDEVVKRARDLVRKLEEKLRGGKKEEVKKVKKEVDEVIRRLKELVRRSEEEARRVIKTLEKLLRDSKKRVEDVIKDLDRTVR

SEQ ID NO: 11735 - protein, 183 aa, Artificial Sequence; identical to SEQ ID NO: 11734
  Synthetic

SEQ ID NO: 11736 - protein, 183 aa, Artificial Sequence
  Synthetic
SMVEKVEEDLKKLTRDVEKSTEESRKTAEDSARDVRRSSREVEDVLRRLRKEVEELKDDDRAEEIVRRVVKEARDVVEENERSVRKVVERNRRSVEENKRVIDEVVERAKRLVERLREKLDKGKKEEVKKVEDKVKEVIERLKKLLDESKKRHEDVIRELEKLLEESERKVRKIIRELEETLR

SEQ ID NO: 11737 - protein, 183 aa, Artificial Sequence; identical to SEQ ID NO: 11736
  Synthetic

SEQ ID NO: 11738 - protein, 183 aa, Artificial Sequence
  Synthetic
SVVEEVKRRLEELEKRVEDSTRDSKRTLDESERELEESSRDNRRTVEELLDELRRLKDREEARDVARRVVEAIKKSLDDNRRSIDELVKKNEDSVKKNEKVIKEVVDEARKLVEKLVRRLKGGKKEEVEKVEREVREVIKKLRDLVRRSREEHEKVIEKLKRLLEESEDTNRKVIKKVEDDLR

SEQ ID NO: 11739 - protein, 183 aa, Artificial Sequence; identical to SEQ ID NO: 11738
  Synthetic

SEQ ID NO: 11740 - protein, 186 aa, Artificial Sequence
  Synthetic
SVTDEVREKLRRLLEELREVVKRVEDISRKTHEETKRVVEKVKRILEKLKREIEEVIRELGKDDRLRKVVERVEREARRVLKELEEAVKRSMKKNEKALRDLRRVAKKVVDALRKILKEVAERLKDRKEDLERLRRDVERVIREIEKLLRDVEEKVKETIKTDEDLLRRVKEDVERVLEEIDRRLK

SEQ ID NO: 11741 - protein, 186 aa, Artificial Sequence; identical to SEQ ID NO: 11740
  Synthetic

SEQ ID NO: 11742 - protein, 186 aa, Artificial Sequence
  Synthetic
SVAETVKERLKDLHRRTKESNERAKRISDELNKHNEKSVRDVDREVKRLLEEITEVIKRLGKDERLKKVAREIERILEKVLEDVKRNSEKAAREHKKVVEENHRSVRRSAEELKRILEEVARDLKDDKEALRKLDEEVKKVADDDRRLNEESRKRAKDSIEESRKLVRDVAERVKEVARKIREDLR

SEQ ID NO: 11743 - protein, 186 aa, Artificial Sequence; identical to SEQ ID NO: 11742
  Synthetic

SEQ ID NO: 11744 - protein, 179 aa, Artificial Sequence
  Synthetic
DEARELIERVKRVLDRVREENTRVNKELHDILRRVEKRNRDLLRELREILKDVKKKADEVREDKEVLRKLLKEVEKALRRVKEESDRSLKEVRDAVEEVKRISDTSLDKVRKVLEDAKRAVKDSRELEKELRRLIAEVARIVEESRRNLERIEEAIKRISETSEKEIREIEDRIKKDVD

SEQ ID NO: 11745 - protein, 179 aa, Artificial Sequence; identical to SEQ ID NO: 11744
  Synthetic

SEQ ID NO: 11746 - protein, 176 aa, Artificial Sequence
  Synthetic
SEAERAREEAKKLKEEIKKSNDELRKAAEKLKRDIERSNDELRKAIEELKRRVESLLRRVEKKLVDEVRRLAEDAARKLKRSLDETRKLVEKVLREIEESLKTVEELVKRLLEEIEKALESDEVLKEVKRIAEELHRHNREVLERIEKIARELEKHNRDVLDDIRRIVEKLERDLN

SEQ ID NO: 11747 - protein, 176 aa, Artificial Sequence; identical to SEQ ID NO: 11746
  Synthetic

SEQ ID NO: 11748 - protein, 176 aa, Artificial Sequence
  Synthetic
SEEERAREDLERLREEIRRSNEKLEEDSDKLRRDIEESNRRVEEEIRRLKEDVERKLKDVPEDLARKVRELVERLMDKIRKSLETTRELIRRVLEHDKRSLDEVEKIVREALKLIETRLESEEVLEEVRRLVKKLHEHNEESLRRSEEILKDLERHNRDVLREVEEIVREALERLD

SEQ ID NO: 11749 - protein, 176 aa, Artificial Sequence; identical to SEQ ID NO: 11748
  Synthetic

SEQ ID NO: 11750 - protein, 176 aa, Artificial Sequence
  Synthetic
REAEEAKKEADRLEEEVRDSNRKLEEDSKRLEREIRESNRKLKETAERLLRDVERLLKDVEERLVRDVKRKVEEAMEKLKKSLDKTRKLVRELLEHDRKSLEESERLVREVLRLIEEKLESKEVLEDIRRIVKELHDHNKKSMEDSRRIIEELKRHNKRVIDEVKKIVDELREKLR

SEQ ID NO: 11751 - protein, 176 aa, Artificial Sequence; identical to SEQ ID NO: 11750
  Synthetic

SEQ ID NO: 11752 - protein, 176 aa, Artificial Sequence
  Synthetic
REAEEAEKELKRLEDDIKKLVEDLDREAKRLKKEVDDSNRELEKESRRVKKEVRELLKDVDEKLVREVEKLVDEALEHDKKSLDDTRKLVEDVLRKLEEVLKEVKKLVDDALEEIRKKLESDRMLEKVKRIVDELRKLLKTVLDDVRRIVEELHRHNKESMERTRKILEDLARRLT

SEQ ID NO: 11753 - protein, 176 aa, Artificial Sequence; identical to SEQ ID NO: 11752
  Synthetic

SEQ ID NO: 11754 - protein, 176 aa, Artificial Sequence
  Synthetic
SEAERAREVLERLREEVERSNKRVREELKRLTEDVRRSNKKLREDSEEVRKRVEDLLKDVDKELVDEVRKLVKEALDLDEKSLKETEDLVREVLEEIEDSLRKTDELVKRALKIIEDKLESDEMLRRVRRIIEELHRLNKEALDRVRKIIEDLHRKNEDSLKKTEDILRRLEEELR

SEQ ID NO: 11755 - protein, 176 aa, Artificial Sequence; identical to SEQ ID NO: 11754
  Synthetic

SEQ ID NO: 11756 - protein, 179 aa, Artificial Sequence
  Synthetic
SSIEEVLERLRRLSDEVRKRTDDVLERAREISRETEERSRRINEEIERIVEELKKRADKDMVEKVKRDAEELLKKSEDLHRRVIETLRRLVERVREIHEETIRRLEELLKKVEDELKGGDKEAVDRARREVERLVKENEDILKRLEEEVRKLVKRNEDLVEENRREVEKWRKELEDRKR

SEQ ID NO: 11757 - protein, 179 aa, Artificial Sequence; identical to SEQ ID NO: 11756
  Synthetic

SEQ ID NO: 11758 - protein, 179 aa, Artificial Sequence
  Synthetic
SEIDEVLKKLRDDSKKVEEDTRRVLEELERISEKTRKDSEEVLREIEDIVEKLKRRSDEDMVRRVMEEADKLLKELEDRHRDAIRRLEELVKRVEEIHREVIERLERLLKEVEKRLSKGVREEVERAEEEVRKLVEENKRIVKEAKERVDELVERNKEIVEEIRREVERLKKELEDRRR

SEQ ID NO: 11759 - protein, 179 aa, Artificial Sequence; identical to SEQ ID NO: 11758
  Synthetic

SEQ ID NO: 11760 - protein, 179 aa, Artificial Sequence
  Synthetic
REVEEVTKELRKISKEVEDLTREVLREAREISRRTEEESRRLNKEIAEIVERLRREGDEKAVEEVLREVDKLLEESERLHREAIERLRRLLEEVEEIHRRVIEEMKRLLDDLTRKVDKGSKEDVRRVAEEVKRLVDKNRRIVEEAKKEVDRLVKRNEDLMRRNREEVERWKRELEEDRR

SEQ ID NO: 11761 - protein, 179 aa, Artificial Sequence; identical to SEQ ID NO: 11760
  Synthetic

SEQ ID NO: 11762 - protein, 179 aa, Artificial Sequence
  Synthetic
SEVDEVLKTLKKLSDDARKKTKEVLDRLRDISRRVEEESRKVLEEIRRKVEEVKKRRDDDAVKEVMKDADRLLKRLEEIHRKVMDELDKLLKRVEEIHRETIEELKRLLKDVTDKVSKGSKDKVRKVKEDVRRLVEDNKRIVKEAREEVERLKERNKDIVRRIKETVDRLKDELRKRAE

SEQ ID NO: 11763 - protein, 179 aa, Artificial Sequence; identical to SEQ ID NO: 11762
  Synthetic

SEQ ID NO: 11764 - protein, 179 aa, Artificial Sequence
  Synthetic
SDVDRVLKELEDISKDVEDKTREVLKRLKEISDEVKKRSEDINREIARIVEDLERRRDERFVERVKREADRLLKESRDIHRRVMRELEKLLEDVERIHREAIKTLEDLLRKVEKKVSKGDKEKVKDARRVVRELVERNKEIVRRAAEVVKKLKKENAKLVEDNTREVKKWKERLERRRR

SEQ ID NO: 11765 - protein, 179 aa, Artificial Sequence; identical to SEQ ID NO: 11764
  Synthetic

SEQ ID NO: 11766 - protein, 177 aa, Artificial Sequence
  Synthetic
SEVEDLLRKLKEISDESRERIKRLLEELEEISRKSKEDSERSNEELHRIVKRLKEENRDEAVERVKDALRRVLERDRELVERSIRVLKKVVDDVRRIVEESVKRLRDVVRKVRRDVEREEDLRRAEDDVRRLIEDNKRLLEEAKRRVDDLRRKNEEILRESEKNVRRIEKELEDRRR

SEQ ID NO: 11767 - protein, 177 aa, Artificial Sequence; identical to SEQ ID NO: 11766
  Synthetic

SEQ ID NO: 11768 - protein, 177 aa, Artificial Sequence
  Synthetic
SEVEDLLRKAEEISDRSRREIEKLLRELERIVREVRERSKRSNDELHRIVKELKEERRDEAVERVKRVLEEVVKRDEEIVRDVARLLERVVKEVERIVRESVEMLKRIVETIRRDLEDEKKLRDVEKRARELIRDNERLLEDAKRRVDELRRELKKILDDSRRNVERIMKELDDEKR

SEQ ID NO: 11769 - protein, 177 aa, Artificial Sequence; identical to SEQ ID NO: 11768
  Synthetic

SEQ ID NO: 11770 - protein, 177 aa, Artificial Sequence
  Synthetic
SEVDELLKRLEEISEESRRRSEDSNREVHEIVKEVKKRSEDSNRRLHKIVEDLKRENKDKAVEEVKEVLREVVERDEEIIRRVRERIRDLVRRDERIVRESVKRLRKVVEDVRRDVEDKDELKRAEDRVRELIKENKRILDESKENAERIDRELKKILEDSKRNVEEIAKRLEEDRK

SEQ ID NO: 11771 - protein, 177 aa, Artificial Sequence; identical to SEQ ID NO: 11770
  Synthetic

SEQ ID NO: 11772 - protein, 177 aa, Artificial Sequence
  Synthetic
KDVEKLLRELEKISEDSKRESDKSNKEVHDSSREVERRSRESNRRLHKVVEDLKRTNRDEAVERVKELLKKVVEEDKRIAEEDEERIERVLRRDKEIVRKSVEDLRRVVDKVRTRVERDEDLRRAKREVERLIRENEKILEDSRENLRRIAERSRRVLEESERNVRRLIEELEETRR

SEQ ID NO: 11773 - protein, 177 aa, Artificial Sequence; identical to SEQ ID NO: 11772
  Synthetic

SEQ ID NO: 11774 - protein, 177 aa, Artificial Sequence
  Synthetic
REVEELLKDLRRILEEVKRRIEKLLDELRKISEESRRRSEKSNEELHDIVKKLKDENKDEAVERVEEVLKKVLERDKRLVDRSVEELRRVVEEIKRIIDRVVERLEKVVEDVRRDVKDEKTLRDAEREVKKLIDTLRKILEDARREVKKLIDKNEKILRDSEKNVRDIAEELRRTRK

SEQ ID NO: 11775 - protein, 177 aa, Artificial Sequence; identical to SEQ ID NO: 11774
  Synthetic

SEQ ID NO: 11776 - protein, 177 aa, Artificial Sequence
  Synthetic
DEVRELLREVKEAVDEVRRRSEESNREAHRVSEESEKRSRESNKRLHEIVEDLKRRNKDEAVEEVKKALRRVVEEDKRLVDESVERLEELVRRDEEIARRLEEKAKKVVEKVRRDLEDEEKLKRAEEEIRKVIEDLRRILRESRENAKRIIRRNREILRESKKNVEDLERELEETRR

SEQ ID NO: 11777 - protein, 177 aa, Artificial Sequence; identical to SEQ ID NO: 11776
  Synthetic

SEQ ID NO: 11778 - protein, 177 aa, Artificial Sequence
  Synthetic
SEVEELLKRLRESSRRVRELSKRSNEEVHRSSDKVRRDSEESNRELHKIVEDLKRENRDDAVRRVKKRLDDVVEKDRKIVEDDVKLARDVVERDRRIAEEDVRELERVVKEVERDLEDERKLREARKEVKKLIEESREVLERSERNIRELIKESRRLLEESRRNVERLKKELEDTRK

SEQ ID NO: 11779 - protein, 177 aa, Artificial Sequence; identical to SEQ ID NO: 11778
  Synthetic

SEQ ID NO: 11780 - protein, 180 aa, Artificial Sequence
  Synthetic
SEEDEARKDVKELEDRLRKINEDSERAVRRIEEELKRILEENDREVKRLLRKIEELLRRKSSEEIKKLVDDLKKIAEDVLREAKKSVDDLRRILRKVLRDSSELVKELKEILERALRVVEAGVDIETVIRELRKALEEAARRSKRLIDELKKVLEEVKRANEETNKRLTEVVEEVAERIR

SEQ ID NO: 11781 - protein, 180 aa, Artificial Sequence; identical to SEQ ID NO: 11780
  Synthetic

SEQ ID NO: 11782 - protein, 180 aa, Artificial Sequence
  Synthetic
KEKEDAEREVERLERESRRVNRESEEEIKRLLRESEKVNEDSEREVRRIREELERLLRKKEDDEARRMVEELEKILKEVLERSSELVERDREILERILRESSRLVDEDRRILEEALRVVREGVDIDKVLTELRRSSEEVTRLSEELIERVARSSRKVKELSRKLIEELRKVLKDVARRLE

SEQ ID NO: 11783 - protein, 180 aa, Artificial Sequence; identical to SEQ ID NO: 11782
  Synthetic

SEQ ID NO: 11784 - protein, 184 aa, Artificial Sequence
  Synthetic
EELERLEKDLREVIKDSERSSDDVRRRLEEVIRDNERLLEELDERLKEVIRDVEDLLRKKDREDVKRLLKELRERVDKVRKDAEDLLRRSRKIVTEWIRRSERAVEENRRVVDEVRKEAAKEDKNKKLIDDLRRKIEESLKDSRRLDEEARKEIERISRKTREDIKELLDRIKEVLDEIRERIR

SEQ ID NO: 11785 - protein, 184 aa, Artificial Sequence; identical to SEQ ID NO: 11784
  Synthetic

SEQ ID NO: 11786 - protein, 184 aa, Artificial Sequence
  Synthetic
DELEDLERKLKEIIDDSKRLLDELEKRLRESNREVERLLDELRKELEKVIRDVEELLKKKPREEVAKLLEDLRRKVKEVEEELRRMLKKNRDVTREVKKEADKALKENERLADEVRKEATREDKNKELIDKLVRELEKSLEESRRLIEELRKEIERTSREIEKRIRDLLKEIKDVLDDIRRRIE

SEQ ID NO: 11787 - protein, 184 aa, Artificial Sequence; identical to SEQ ID NO: 11786
  Synthetic

SEQ ID NO: 11788 - protein, 183 aa, Artificial Sequence
  Synthetic
SELEEVEKRAEELARTLEELNRDVNRRLEELLRRLEKINRTVNDELRKLLEELKDVRRRGKKDVEETLKRVEDRAEELVREVKERTKEVVRRAAELVRKVVEDSRRVAEEIRELAREVAERVESKEDLDRLDKRVRDIVRDLERINEETRKTLEEIRERLERILKRTEENLKEIKEEVRKDEK

SEQ ID NO: 11789 - protein, 183 aa, Artificial Sequence; identical to SEQ ID NO: 11788
  Synthetic

SEQ ID NO: 11790 - protein, 183 aa, Artificial Sequence
  Synthetic
SELEKVTEDVRRLLERLRDINRRVNEALRRLAEELKRLNDEVNKLLRELVTELKKASKDGVPNVEEAVDRVLEELERLVKTVKDISREVAKRLEDLVRRVVEETDKVLRKIRDDVDKVLKRVEDKDKLEELKREVERIEKDVREILKRTEDNLRRIVEELKEINERTEDSLRKIVRELSEDRK

SEQ ID NO: 11791 - protein, 183 aa, Artificial Sequence; identical to SEQ ID NO: 11790
  Synthetic

SEQ ID NO: 11792 - protein, 183 aa, Artificial Sequence
  Synthetic
REKDELRKKVEELLKRLEEISKRTKDSVERVLRELDKITKESKKRAKKLVDRLKELLKRVTDERVKEIVRDVLRKIDKLVRDVARLNEEVKKRIKDLVREVEKRNRDVLDEIRKLVEEVERRGDERAIEEVLKTIEELIKEVEDVNRRVNETIRELLERLRRANEDVIRKVEKLIKEVEDATR

SEQ ID NO: 11793 - protein, 183 aa, Artificial Sequence; identical to SEQ ID NO: 11792
  Synthetic

SEQ ID NO: 11794 - protein, 183 aa, Artificial Sequence
  Synthetic
SEKERLRDMLRKIRETLDRISEDTKRSLDEVRRRLEEISKRTKDNARKLVRELEELLRRVSRKEVKKIVDDVRRRIEELVKEVEETNKRVLEEAKKLVEEVVKLNKTVLKEATRLIEEVERRMDEEFVKRVEDTLRELLDRVRRENERVNRDIDRLLKEVEERNKRVNDELRKLIEDVKEAAR

SEQ ID NO: 11795 - protein, 183 aa, Artificial Sequence; identical to SEQ ID NO: 11794
  Synthetic

SEQ ID NO: 11796 - protein, 186 aa, Artificial Sequence
  Synthetic
DDVRELIERLERILKRVEDINRDVNRKLRRVLERVRKDNEDSNRKTEKVLRDVKERADEIRSDEDALKKLVEEVERVLEEDIRRSEESVDEVRRVLEEVIRRSEETVKEVEEVIKEVEDAVRRASISEKLLRDVERELKRVREDLERILRESRDVVRRVKEELDKILEESRRKVEKVRKDLEDTRK

SEQ ID NO: 11797 - protein, 186 aa, Artificial Sequence; identical to SEQ ID NO: 11796
  Synthetic

SEQ ID NO: 11798 - protein, 186 aa, Artificial Sequence
  Synthetic
SEVEKLITDLRRILKEVEERNRELNKRNDETLKRVEETNRRVNKELKEILDRVIDEARRKREDRDLLRKLVREVEEVLKKVLRDSEETAKEVERSTREVETISRKTVDEVRKVIERVKEAVERLEISEDLLRRVEEELRKVEKDLKRILDKSRDDLRKSRERLERILRRSEEIVREVEERLRRAAT

SEQ ID NO: 11799 - protein, 186 aa, Artificial Sequence; identical to SEQ ID NO: 11798
  Synthetic

SEQ ID NO: 11800 - protein, 186 aa, Artificial Sequence
  Synthetic
DEVRKIIKELEEILEEVRKRNEKLIRENEETLERVRKINEKAIRELEDILRRVKEAVERKREDERLLRELVKTVKKVLEDVEKKSEDTLDEVRRSTERVIRESERSVEEVRRVVKKVLEMVRRLEVSEDVLRDAERRVREVREKLERINKTSRDRLKRSKEEADRINKESREVVKRVKEELEKTAT

SEQ ID NO: 11801 - protein, 186 aa, Artificial Sequence; identical to SEQ ID NO: 11800
  Synthetic

SEQ ID NO: 11802 - protein, 186 aa, Artificial Sequence
  Synthetic
DEVERVIRELERILREVEKRNRDVLRKNEETLREVRERNERAIEELRRILKKVKEEAERKREDEDALRRLVKRVEEAIKRVRELSERSVRKVEESTKEVEDDSRRSVETVRRMLEKLRREVEKLEVSEDVLRTVRKKVEEVREALDRINETVKKALDDSRRRLEKINRDVRRDVEKVREDLERTAT

SEQ ID NO: 11803 - protein, 186 aa, Artificial Sequence; identical to SEQ ID NO: 11802
  Synthetic

SEQ ID NO: 11804 - protein, 186 aa, Artificial Sequence
  Synthetic
DEVKKLIDDLRKILDRVRKENRRVIEELRKILEDVERRNREAIERLERILRRVVDLMRKKREDRKMLEDLVREVERAIERVEKLSEESLDEVRRVIEEVKRRSDKTVKDVRDALKEVLEAVERLQVSEEVLKRVREEVDRVRRELDRINEDSERVLRDVARELERINREVRKRLKEVEKRLREAAK

SEQ ID NO: 11805 - protein, 186 aa, Artificial Sequence; identical to SEQ ID NO: 11804
  Synthetic

SEQ ID NO: 11806 - protein, 186 aa, Artificial Sequence
  Synthetic
SEVEKIIKELREILERVREDNRKIIDDLRKILKEAEDTNRKVIKELKEILKDVSKLMKEKRSDEDALRRLLEEVDRVIKDVIRLSNESLKEVERVIEEVERRSRKSVEEVRRVIKRVLEMVKRLEVSEELLKEAEKDVRRVKEKLDKINRDVREELKKVAEDVKRINDRSREELRRVKEELKKDSD

SEQ ID NO: 11807 - protein, 186 aa, Artificial Sequence; identical to SEQ ID NO: 11806
  Synthetic

SEQ ID NO: 11808 - protein, 186 aa, Artificial Sequence
  Synthetic
KEVEKVIEELRKILDDARRENERLLRELEEILKRVEERNRKLLEDLRRILEEVRKKAKDIRRDKDALDKLVREVDKVIKRVKEESDRSVEEVRRVIEEVITRSEKSLRDVERAIERVKETVDRLQVSEEVVKRVEEELKKVKEDVERINKEVRDRLREVEERLEKINEDTERTLKKVKDELEETKR

SEQ ID NO: 11809 - protein, 186 aa, Artificial Sequence; identical to SEQ ID NO: 11808
  Synthetic

SEQ ID NO: 11810 - protein, 179 aa, Artificial Sequence
  Synthetic
DELRDVLRRLREVLTELEKENRKSIEELKKLNEDVARDIKRVIDELRKLLKRVKEEIEKNKDSKELIERLLEEVEKAVKRIDELVKKLLDDNKRVVDESRELARRTLETVEEVVRKILETADKDEEVRKELEDVRRKAEKILRDNDERLKESNRHMEKLLREVKEELKRVRDAVEEARK

SEQ ID NO: 11811 - protein, 179 aa, Artificial Sequence; identical to SEQ ID NO: 11810
  Synthetic

SEQ ID NO: 11812 - protein, 179 aa, Artificial Sequence
  Synthetic
DEVRDVIKKLKDLNDRLDDENKKSIEDLKRELERLERRNRDSIRRLEELLKDVADKIRRRRDDEELVERLLREVKKVVEDSRRLAEETLKEVKDIVKRSEELARTTLERNRDVVKKIIEAADKDKDVRKRLRESNEHMKELLKENKELLKRLEDEVKRILERNKKELDRVLRRAEELRK

SEQ ID NO: 11813 - protein, 179 aa, Artificial Sequence; identical to SEQ ID NO: 11812
  Synthetic

SEQ ID NO: 11814 - protein, 182 aa, Artificial Sequence
  Synthetic
RSVEEVRKVLEELKREHEKISKKTEEVLEDLKRRHEEIIKRVRDVLREIEEDLRRIRSRVDDELKRVLSEVLERVRRLVKELEDILKDSLRKIEKLVRELHEINKRSLDTLRELADRLAKDDTDEKVEKVIRELRRSVEDSKRRNDEAIRRLEESVRKSSDEVRRAIKELRDLLKKVRDTTK

SEQ ID NO: 11815 - protein, 182 aa, Artificial Sequence; identical to SEQ ID NO: 11814
  Synthetic

SEQ ID NO: 11816 - protein, 182 aa, Artificial Sequence
  Synthetic
STVERVREEADRLRKEHERISDETRKVLRKLEEDHERISRRTEELIERIEREVRKIESRVDEDLVRELREVLKEVRRLAKEVHEENKRSLDRLRELVERLHRENDKSLREIDKLADELAKDDDDEKVKRVEEEVRRSVEESKKENKKVIDDARRSVKRSEDRNREVIKEVKRLLDTVRERAK

SEQ ID NO: 11817 - protein, 182 aa, Artificial Sequence; identical to SEQ ID NO: 11816
  Synthetic

SEQ ID NO: 11818 - protein, 182 aa, Artificial Sequence
  Synthetic
STVEDVRRRADELRRRHKKISEETERVLRRIEEAVRRILEDLRRILKEIEDRVRELLSRVDEKLKRVLEEVRRRLKKLVEELERRLTEVLKRVRELIRKLHEDNKRSLERIDKLADELAKDDDDEKVKEAKRRVTESVRKSKDRNRRVIEEVDRLLKRVEEEVRRVKEEAKELLREVAERTK

SEQ ID NO: 11819 - protein, 182 aa, Artificial Sequence; identical to SEQ ID NO: 11818
  Synthetic

SEQ ID NO: 11820 - protein, 177 aa, Artificial Sequence
  Synthetic
SSVEKVIEDLRRISEKVKKRTEDVLREAEKILRRVEKDNKKVNDDARRIVEELERRGDEKAAREVVKKVEDLLKELKEIDEEVARRVRKLVKELKEIHRKVIEDVRRLVKELEDEGIEKRLVDRVREAAKDIEDENREVLRRVEEILRRIEEELKRSSDETEKAVREIKRRLDERAR

SEQ ID NO: 11821 - protein, 177 aa, Artificial Sequence; identical to SEQ ID NO: 11820
  Synthetic

SEQ ID NO: 11822 - protein, 177 aa, Artificial Sequence
  Synthetic
EEVERVLEEIKRISTDVARRSKEVLKRARESSERVKRRTEEVLEEIRKTNEDVARRADEELFKKVVEDNKRLLDRLREEHRKDDEVVRKLLKELEDIHRKSIEEVRRLLEDLERRGIDKKVVDRLRKEVKRNEDENREMVREVEEEVRRLEKENEEAVRRAADIVRRSEEHLRERTR

SEQ ID NO: 11823 - protein, 177 aa, Artificial Sequence; identical to SEQ ID NO: 11822
  Synthetic

SEQ ID NO: 11824 - protein, 184 aa, Artificial Sequence
  Synthetic
KEVEDLLREVEKSSEKVRELIERSIRELERILEKVAEEIRRSIEELEKILERVAEVAKRRDRELVKRIIEEVLERVDRVNKENEEIIRKVAKEVDDVNDRNRKIVTENKKELERVLREIRNLPVDEKIVKRVEDEIRRLMKKSDELLERSTKVVEDIKRELEKLLETSSRMAEDIKRKLEELRR

SEQ ID NO: 11825 - protein, 184 aa, Artificial Sequence; identical to SEQ ID NO: 11824
  Synthetic

SEQ ID NO: 11826 - protein, 184 aa, Artificial Sequence
  Synthetic
SEVEKLIEELERILEEVARRLKKSNEDLRKILKEVAKRIKDSIRDLRRILEEVADELRRRSEELVERIIRDVLRRVDKVNKENDEIIKRVEETVRRVLDRNRKIIKEVEDTVDKVLKEIRDLPVDERIVEEVERAAEEIKRRLEELVRRSEKSVEEIERELRKLLKDSSDVVREIKKRLEDERR

SEQ ID NO: 11827 - protein, 184 aa, Artificial Sequence; identical to SEQ ID NO: 11826
  Synthetic

SEQ ID NO: 11828 - protein, 184 aa, Artificial Sequence
  Synthetic
SEVEKLLKEVEDSSRKVEEDLRDSNRELKKILDEVADRIRKSIKRLEDILKKVAEDAKRRDKELVEKIIKEVLDDVERVNRENKRILEEVRKRVDEVLRRNREIVKENEKLLDDVLKEIRDLPVDEKIVRDVERRVRELKERSRRIVEESERSAREIKRELKRLEDDSSRVVEDIRKKLEELAK

SEQ ID NO: 11829 - protein, 184 aa, Artificial Sequence; identical to SEQ ID NO: 11828
  Synthetic

SEQ ID NO: 11830 - protein, 184 aa, Artificial Sequence
  Synthetic
REVEELIKRVEESSRDVERRLRESNEEVERSTRRVAEEIKKSIDRVREIVERVERKKERVSEDILRDIARRVSEFVRRANKRNEKIARDNRRRVREVLRRNREIVKRNKELLDKVLEEIERLPVDEKIVERVRRVIEELKRRSDEIVKESERSVRRVEKETTELLEESSRAVERVERRLRELVR

SEQ ID NO: 11831 - protein, 184 aa, Artificial Sequence; identical to SEQ ID NO: 11830
  Synthetic

SEQ ID NO: 11832 - protein, 184 aa, Artificial Sequence
  Synthetic
SEVEKLIEEVRRSSKKVEEDLDRSNRELEDILRRVAEELEKSNRELEKILKEVAERVKRREERLVKKIVEEVERKVDEVLKRNRDIIRKVEETVERVLRRNRKIVDDNRKLLDKVLEDIRRLPVEEEIVKRVEEEARRLKERSREIVKRSEDSAREITKALRKLVRDSEDSVRKIKEKLKEETR

SEQ ID NO: 11833 - protein, 184 aa, Artificial Sequence; identical to SEQ ID NO: 11832
  Synthetic

SEQ ID NO: 11834 - protein, 184 aa, Artificial Sequence
  Synthetic
REVEELDKRLKESSTEVEERLRRSNREVEDSTRRVEEEARKSNEELREILERVAEDVKRRRKEEVDKIVRDVDERVKEVLKRNEDIARENERLLDRVLKRNKEIVEENEKLLRKVLEDIRRLPVEERIVERVERSARELMRRSRDIVRRSKESIERLKKRTRDLVKESRESVEKIKRDLEELRR

SEQ ID NO: 11835 - protein, 184 aa, Artificial Sequence; identical to SEQ ID NO: 11834
  Synthetic

SEQ ID NO: 11836 - protein, 184 aa, Artificial Sequence
  Synthetic
SEVEKLLKELEDSSKKVEDDLRKSNEELRKIVEEVADLIRRLNKELEEILREVRERMRRVSEEEAERILREVAERVKRVHDESREIIERVLRDVERVLEENERIIKENKERLDKVLKEIRDLPVDEEIVRRVEKIVRDLKRRSDELVRRSRKSVEEIRKELEELVERDRRSVERIKEELDKERK

SEQ ID NO: 11837 - protein, 184 aa, Artificial Sequence; identical to SEQ ID NO: 11836
  Synthetic

SEQ ID NO: 11838 - protein, 184 aa, Artificial Sequence
  Synthetic
SEVEKLTKEVRDSSKRVEDELRKSNERLKESTDRVADEIRRLNKELKEILDKVAREVERRDKKLAEDIIRDVKKKVDEVHKESRDIAEENKKLIDEVLRRNREIIRENMERVERVLKEIRDLPVDEEIVERVERDARKVKEDSKRLVEESEESVRRLKTDTERLVEEDKKSVDTIKEELKKLTK

SEQ ID NO: 11839 - protein, 184 aa, Artificial Sequence; identical to SEQ ID NO: 11838
  Synthetic

SEQ ID NO: 11840 - protein, 184 aa, Artificial Sequence
  Synthetic
DEVEELRKELEDSSREVEELIRRLNKEVEKSTREVAKRVKDSNKRLDEILKKVAEEVKKRSKETAKRIIEEVMRRVREALRRNEEIAERNRRLLERVHDTSRKIVETNKDRLDRVLERIRNLPVDREIVERVREEVEKLKKRSEDLLERDKESIDKLDKETKELVEESRKSVRDIERELKKLSD

SEQ ID NO: 11841 - protein, 184 aa, Artificial Sequence; identical to SEQ ID NO: 11840
  Synthetic

SEQ ID NO: 11842 - protein, 184 aa, Artificial Sequence
  Synthetic
DEVEKLIKDVEDSSREVEERIRDLNRKAKKIVREVAERIRELNERLKEILDKVAEEVKRRDKELAKEIIKKVLEDVRRVHKESRDIIREVKEVLDRLHKTSEDILRKNKELLDKVLEDIRRLPVDEEIVKRAEKRIRELKKKSDELLKRDRDSMDRIKKELEKLTREDEESVRRIERELKRLAD

SEQ ID NO: 11843 - protein, 184 aa, Artificial Sequence; identical to SEQ ID NO: 11842
  Synthetic

SEQ ID NO: 11844 - protein, 184 aa, Artificial Sequence
  Synthetic
SEVEKLIEEVRRSSEEVERRIKKLNDDVRRSTEKVEEDIRRLNEELKKILDEVAKEMERRDKEEVKRIIEEVEKRVKEVHDRSREIAERNKKRIDDVHRESARIAEENKEELDKVLKRVRELPVDERIVRRVEKIIRDLKKRSDELLKEDRRSAEEAKRETDRLVEEDKRSVDEIRERLKELSR

SEQ ID NO: 11845 - protein, 184 aa, Artificial Sequence; identical to SEQ ID NO: 11844
  Synthetic

SEQ ID NO: 11846 - protein, 184 aa, Artificial Sequence
  Synthetic
DEVEELLRRVEEIVERVAKRIEELNRRLEEILEEVARRSTKSIKELEDILRKVAKEMERRRKEEAKKILDKVVKDVEEVNKRDEEIARRVEKIVKDVHRDSRRIAEEVLRFLDRVLERIRELPVEEEIVERVERRIRELKKRLEKLVRDDEESVKEIRKKLEELVKRSSDVVERIKRELDKLRK

SEQ ID NO: 11847 - protein, 184 aa, Artificial Sequence; identical to SEQ ID NO: 11846
  Synthetic

SEQ ID NO: 11848 - protein, 184 aa, Artificial Sequence
  Synthetic
SEVEKLLRELRESSREVEERIRKLNRELEKIVRDVDRESARSIEELKRIAEEVAERAKRRDKEDVKRILERAVEEVRRVNKRDRDIIREVLKLVDDVHEESRKIVEDNKRTLEKVLEEIRRLPVEERIVKEVEEEVRRLKKRSTKLLEDDRKSVEDIKERLKELVRRSSEVVKEIEERLKRLEK

SEQ ID NO: 11849 - protein, 184 aa, Artificial Sequence; identical to SEQ ID NO: 11848
  Synthetic

SEQ ID NO: 11850 - protein, 184 aa, Artificial Sequence
  Synthetic
SEVEDLLRRVRESSKEVEERIRKLNDELRKSTKEVEDRSRRSIERLDRIVEKVAREVERRDKELVSRIIKRVLEDVDRVNKEDKEIAEENKKEIDRVHEESRRIVEENKKLVDEALERIRRLPVDEKIVRDVEREVRRVKERSDRLLEEDRKSVEELKTRTDRLLEESSKRAEDIKRKLKELEK

SEQ ID NO: 11851 - protein, 184 aa, Artificial Sequence; identical to SEQ ID NO: 11850
  Synthetic

SEQ ID NO: 11852 - protein, 184 aa, Artificial Sequence
  Synthetic
SEVEKLLREAKESSREVKDRSKKSIDELRESTKTVERLIRDLNRKLKEILDRVADDMRRRDKELAERIIREVLKRVDDVHRESKKIADENKELLKRVNDRDREIVKRNDELLDEVLKRIRELPVDEKIVRRVEEIVRRLKKESKDLVEESTRVADELRRRTDRLVEEDERSVRKIKEDLDRLRK

SEQ ID NO: 11853 - protein, 184 aa, Artificial Sequence; identical to SEQ ID NO: 11852
  Synthetic

SEQ ID NO: 11854 - protein, 181 aa, Artificial Sequence
  Synthetic
SEKEEAKRRARELEKRTDELLEESTRVNEESKRHLKELLDESRRTAKRVKEEIDKLLKEKREGDRVEELVKELKKIIDEVLKRNEELIREAERIDDESNKRNEELARRDKEIIRELLRLVEEGVDVDTLLERVDRSSKEVADRMRKSNEEVKDVNRRVAKALKDSNRDVERVLEDVARKIK

SEQ ID NO: 11855 - protein, 181 aa, Artificial Sequence; identical to SEQ ID NO: 11854
  Synthetic

SEQ ID NO: 11856 - protein, 181 aa, Artificial Sequence
  Synthetic
SEKETARKVIEELRKETERLLRESTKTNEDSSRHAKELLKRSEDVAREIEERIDRLLEEKKDGDEVKRLVEELKKRVEELLRRNEELVRRLEEIDKRSNDENRKLAEEDKRRLEDAERRVEEGVPIEEVIKRLEDSSRDVERRLRKSNEDVKRVNKEVADRLKESNDRLREELKKVEDDIR

SEQ ID NO: 11857 - protein, 181 aa, Artificial Sequence; identical to SEQ ID NO: 11856
  Synthetic

SEQ ID NO: 11858 - protein, 181 aa, Artificial Sequence
  Synthetic
DEKEDAERKIRRLEERTKKLLDDSTKTNKESRDHLRKLLADSEKTARDIKRAIKKLLDDKKDGDEVRRLVEELKKIIDKVLEDNKRLIEEVEKIDKDSNDENRKLVDDDRRKLEEVRKLVEEGVDVDTLLTEVTDSSRRVEEELKRSNDEVRRVNREVAERLKKSNRELEEVLRKVAEDIK

SEQ ID NO: 11859 - protein, 181 aa, Artificial Sequence; identical to SEQ ID NO: 11858
  Synthetic

SEQ ID NO: 11860 - protein, 181 aa, Artificial Sequence
  Synthetic
SERERAEEEAKKAKKEAKRLLDESTKANEDSKRHADKLLEDSKRAAEDIKRKAEDLLRKKKDGDRARRLAEEARKIADKAVEDSERLAREAAKIDKDSNDESRRLAREAEEIADRALEAVDRGADARRAIEEVRRALKEAADASRDLNRRAKEANERAAKASEELNKRAEDALRRASEEIR

SEQ ID NO: 11861 - protein, 181 aa, Artificial Sequence; identical to SEQ ID NO: 11860
  Synthetic

SEQ ID NO: 11862 - protein, 181 aa, Artificial Sequence
  Synthetic
SEKEEVKKRVDEIKERLKRLLDDSTRTNEESRKHIEDLLEESKKEIDKVRKDLERLLRKKEEGDRVRELIKEIERILEKAVRDSKELVDRLRKIDEDSNRESKRLIEEVEEILDRALELVKAGVDVDTMTRKVEEVLRDVAEKIKELNRRVEEANKDMARESERLNREVRDVLRKVAKDIE

SEQ ID NO: 11863 - protein, 181 aa, Artificial Sequence; identical to SEQ ID NO: 11862
  Synthetic

SEQ ID NO: 11864 - protein, 181 aa, Artificial Sequence
  Synthetic
SDEDRAREDLKRIKEELKRLLRESTEVNKESEKHIRKLLRESEETIRRLKKAIDDLLRKKREGDEVERLVREAKTRLDEVLKRSKELVDTLREIDKKSNKDSRKLVRDAEEILDRALRLVEAGFDIETILRRLERVLKEVEKKSRELNRRVKEVNEKVRRDIERLNKEVKDVLKTVAERIT

SEQ ID NO: 11865 - protein, 181 aa, Artificial Sequence; identical to SEQ ID NO: 11864
  Synthetic

SEQ ID NO: 11866 - protein, 181 aa, Artificial Sequence
  Synthetic
DEKERAEERIRELKKRTEELLRESTRVNRESKEHAKELLKRSEDTIRELDERIRRLLERKKDGDRVRELVKEAKKRLKEVLEESEDLVRKLEEIDDESNRRSERLVREDERILREARKLVEDGVDVDTVLARLEESSKEVEDRSKRLNEEVKKVNEEVAKRIKELNEEVERVLRRVAEEIE

SEQ ID NO: 11867 - protein, 181 aa, Artificial Sequence; identical to SEQ ID NO: 11866
  Synthetic

SEQ ID NO: 11868 - protein, 182 aa, Artificial Sequence
  Synthetic
SLKEELREKVRKVKEDSERLLRDLERTVKKVREDSKRILDRNRETAKEIERRIRELERNGKISDEAVRRIEEVLKRVIELSERLLRRNEEVLKEVIKKVERMLRENERLLREVEREVDREKDNEELVRKLRKELDDSLKRTKELVDRLKEDLERSLRDSEELARRLDRELEDVLRRIEDEAR

SEQ ID NO: 11869 - protein, 182 aa, Artificial Sequence; identical to SEQ ID NO: 11868
  Synthetic

SEQ ID NO: 11870 - protein, 182 aa, Artificial Sequence
  Synthetic
SLLETLKEIVRRVERESARILEDNRRTVTRAKEESKKILDRNAKTVDDLRKEVERLKTEGKISEELAKEIERVLRDVLRLSKEALERNEKVLREVIETSERALRENRKLLKRVIEEVAREQDNEELVRRLVEELEKSLRTTERLARELDRKIKESLDTSEELARRLDKRLEEVLKDVKRRAE

SEQ ID NO: 11871 - protein, 182 aa, Artificial Sequence; identical to SEQ ID NO: 11870
  Synthetic

SEQ ID NO: 11872 - protein, 182 aa, Artificial Sequence
  Synthetic
RLEEELKKTVDRAREEVKRLLDRDRESVDDLRRAVEEILKTNRRTVEKLRKDLTDLRRNGKIDDELVKRIEEVLKRVERASREALRRIKEVLEEVERKSKKALDDIEKVLREVEDVVRKERDNEKLVRELIEKIKKVLDEVRRLSEKLNEDLREILERVKRLADKLDEELKRMLEKVEETAR

SEQ ID NO: 11873 - protein, 182 aa, Artificial Sequence; identical to SEQ ID NO: 11872
  Synthetic

SEQ ID NO: 11874 - protein, 187 aa, Artificial Sequence
  Synthetic
DDVERVKRDIDRLLEKVTRENEKVKEKMKELLDRAREVNRKVKEDIKRLLKEVEDVARREGGESERVVRRARKVVKDVEDLVREVHKLNEDIVRRAEELVRRLHRLNEEIVREIARLVEEVVRRRGEDTEDVRDLERRLREVEEEARKLSEDVRRVLEEVRKELERLSRDTERVLKRVREEIRKIEK

SEQ ID NO: 11875 - protein, 187 aa, Artificial Sequence; identical to SEQ ID NO: 11874
  Synthetic

SEQ ID NO: 11876 - protein, 187 aa, Artificial Sequence
  Synthetic
SEVEEVIRRVRKLLKDAKDLNEEVKRRLKELLDRVKRVSEKTKEDIKRLLEEVERVVRTKGGETEEVRRRIEDVVRKIRRLSEEIRRILEEVVRRAEELVRRLDELNRDIVRKVKKLAEDVLRSTGEDTDLAERVRDVLRRVAEAAKELSKDTKRVLDEVKKAIDELLKDNKRTVEEVEKEAKKTLK

SEQ ID NO: 11877 - protein, 187 aa, Artificial Sequence; identical to SEQ ID NO: 11876
  Synthetic

SEQ ID NO: 11878 - protein, 187 aa, Artificial Sequence
  Synthetic
DEVEKVKKTLKKLLEDARRRNEEVRKEIEDLDRELERLNRESKKRIEDLLEEVKRVVDRDGGEAEEVRRRIERVVEEIERLSREAAEMNRKVLEEIEELVDRLDRTNKKIVEEAKKLVEDVVRKEGEDTELVRELERVLDTVRREAERLSRKTREVVDESRRRNKKLLEEDERVVRKVVEDAERKLK

SEQ ID NO: 11879 - protein, 187 aa, Artificial Sequence; identical to SEQ ID NO: 11878
  Synthetic

SEQ ID NO: 11880 - protein, 187 aa, Artificial Sequence
  Synthetic
DEVKKVIDDIKDLLRRVEEVSRRVNKELERLLREVREVNKDVKRKLEELLRRVKEVVRRDGGESEEVKRIIDRIVEEAEELVRRVNRLNEEVVREAKELVDRSMKIIEKVVEDIERLVRELLRKEGEDTDLAERVRKVLEDVTRAAKELIKRDKKSLEDVKREIEKLSRDVKRVLEKVAEDAKDTLR

SEQ ID NO: 11881 - protein, 187 aa, Artificial Sequence; identical to SEQ ID NO: 11880
  Synthetic

SEQ ID NO: 11882 - protein, 176 aa, Artificial Sequence
  Synthetic
SEEEDLARVVERVERDLKRLDDDNKRVLDESRRRNEELVKRTAEIVERVRRELERLRREGRVSDEIVERVMREIEKLLRELERINRETIKRNKRLSEEASKINKEVTDRVRELLRDKSERVEEVKRTMEKLLDDVRKANEDSKREIEKSDDEVRKRNEEVVRDIERLLKEVEERAR

SEQ ID NO: 11883 - protein, 176 aa, Artificial Sequence; identical to SEQ ID NO: 11882
  Synthetic

SEQ ID NO: 11884 - protein, 176 aa, Artificial Sequence
  Synthetic
SEEEDLRRRAEEVHRRNEELLRDNERTVKKVHDRNRELLEDLRRVVERIERELRRLEEEGRVSEEEVRKVVETVRKLLKDVEKIVEDSSREVKRLSDEVREVVERSSREVKRLVEEKSSRVEEVKERIDRLHEELEKLSRTTKEKLKELHKRLEDVVREVKRRAEELLREIKERAD

SEQ ID NO: 11885 - protein, 176 aa, Artificial Sequence; identical to SEQ ID NO: 11884
  Synthetic

SEQ ID NO: 11886 - protein, 185 aa, Artificial Sequence
  Synthetic
SEVEEVRKVVEEVKRELRRLSEDSRRVVEEIVEADKRLSEKNETSVREVKKALKKLKDDGVVQEDVVTRVTEEIDRLLRESRESSRESVERIRKLLEDLERVSKEVLERLDRLLEDIERKLSDKDAEELVRDVIRRAREVLKRVEDVHRKVKKDLKKVHDDNKKISEDIDRRLEEVLRKVEEDDR

SEQ ID NO: 11887 - protein, 185 aa, Artificial Sequence; identical to SEQ ID NO: 11886
  Synthetic

SEQ ID NO: 11888 - protein, 185 aa, Artificial Sequence
  Synthetic
SEVEDVKRKVREIEKADEELSKRNEDSARESKKRLKEWSDDTKEVVERVRKRLKDLEDEGKVREEVVKRVKELLDELLDRLRKVSEEVLRRNDKLLKESRDSSRESVRRIRELLEDIRRKLEDEEAERLVREVTKEMKDVHDKNKKLSEDIDKRVEDTNRRLKEVHERVKEEAKKVVRDLEETAK

SEQ ID NO: 11889 - protein, 185 aa, Artificial Sequence; identical to SEQ ID NO: 11888
  Synthetic

SEQ ID NO: 11890 - protein, 185 aa, Artificial Sequence
  Synthetic
SLVETVEDVLREVEERLRKLLRDNEESVERIKKRDEDLSKENEESVKRVEDTLDELRERGVVDESVVKEVKRLVRELLKESRDSSKRSVEVVKELLDESRRVLKELKEEADKLVDRLRDLVDDERVEELVRKVIEDARRLLDDVRRKSERLDREAERVHRENKKLSEDLDRRVKTVVDDVRERAR

SEQ ID NO: 11891 - protein, 185 aa, Artificial Sequence; identical to SEQ ID NO: 11890
  Synthetic

SEQ ID NO: 11892 - protein, 185 aa, Artificial Sequence
  Synthetic
SLVEEVEKEARDIERRDDELSKRNEKVARDIEERDRRLSDEVREVVKRVKRELERLVESGEVDEDVVRRVLELLKEILEEVERSSKKSVDVVKKLLEESEKSSRDSVREVRRLLKEIRDKIDDKDAEKLVRRVIKDLRKLHKENEDLSREIDKRLEDAHKRNRDLVEEVKKRMERVREEVERAAR

SEQ ID NO: 11893 - protein, 185 aa, Artificial Sequence; identical to SEQ ID NO: 11892
  Synthetic

SEQ ID NO: 11894 - protein, 185 aa, Artificial Sequence
  Synthetic
KEKEDVKKVVEDIERADKKLSEDNRRVVKRIEEADRKLSKENKESVERAKKRLDDLERRGEVDRRVVTEVEKTLKEILERSERSSKRSREEVKRLLEESEDSSRRSVEEIRRLLKEIEDKLSREEAEELVRRVIKEMEEVHKRNRDLSKRLDDELKRIHKENEDRLRRLDEEIEKVVKKVEDDAR

SEQ ID NO: 11895 - protein, 185 aa, Artificial Sequence; identical to SEQ ID NO: 11894
  Synthetic

SEQ ID NO: 11896 - protein, 185 aa, Artificial Sequence
  Synthetic
SLVEELRKDVEEIKKRLKRLVEENEKVVREVTEADKKLSKELEDEARDVKRALEELRRRGEVDERVLRRVLEIVDELLERARESSRDSERVVRELLEESRRVVEEVLRRIEKLLEELERLISREEVEELVRRVREDMERVVREVEKVSRDLDREIRRVHRENRELIEDVKRKARKVLRDAEEEAR

SEQ ID NO: 11897 - protein, 185 aa, Artificial Sequence; identical to SEQ ID NO: 11896
  Synthetic

SEQ ID NO: 11898 - protein, 185 aa, Artificial Sequence
  Synthetic
KIVEDVEKVVKEVDDRLKKLVDDNERKVREIIRRDEELSEKNEKSVRDVKEELKRLAEEGTVREEVVRRVEEELRRLLEESRRSSDRSRKRVKKLLDDSRRVADRVREELERLLREVRKKADREEVEKLVREVIDRMRRVVREVEEMSKRLDEELEEVHRRNRETLTRIDEEAKKVVDDVDRRAR

SEQ ID NO: 11899 - protein, 185 aa, Artificial Sequence; identical to SEQ ID NO: 11898
  Synthetic

SEQ ID NO: 11900 - protein, 183 aa, Artificial Sequence
  Synthetic
SVRETLEEVLRRIAEAIDELIKTLEKVLEESRREIERWKKENEDSLREIKKKLEDLEKKIEDERVVRDIRRVLEEVRRLVEESKKILDEVVEDNERLVRELVKELEDVKRKVEELVRDVKRDNTEEKAKRALEEIKRLLERVKKRVEEALEEIKKSNKEAADIVRDIDRRLEELLRTVADKTR

SEQ ID NO: 11901 - protein, 183 aa, Artificial Sequence; identical to SEQ ID NO: 11900
  Synthetic

SEQ ID NO: 11902 - protein, 177 aa, Artificial Sequence
  Synthetic
DEVEEVIKTSREINDRVRRELERVLRRSEEIIEEVAKSIEEVIKESEDIIRKVEKDGDEEALRRAVEESTRLVEEVKRELEEVVERSTRLLEELVRILEEALRRSEELVRDLEARVDKEELKRKIRDVLRDDERAARKWVRDLEEVNKRTEDKIRELLRKLEEVNEKTERDIRRREK

SEQ ID NO: 11903 - protein, 177 aa, Artificial Sequence; identical to SEQ ID NO: 11902
  Synthetic

SEQ ID NO: 11904 - protein, 177 aa, Artificial Sequence
  Synthetic
EEVERVIEEIKKLLKDVAELVERVIKEIRKILDDVAKENKRLLDESRKIIKEVAERGDERMLEDAVRRSNELLKEADRINKEVLKRVRELVKEVERILRDVLRRVDELVKELEKRVDKEEVKRKIRKVLKEIKEEIEKLLKKLRDALRDVEEKIRDLTRRAREVNEKSREDLERRKD

SEQ ID NO: 11905 - protein, 177 aa, Artificial Sequence; identical to SEQ ID NO: 11904
  Synthetic

SEQ ID NO: 11906 - protein, 177 aa, Artificial Sequence
  Synthetic
DEVEDVIRRLEEIIREVEDRLRKILETSKKIIKEVEDENRRVVTEIERILREVEKRADERMLEKVLDDIRKLVEELDRINRKAVEISNRLLEKAKRILDEVLRRVTKLVEDLKDKVDKEELKRRIEEVLERLRRKIERLAKELKDVNDESEREARRLTEEVKRVLEEVARRIKEAAE

SEQ ID NO: 11907 - protein, 177 aa, Artificial Sequence; identical to SEQ ID NO: 11906
  Synthetic

SEQ ID NO: 11908 - protein, 177 aa, Artificial Sequence
  Synthetic
REVEEVRKKIEEDIDRVDKELKEVLETSRDILRRVAKENEDVLRDLERLVDEVRRDSDKDLLEEVLKRVEDLVRELDRKNKEVAERSTRLIEELAKILDDVLKRVEELLEELKRRVDKEELKKKLEKVVRDLSKRLEELLKELEKVNEEVKRRLERLTEEVRKVLEEITKKLKERAR

SEQ ID NO: 11909 - protein, 177 aa, Artificial Sequence; identical to SEQ ID NO: 11908
  Synthetic

SEQ ID NO: 11910 - protein, 177 aa, Artificial Sequence
  Synthetic
SKVEEVMRRLKEILKRVAEELEKVLTESEKILRDVADENRRVMEESRKILKDVAERGDEKALEDALRDSSRLVKDLDEKNRRVLETSTELIERLKKRLEEVLREVKELVDRLKKDVDKEEVKKKIDKVLEDVRKELDDLRRKLEEVNKRIEEEIRRLTEDVRRVNDEIRKRAEDRKR

SEQ ID NO: 11911 - protein, 177 aa, Artificial Sequence; identical to SEQ ID NO: 11910
  Synthetic

SEQ ID NO: 11912 - protein, 182 aa, Artificial Sequence
  Synthetic
SLREKADEVVKRIKERLDRLEDKSREVVKDSRRKLREWYEKSKRAVEDIETKLDELRKDLTDKKAEEILRKVKEDVKRVHEENERILRELKKITDKLHEENKKIIDDVKRKVEDVLRRVRDVDKDMVEELIRELEKIVTDVAKKVEDTIEESRKINEEVAKRVEDTIKRLEDILRDVARRVK

SEQ ID NO: 11913 - protein, 182 aa, Artificial Sequence; identical to SEQ ID NO: 11912
  Synthetic

SEQ ID NO: 11914 - protein, 182 aa, Artificial Sequence
  Synthetic
SLREKVDKVVEEIKRKLDKLLEDSERVVEKSERDLRRWLKEAEEVVREIEKTLKELEKRARDDRLRKIIDEVRKRVERVLEEVEKIIDELRKRSETVHRRNETIIRKVEEDVKRVRDRIERVDKDVVEDLIRELEEIVRRVAEEVRTTIEDLRKINDEVREKVKRLIEELKKILDDVAEEVR

SEQ ID NO: 11915 - protein, 182 aa, Artificial Sequence; identical to SEQ ID NO: 11914
  Synthetic

SEQ ID NO: 11916 - protein, 182 aa, Artificial Sequence
  Synthetic
SLEEKAREVVKEIRRRLDELLRKSHDVVREIEERLDKLEKESEDAVREIEKRLDELAKRITDERAKKILDEVKKEVRRLHEENRKILEEVKKEVRRVNDENRRIIERVKETVDDVLRKVSRVDAKVVEKLIKELRDILREVAERVERTIRRLREIVKRVERKVERSIEEMERIVREAEEETR

SEQ ID NO: 11917 - protein, 182 aa, Artificial Sequence; identical to SEQ ID NO: 11916
  Synthetic

SEQ ID NO: 11918 - protein, 182 aa, Artificial Sequence
  Synthetic
SLREKVDEVVKRIEKRLEELIRKSRKANEDIRKKLEELIKKSEDVVRKIKRELEELKRRVTEDEVKEIIERVLERVERVNEENRKIIEDVLRKSDEVDRRNKDILRRVRERVDEVLEEAKDVEREVVEDLIRELEEILRKVAEEVEDTIRRLEKILKEVAERVERTIKDLEDIVRDVAEKVK

SEQ ID NO: 11919 - protein, 182 aa, Artificial Sequence; identical to SEQ ID NO: 11918
  Synthetic

SEQ ID NO: 11920 - protein, 182 aa, Artificial Sequence
  Synthetic
SLREKVKRMVEEVKRELDELEKESNRAVERVERELEKLIRKSERVNERIRERLKELAARSTDKKVEKILRELKKLSDELDRTNKEIIDRLRKEVREVNDRNRKIIEDVEDFVRRAEDRLRDVEDKVVEKLIKEVRDIVKKVAEEVKKTIEDVERKVKEVAERVEDTIRRLDEAVKEVEERVR

SEQ ID NO: 11921 - protein, 182 aa, Artificial Sequence; identical to SEQ ID NO: 11920
  Synthetic

SEQ ID NO: 11922 - protein, 182 aa, Artificial Sequence
  Synthetic
SLREEAERVIREVREDLDRLRRESKKVNDRIRRTLDELRKRSDDAVRDIKEKLKELAKRTTDEKVKKILKDVEDEVEKVNRENREIIKELEKVSNDLDRRNKEILRTLKKLADEVLERVKDVDKDVVRELAERLKRLLEEVEKRVKDTIRELEKIVEEVRKRVEDTIRRLEEVLDKVAKEVT

SEQ ID NO: 11923 - protein, 182 aa, Artificial Sequence; identical to SEQ ID NO: 11922
  Synthetic

SEQ ID NO: 11924 - protein, 184 aa, Artificial Sequence
  Synthetic
SIEEELKKVLKEIEDRVRKSDKENKEASERIKRTVEELERRLREVLRRIEEAVRKLVREKGEETELVEEVRRLVEELRDRLRKVIEDIRDLVRRLVEHNKRVSDEVKRRVEELKRILEEVLRDSDEKKVKEVVDELRKLLRELEKLSEESNRKLKKLTDDIEKLVRDVEKELRKLLKELAEKIK

SEQ ID NO: 11925 - protein, 184 aa, Artificial Sequence; identical to SEQ ID NO: 11924
  Synthetic

SEQ ID NO: 11926 - protein, 183 aa, Artificial Sequence
  Synthetic
SVEERLKRVLERAREEIKRLLDELERVLEESRKEIKKLSEDLTRANEDTRREIEKLAREITDERLREILERVVRESTRLVEEVHRINEKVLRDNTRLVDEVRKILEEALKRVEELIEELRRVDDERIVKKVEEEIEELVRRVEKRVREVKKRMEDSNREVRKANEEVKKRSEDLLRKVRRDAE

SEQ ID NO: 11927 - protein, 183 aa, Artificial Sequence; identical to SEQ ID NO: 11926
  Synthetic

SEQ ID NO: 11928 - protein, 183 aa, Artificial Sequence
  Synthetic
RVRDELREVLRKAREDIKRLSDKMREVLRESEEKIKRLSDDLRRVNEETKKEIDRLRKEIDKEELKEILKRVVEESTRLVEEANRINREVLRRNEELIREVDRINKEALEEVERLVEELKRVDKKEIFRKVEKEIEDLLEEVRDVNRKIEEEARRSNEDVERVNREIKKRSEELLRDVEKKTE

SEQ ID NO: 11929 - protein, 183 aa, Artificial Sequence; identical to SEQ ID NO: 11928
  Synthetic

SEQ ID NO: 11930 - protein, 183 aa, Artificial Sequence
  Synthetic
SVREELKKALDRVRESIRRLSEELREVLERSEDTIRRLVEDLERVNEETRREIEDLARKIRDDRLRRILEEVLKESTRLVEEVKRILKRVLDENRRLVEEVDRINKDVLREVRRLVEELRRVDDERIMKEIEKRIEDLEREVKEVNREVIERAEESNRRVEELVREAKKRSRELLKRVREEAK

SEQ ID NO: 11931 - protein, 183 aa, Artificial Sequence; identical to SEQ ID NO: 11930
  Synthetic

SEQ ID NO: 11932 - protein, 183 aa, Artificial Sequence
  Synthetic
SVREDLERALRRAAEEIEKLSRDLKRVLEESRKNIERLRRDIERMNEETEKEIRRLAREIDKEELKRILEEVLKRSTELVKRLTEILKRVLDTNTKLVEEVDEINKRVLDEVRKLVERARRVDREEDAEEIKTRIKELIDRVRRVNEEVKERMKKSNEEVEEVVRRVKEESKRLLERVEEDVR

SEQ ID NO: 11933 - protein, 183 aa, Artificial Sequence; identical to SEQ ID NO: 11932
  Synthetic

SEQ ID NO: 11934 - protein, 183 aa, Artificial Sequence
  Synthetic
SLREDLRRVLERARDELRKLSKELKEVLKRSRDNIRKLSEDVKRANERTEEEIRRLTKEIDKDELREILERVLRTSTELVKELNKRNRDVLRENERLVREVDKINKDAAREVTKLVEELDRVDKDEIFKRVKKEIKELVDRVREVNKDVIRRMKKSNDEVKRENEKVIRESEKLLKDVEDARR

SEQ ID NO: 11935 - protein, 183 aa, Artificial Sequence; identical to SEQ ID NO: 11934
  Synthetic

SEQ ID NO: 11936 - protein, 183 aa, Artificial Sequence
  Synthetic
SVRERLEKVLKEVEDSIKELSDDLRRVNKRTEEEIRRLAEDLERVLERIEREIRKLAKEIDKDELREILKRVLEEVERLVREVKEILRDVVRRSSELVERVDKINKDVLEEVRRLVEELRRVDKEEIAERVERTIRKLEDDVRKVNEDVKRRSRELLERVARLVERVKEEAEKLLEDVKRKAD

SEQ ID NO: 11937 - protein, 183 aa, Artificial Sequence; identical to SEQ ID NO: 11936
  Synthetic

SEQ ID NO: 11938 - protein, 183 aa, Artificial Sequence
  Synthetic
SLREDLERVLEEIERELKELSDDLRRMNEETEREIRKLSDDLRRALEKIRDEIRKLAEEIDDKRLEDILRKVLREVEELVKEVNRINREVLRRSSELVKRVDEINKKVLDDVRKLVEELKRADKEEIFRKVKEEARRLVREVEEVNKEVKKRSRDLLREVRKVNEDVKREIERLLRKVAKDAE

SEQ ID NO: 11939 - protein, 183 aa, Artificial Sequence; identical to SEQ ID NO: 11938
  Synthetic

SEQ ID NO: 11940 - protein, 183 aa, Artificial Sequence
  Synthetic
SMREDLRRVLEEAEKKIRKLSKEAKDANRETEKEIRKLSEDVKRVNKESKDEIDRLAEEITDDRLRKILEKVVRESNRLVERLNRINRKVLKESSELIKEVDEINKKVLRDVEKLVEDLKRVDKKEIAEKVKREIEKLVRDVERVNREIIERSEKLLREVREENERVKRESRRLLKEVEKAAE

SEQ ID NO: 11941 - protein, 183 aa, Artificial Sequence; identical to SEQ ID NO: 11940
  Synthetic

SEQ ID NO: 11942 - protein, 183 aa, Artificial Sequence
  Synthetic
SVRETLKKVLEDVRRELKKLSDKLRKVLEDSRRNVKRASDKLREVLKRVKEEIERLRREIDKKELEEILERVLREVKKLVEDVNRINRKVLKENTDLVREVDDINKRVAEEVDELVERLKRVDKEEIAKRIIEEIKKLLDRVREVNEDVIRRMKKSNEDLDRRNEEVRKRIEDLLEKVARDAK

SEQ ID NO: 11943 - protein, 183 aa, Artificial Sequence; identical to SEQ ID NO: 11942
  Synthetic

SEQ ID NO: 11944 - protein, 185 aa, Artificial Sequence
  Synthetic
SLEETAKEVIERSEDHLRRLEETNRKVVEDSERHLDDLTRRIKKVVEDIKKRLDEIEKRGEVDERVLRTLAKKVEDLLRRVEEVVRRVKERTRDHLRDSERVLRELLELSKRILERVRRKSSDERAEELLRTVVKEIEDANRRVEEVSRKNTEDIKEWNKRLEEELRRVVERARRELKKVEDAAR

SEQ ID NO: 11945 - protein, 185 aa, Artificial Sequence; identical to SEQ ID NO: 11944
  Synthetic

SEQ ID NO: 11946 - protein, 185 aa, Artificial Sequence
  Synthetic
SLEETAKRVIEESRKHLDRLRRENERVVKEIRDALRELEKKVEDVVRRIAEELERIRKEGKVPEDVVREVRKTVEKLLRELEDVIRRLKELVDRHLEDSERVVREVKRISDRLLEEVKRKSSREEAEDLLRKVIEDIKELNRELERVSRKNIEDLRRWLEEVREMVKRVEEKAKRVLEELREAAK

SEQ ID NO: 11947 - protein, 185 aa, Artificial Sequence; identical to SEQ ID NO: 11946
  Synthetic

SEQ ID NO: 11948 - protein, 185 aa, Artificial Sequence
  Synthetic
SLEETIEKVVERSKRNLEKLRREIRKVVKESDENLKDVERRAREVVEEIKKALEDIRRKGDVDERVVEEVKRDVDRLEREVKRVLDDLRRVTEELLKRVEDMVRRVLEVSEKLLKEVKDKSSREEAEELLRKVIKESEDLNRRLREEVKKVVREIEEANKRVNDTVRKMEEALKKLLDDLREKAR

SEQ ID NO: 11949 - protein, 185 aa, Artificial Sequence; identical to SEQ ID NO: 11948
  Synthetic

SEQ ID NO: 11950 - protein, 185 aa, Artificial Sequence
  Synthetic
SLEEDMKRVVDESRRNLERVEKENRDVVKESRDNLKKVEDDIRKVVKDIRDELEKIRKRGEVDETVVKRVMDTVRELLKEVKRVIDEVRRRTDEHLKHSKEVVERVLKISEDLLREVEKKSSREEAEELVRRVKETSKRVNEELDKTAKKNVDDIKDWNRRVNEKVKKVKEDAERVLRELEETAR

SEQ ID NO: 11951 - protein, 185 aa, Artificial Sequence; identical to SEQ ID NO: 11950
  Synthetic

SEQ ID NO: 11952 - protein, 185 aa, Artificial Sequence
  Synthetic
SLEETITKVVEESKKNIDRLLEEVRKVVEDSRRDLDRVIDEARKVVEKIDRELKRIEKRGDVDKRVVEEVRKEVKELLDRVREMLERVKRVSDKLLEDLRRLAEEVKKLSTDLLEEVRRKSSREEAEELVRRVKKRSEDVNKKLDEDVEEMKRRSEKLNKDINKDVDRVRKRLEEVLKRLREAAK

SEQ ID NO: 11953 - protein, 185 aa, Artificial Sequence; identical to SEQ ID NO: 11952
  Synthetic

SEQ ID NO: 11954 - protein, 185 aa, Artificial Sequence
  Synthetic
SLKDEIKKVVDDSRRNLEEVKKEITRVVKESRERLEELERDIERLVEKVTRELDRIEEEGRVDSKVVRKVKELIKRLLEEVREVIERLRRRTEKLLEDVKRVVEEVLKVSEKLLRDVERKVSREEAKELVEEVIRRSREVNRDLNRRVREVEKESRDANERVKRRVEEVKRRAREVLERLKKAAE

SEQ ID NO: 11955 - protein, 185 aa, Artificial Sequence; identical to SEQ ID NO: 11954
  Synthetic

SEQ ID NO: 11956 - protein, 185 aa, Artificial Sequence
  Synthetic
SLEEDAKRMVDTNEDRVREWERKIDKVVKDSEKRLRELREDAERMVREIKKELEKIRTEGRVPKEEVKKVLDRVDELLERVEEVVRRVLRVTEELLKEVKRVLKENKEILDRLLKEVTDKSSDERAEELVRRLKKASEDSNEKVARLIEEVIKRSKDVNDDLERDLREVKKRLKDVLKRLKEKAK

SEQ ID NO: 11957 - protein, 185 aa, Artificial Sequence; identical to SEQ ID NO: 11956
  Synthetic

SEQ ID NO: 11958 - protein, 185 aa, Artificial Sequence
  Synthetic
SLEEDAKRAVEESKRTLRELEEENKKVVEDIRRALRRLEEDIKRVVEEIRRELDRIRREGRVDERVLRDVKRLVDELLERVREVIKELEELVKRHLDHSKTVIDRVDEITEELLKDVERKSSDERAEELVRRVKKTIEDVNRKVAKVVKENIKRLREWLKRVEERLKEVKDRLRKVLEDVERAAK

SEQ ID NO: 11959 - protein, 185 aa, Artificial Sequence; identical to SEQ ID NO: 11958
  Synthetic

SEQ ID NO: 11960 - protein, 180 aa, Artificial Sequence
  Synthetic
DVEEDVKRVADDNRRELERWRRDVKKVADEVKDRSRKLERDVERRIREIEKTLEDLRREGLDERVIETLARILKRLLDEVKKLLKDNERVVDRVLTEVDELIRRNEESVRRILEDVKKDRTKEVVKRLKEESKKSNEDVARRVEKLKEELERSTREVERAVRELKKELDEVVREVKERAK

SEQ ID NO: 11961 - protein, 180 aa, Artificial Sequence; identical to SEQ ID NO: 11960
  Synthetic

SEQ ID NO: 11962 - protein, 180 aa, Artificial Sequence
  Synthetic
SIEERLDKLLRDVKRALEELEERIRRSNKRLREAVEKLKKEVEDSNRELDKAVKEVLRRKDEEKAKKLAEAVKRSLDKTRKLVEDVARAIEESLKRVEEIVKRVLKAIEEILEEVRRKVRTEEAVRTAADLLRRVLERVKRLAEELHRHNKEVLDEARKIARDLHRLNEEVLRRVEEATK

SEQ ID NO: 11963 - protein, 180 aa, Artificial Sequence; identical to SEQ ID NO: 11962
  Synthetic

SEQ ID NO: 11964 - protein, 180 aa, Artificial Sequence
  Synthetic
SIEEDLKRLLDEVRKRSKDLKEEVKRSNDRVREDLKRLKEEIDRLLEEARRRLEEIIRRKDREEVKKLLDKIEKVLREVEETVKRLEEDIERSLKKSEELVERALKHDEDVLEDVERRVRDKELVDRARDKIRESLRRSEKIIEELHEHNKDALRRVREEIKRLKDKLKKVVEEVERATR

SEQ ID NO: 11965 - protein, 180 aa, Artificial Sequence; identical to SEQ ID NO: 11964
  Synthetic

SEQ ID NO: 11966 - protein, 178 aa, Artificial Sequence
  Synthetic
DSVERVKEESERTNREIAKLSKKVEDETRKVLKDLEDISRDTERRSREVLERARRDKDKDLLEKLLRDLTETHKEVIKTLEKLLEEVKRIHDRTVEEARRLLEESERIVRKVIKETGEEAELVRELEEVVRENEERVRRLIERNKKLVDDARKRVEELVRRNDKIVKEIEKVVRDIKT

SEQ ID NO: 11967 - protein, 178 aa, Artificial Sequence; identical to SEQ ID NO: 11966
  Synthetic

SEQ ID NO: 11968 - protein, 178 aa, Artificial Sequence
  Synthetic
KSDEEVEKLIREVLKRIEELSREAEKLTDEVRKLLKEISDRVEERSRDVLDKIRRTNDEEVIRRLITELEKEHEEVMRELDRLLKELEDIHRRTIELAKRLLKKVEEIVEKVIREEGEEAELVRKLEKLLEDAERRVRELVKRNKEVVERVKRTVDELKARNKKIVEEIKKVMEEITR

SEQ ID NO: 11969 - protein, 178 aa, Artificial Sequence; identical to SEQ ID NO: 11968
  Synthetic

SEQ ID NO: 11970 - protein, 178 aa, Artificial Sequence
  Synthetic
RELEEVEKKVRTVLEEVRRISEKAEELSRRVLEEARKISEDNEREVRRVVEDVRRENDRELLKKLLEEVRRSSEEVIKRLEDLLRKLEEEHKRVIDKLKDLLRRVREIVEEVIRRTGEEADLVERLKELVKKVEDEVRRLVKRNKDIVDDIRRRVEELVRRNKRITDEVRKEADKLRR

SEQ ID NO: 11971 - protein, 178 aa, Artificial Sequence; identical to SEQ ID NO: 11970
  Synthetic

SEQ ID NO: 11972 - protein, 188 aa, Artificial Sequence
  Synthetic
SELEKVKKEIRELLEEVRKISKESEDRSRKSNDELHKSSEEVEKRIRDLLRELEKIVRELKDGDRETVVRVLDRVVEEVRRIVEEDKRRIEEVLKRDKKLVEESVRLIEKVVRDIEEIVKELERRLREKKDVVKELREVLERAEREARKLIKRNDEILKESEKNARDLIRRTEELLRRAKKRVDELKK

SEQ ID NO: 11973 - protein, 188 aa, Artificial Sequence; identical to SEQ ID NO: 11972
  Synthetic

SEQ ID NO: 11974 - protein, 188 aa, Artificial Sequence
  Synthetic
SDVEEVKKEIARLLEELKRTTDKVKEDSDRSNEEVHRSSEKVKKDIEKLLDELRKVVEELKDGSREEVERLLEEVVRRVKKIVDEDKKKLDDVAKRDEDIVRKDVEELKRVVEEVRRIIAEVKRRLKDLREVVKELEDVLKRAEEVVERLEEKTRRILEESRKNIERLKRETEEMLKRAEDEVKKLKD

SEQ ID NO: 11975 - protein, 188 aa, Artificial Sequence; identical to SEQ ID NO: 11974
  Synthetic

SEQ ID NO: 11976 - protein, 188 aa, Artificial Sequence
  Synthetic
SLVDRVRELIERLLRRLEEIVREVEERLRRSNERLHESSADVERLIRELLERLRDIVRKLEKGDREKVKKVLKEVVEEVRDIVRRDRELLDKVVEENADIIRRVVEELRRVVEEVEKIVRDVKTKLRKDEDVVRELEELLRRAKERVDELKKRLEELLKESREDVERLKKKTDEALKRAEEEVEKLRK

SEQ ID NO: 11977 - protein, 188 aa, Artificial Sequence; identical to SEQ ID NO: 11976
  Synthetic

SEQ ID NO: 11978 - protein, 188 aa, Artificial Sequence
  Synthetic
RDLEEVKKRIDELLKRVRETTKRVEDELRRSNKELHESSRRVEEEIKKLLEELEDVFRKVKDGDRERVKELADRIVEEVKKIVDEDVERLERVVDENRKIVDTDRRDLDRVVEEVTRIVEELKRRLKDKEELVRTLEDMLRRAREEIEKLKEKTRKLLEDSERDVKRLIERTTEVLKRARERVEELKK

SEQ ID NO: 11979 - protein, 188 aa, Artificial Sequence; identical to SEQ ID NO: 11978
  Synthetic

SEQ ID NO: 11980 - protein, 188 aa, Artificial Sequence
  Synthetic
SELEEVKKRIDDLLKRLRDIVDTVRKELRKSDKELHDSSKRVEEEIKKLLEELRRIVETLKKGDREKVTRMLREVVRRVREIVKRDVEELKRVVERNAKIIEDVERELKEAVDRVREIVKELERRLKDLREVVETLRRVLKRAEDDVRRLLEELRELLERSKRNVERLIERTKELLKRAEDEVKKLED

SEQ ID NO: 11981 - protein, 188 aa, Artificial Sequence; identical to SEQ ID NO: 11980
  Synthetic

SEQ ID NO: 11982 - protein, 188 aa, Artificial Sequence
  Synthetic
SLLEKVEEEVRRLLKRLRDIVEEVRRLLEESNERAHRSSKKVKEDIDELLKELEDVVRRVKKGDEEAVRRLLDEVVKTVEEIVRRDVELLREIVEENERIIRKVEEELKRVVEEVRRIVDDVRRKLKDNKDLVKTLEDILERAEREVKKLEDRLRKLLEDSKRNAEELIKRTEDVLEEALRRVEELKK

SEQ ID NO: 11983 - protein, 188 aa, Artificial Sequence; identical to SEQ ID NO: 11982
  Synthetic

SEQ ID NO: 11984 - protein, 178 aa, Artificial Sequence
  Synthetic
SEAERVREILKDAEKKIRDILRRLREINRESARRIEDIKRKLDEILKRNEDDVRRLEKDGADKEILKRALERAEKSVRELRDILKKVLDESSRLVKELEKILRDLLDEVRRLVEEVEKRGDGVEDAERTVRELIKRVEEALERAERASRELIKTVEKVLEEVERRNRKSNEELKEATR

SEQ ID NO: 11985 - protein, 178 aa, Artificial Sequence; identical to SEQ ID NO: 11984
  Synthetic

(The sequence listing continues in the following parts.)

We claim:

1. A cage polypeptide comprising an amino sequence of SEQ ID NO: 6.

2. The cage polypeptide of claim 1, further comprising one or more bioactive peptides within or replacing a latch region of the polypeptide.

3. The cage polypeptide of claim 1, which comprises an amino acid sequence having at least 60% sequence identity, not including optional amino acid residues or latch region, to the amino acid sequence as set forth in SEQ ID NO: 6.

4. The cage polypeptide of claim 3, which comprises the amino acid sequence as set forth in SEQ ID NOS: 6, 16, 17, 56, 57, or 68-80, not including optional amino acid residues or latch region.

5. The cage polypeptide of claim 1, which comprises an amino acid sequence having at least 70% sequence identity, not including optional amino acid residues or latch region, to the amino acid sequence as set forth in SEQ ID NO: 6.

6. The cage polypeptide of claim 5, which comprises the amino acid sequence as set forth in SEQ ID NOS: 6, 51, 54, 55, 61, 65, 27114, or 27115, not including optional amino acid residues or latch region.

7. The cage polypeptide of claim 1, which comprises an amino acid sequence having at least 80% sequence identity, not including optional amino acid residues or latch region, to the amino acid sequence as set forth in SEQ ID NO: 6.

8. The cage polypeptide of claim 7, which comprises the amino acid sequence as set forth in SEQ ID NO: 6-11 or 23-25, not including optional amino acid residues or latch region.

9. A fusion protein comprising the cage polypeptide of claim 1.

10. A fusion protein comprising the cage polypeptide of claim 3.

11. A pharmaceutical composition comprising the polypeptide of claim 1 and a pharmaceutically acceptable carrier.

12. The cage polypeptide of claim 1, wherein the cage polypeptide comprises an amino acid sequence having at least 90% sequence identity, not including optional amino acid residues or latch region, to the amino acid sequence selected of SEQ ID NO:6.

13. The cage polypeptide of claim 1, wherein the cage polypeptide comprises an amino acid sequence having at least 95% sequence identity, not including optional amino acid residues or latch region, to the amino acid sequence selected of SEQ ID NO: 6.

14. A LOCKR switch comprising
(a) the cage polypeptide of claim 1, further comprising a bioactive peptides in the latch region;
(b) a key polypeptide comprising an amino acid sequence having at least 80% sequence identity to the amino acid sequence of SEQ ID NO: 27016; and
(c) optionally, one or more effector polypeptide(s) that bind to the one or more bioactive peptides when the one or more bioactive peptides are activated.

15. The LOCKR switch of claim 14, wherein the effector polypeptide is present, and wherein the effector polypeptide selectively binds to the bioactive peptide.

16. The LOCKR switch of claim 14, wherein the key polypeptide comprises an amino acid sequence selected from the group consisting of SEQ ID NOS: 27016-27020 and 27027-27038.

17. The LOCKR switch of claim 14, wherein the cage polypeptide comprises an amino acid sequence having at least 60% sequence identity, not including optional amino acid residues or latch region, to the amino acid sequence as set forth in SEQ ID NO: 6.

18. The LOCKR switch of claim 17, wherein the cage polypeptide comprises the amino acid sequence as set forth in SEQ ID NO: 6, 16, 17, 56, 57, or 68-80, not including optional amino acid residues or latch region.

19. The LOCKR switch of claim 14, wherein the cage polypeptide comprises an amino acid sequence having at least 70% sequence identity, not including optional amino acid residues or latch region, to the amino acid sequence as set forth in SEQ ID NO: 6.

20. The LOCKR switch of claim 19, wherein the cage polypeptide comprises the amino acid sequence as set forth in SEQ ID NO: 6, 51, 54, 55, 61, 65, 27114, or 27115, not including optional amino acid residues or latch region.

21. The LOCKR switch of claim 14, wherein the cage polypeptide comprises an amino acid sequence having at least 80% sequence identity, not including optional amino acid residues or latch region, to the amino acid sequence as set forth in SEQ ID NO: 6.

22. The LOCKR switch of claim 21, wherein the cage polypeptide comprises the amino acid sequence as set forth in SEQ ID NO: 6-11 or 23-25, not including optional amino acid residues or latch region.

23. A pharmaceutical composition comprising the LOCKR switch of claim 14 and a pharmaceutically acceptable carrier.

24. The LOCKR switch of claim 14, wherein the cage polypeptide comprises an amino acid sequence having at least 90% sequence identity, not including optional amino acid residues or latch region, to the amino acid sequence selected of SEQ ID NO: 6.

25. The LOCKR switch of claim 14, wherein the cage polypeptide comprises an amino acid sequence having at least 95% sequence identity, not including optional amino acid residues or latch region, to the amino acid sequence selected of SEQ ID NO: 6.

26. A method of using the LOCKR switch of claim 14, comprising sequestering the bioactive peptide in the cage polypeptide, holding the bioactive peptide in an inactive ("off") state, until combined with the key polypeptide to induce a conformational change, thus activating ("on") the bioactive peptide.

* * * * *

UNITED STATES PATENT AND TRADEMARK OFFICE
CERTIFICATE OF CORRECTION

PATENT NO. : 10,851,135 B2
APPLICATION NO. : 16/796009
DATED : December 1, 2020
INVENTOR(S) : Robert A. Langan et al.

It is certified that error appears in the above-identified patent and that said Letters Patent is hereby corrected as shown below:

In the Claims

Column 167, Line 2, replace "amino sequence" with --amino acid sequence having at least 40% sequence identity, not including optional amino acid residues or latch region, to the amino acid sequence--

Column 167, Line 49, replace "peptides" with --peptide--

Signed and Sealed this
Second Day of February, 2021

Drew Hirshfeld
*Performing the Functions and Duties of the
Under Secretary of Commerce for Intellectual Property and
Director of the United States Patent and Trademark Office*